United States Patent 11,931,406 (FLAVIVIRUS VACCINE) - sequence listing, part 38

SEQ ID NO: 14625 - RNA, 9876 nt, Artificial Sequence
  derived and/or modified CDS sequence (opt3) from DENV-2__EU482550__SS-prME
accgccggcgugaucauuaugcugauacccacagcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggauuauucggcaagggcgggauugucacaugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccugacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaagguacguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaucaaguuuucggcgcuaucuauggagcggcauuuaguggcgugagcuggacuaugaaaauauugaucgggguaauuaucaccuggauuggaaugaacuccagaucuacgagccugucagucagucucgugcugguuggcguggucacacuuuaccugggugugaugguacaggccgacuccgggugugugguuagcuggaagaauaaagaauugaagugcggaucuggcaucuucauaaccgauaacguccacacuuggacagagcaguauaaguuucagcccgaaucaccaaguaaacucgcuagcgccauucaaaaggcacacgaggaagguaucuguggcauuagguccgugacccggcuggagaauuuaauguggaaacagaucacucccgagcugaaccauauacuaucugaaaaugaggugaagcucaccaucaugacaggggacauuaaaggaaucaugcaggccggcaagcgcucgcugagaccucagccaacggaacuuaaauacagcuggaagaccugggggaaggcuaaaauguuguccacugagucacacaaccaaacauuccugauugauggaccggaaaccgccgagugccccaauacaaacagggcauggaauagucucgaggucgaagacuauggcuuugguguuuucucuacuaacaucuggcugaaguuacgugagaaacaggacguguuuugugauagcaagcugauguccgcggcuauaaaagacaaucgggccgugcaugcagauaugggguacuggauugaaucagcccuuaacgacaccuggaagauggagaaggcuagcuucaucgagguaaaaucuugccacuggccuaagucccacacguuguggaguaauggaguccucgaaagcgagaugaucauucccaaaaauuucgccggccccgugucucagcauaacuaucgaccugguuaccacacacagaccgcaggcccauggcaucuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguaugggauggaaauuaggccauugaaggagaaggaagagaaccuggugaauagcuuaguuacugccggacacggccaaauagauaacuuuucgcucggugugcugggcauggcgcuuuuccuggaagagauguugcgcacacgaguagggaccaaacaugccauccuccuggucgcuguguccuuugugacucuaauuacaggaaauaugucuuuccgggaccugggccgugucaugguuauggugggggcaaccaugacggaugacaucggaaugggcguaacuuaccucgcccugcuugcugccuuuaaggugagacccaccuucgcagcggguuugcuguuaaggaaacucacaagcaaggagcugaugauggccaccauugggaucgcacuucugucacagaguacuauaccugaaacaauccuagagcucaccgaugcccuggcauugggaaugaugguccugaaaauugugcgcaacauggaaaaguaucaguuagcuguuacaaucauggccauucucugcgugcccaaugcagucauccugcaaaacgccuggaagguguccuguacuauacuugcugcgguuucugugagcccacuguugcucaccuccucacagcagaaagccgacuggauuccucuggcacuaacgaucaagggccugaaucccacagcuaucuuucuuaccacucucagccggaccaguaaaaagagaucuuggccacugaacgaggccgucauggccguaggcaugguguccauuuuggcuagcucgcugcucaaaaaugacauaccgaugacagggccucuaguugcaggaggucugcuuacugugugcuacguccugaccggcaggucagccgauuuggaacucgagcgagcggcugacgugaagugggaggaucaggccgaaaucucugggaguucccccauucugagcaucacgauuucugaggacggaagcauguccaucaaaaacgaagaggaggaacaaacacuaaccauacugauccgcacuggccuucucguaauuucagguguguucccagucaguauccccauuacagcagccgcuugguaucugugggagguuaagaagcagcgggcagggguguugugggaugugccuagcccacccccugucggaaaagccgaauuagaggacggcgcguacagaaucaagcagaggggcauauuuggguauucucagauuggagcugguguguacaaagaaggcaccuuccacacuauguggcacguuacacguggggccguacugaugcaucgcggaaagcggaucgagccguccugggcagaugugaaaaaggaccucaucucauacggcgguggguggaagcuggagggagaauggaaagagggcgaagagguccaagugcuugcccuggaaccaggcaagaaucccagagcuguucagaccaaaccuggguuguuuaagacgaacacuggaaccauuggugccgugagucuagauuucagcccaggcacauccgggucucccaucgucgacaggaaaggaaaggugguaggccuguaugguaauggggucgugacccgaucgggagcauacguuagcgcuauagcccagacagagaagucaauugaggauaacccugaaaucgaggacgauauuuuccggaaaaagcgccucacuaucauggaccugcacccgggcgcgggcaaaaccaagagauaucuucccgccauagugagggaagcaauuaaacggggguuacgaacgcugauccucgcuccaacaagagucguggccgcugagauggaagaggcauugcgcggacugccuaucagguaccagacucccgccauucgugccgagcauaccggucgggaaaucguugaccucaugugucacgcuacauuuaccaugagacugcuuuccccagugagggucccuaacuauaaucugauuauaauggaugaggcgcauuucacugaccccgcaaguaucgccgcucgcggcuacauuucuacccgaguggaaaugggggaggccgcaggaaucuuuaugacagccacgccaccgggcagcagagauccuuucccccaauccaacgcuccaaucauggacgaggaacgggagauucccgaaaggucauggaacucuggucacgaguggguaacugauuuuaaggggaagaccgugugguucguuccuagcauaaaagcgggaaacgacaucgccgcaugcuugcgcaagaauggcaaaaaggucauucagcuaagucguaaaacauuugauuccgaauaugugaagaccagagcuaacgacugggauuucguggucacuacagacaucagcgagaugggcgccaauuuucgggcagagaggguaauugauccacgccgauguaugaagcccgugauccugaccgacggggaagagagaguuauacucgccggaccuaugccggugacgcacucuucagcugcccagcggaggggucgcaucggcagaaaccccaaaaaugaaaacgaccaauacauuuacaugggggagcccuuagaaaaugaugaggacugcgcgcauuggaaggaggcaaaaaugcugcuugauaacaucaauacuccugaaggaauuauccccuccauguucgagccagaaagggagaaggucgacgccauagauggcgaauaucggcugcguggugaggcucgcaaaacauuuguggaccucaugcgaagaggggauuugccuguuuggcuggccuacaggguggcugcagagggcauuaacuaugccgaccggcgcugguguuucgauggaaucaagaauaaccagauucucgaagagaacgucgaaguggagaucuggaccaaagagggcgaaagaaagaagcugaaacccagguggcuugacgcucggauauacagugauccacuagcccugaaggaguucaaagaauuugcagcggggcgaaagagcuugaccuuaaaucugaucacugagaugggaagacucccuacauucaugacccagaaagcccgcgacgcucuggauaaccuugccguacugcacacagcagaaguggguggcagggcuuauaaucaugcccucucggaguugccggagacucuggaaacgcuacugcuccuuacccuguuagcaacaguuacugggggaauauuuuuguuccugaugucuggcaaggguaucgggaagaugacccucggcaugugcugcauuaucacagccuccauacugcuuugguacgcucagauucaaccccacuggaucgcggccagcaucauucuggaguuuuuccucaucgucuugcugauaccagaaccugagaaacagcggaccccacaggacaaccaguuaacuuauguggugauugcaauccuaacggucguugcugccaccauggccaaugaaaugggauuucuggagaagaccaaaaaggaccucggccuugggucaauuaucacucaagagagugaaucuaacauacuggauaucgacuugcguccagcauccgcuuggacccuguacgccguggcgacaaccuucguaacuccuaugcucagacacagcauugaaaauucaagugugaacgucagccugacagcuaucgccaaucaggcaacggugcuuaugggacucgguaggggcuggccccuguccaaaauggauauugggguuccguugcuggccaucggauguuacucucaggugaacccaauuaccuuaacugcugcacuacugcuccuugucgcccauuaugcgaucauaggcccuggucugcaggcuaaggccacacgcgaagcacaaaagcgggccgcugccgggauuaugaaaaaucccaccguagacggcaucaccgugaucgauuuggagccaauucccuacgacccuaaguuugaaaaacagcugggacagguuaugcuccuggugcuuugcgucacacagguguuaaugaugcgaacuacgugggcacugugugaggcucucaccuuggccacaggcccgauaagcacucugugggaggggaaccccggaagauucuggaauaccacaaucgcggucuccauggccaacauuuuuaggggcucauaucuagcuggugcugggcuacucuucucuaucaugaagaauaccacuaacacgcgccggggaacaggcaauauuggugaaacccuuggcgagaaauggaagaguagacugaacgccuuggggaagucggaauuucaaaucuacaaaaagagcggaauacaggagguggaucguacucuggcaaaagagggcaucaagagaggggaaaccgaccaccaugcuguuucccggggaucugccaaacuccgcugguucguggagcgaaacaugguaacaccagaaggcaagguggucgaucuggguugcgggagaggaggcuggucauauuacugugguggccuuaaaaauguuagggaggugaaggggcuaacuaagggaggcccugggcacgaggaaccaauuccuaugagcaccuauggauggaaccugguccggcuccaguccggcguggacguauucuuuacaccacccgagaaaugcgauacgcuacugugugacaucggugaaaguucuccuaauccaaccauugaggccgggcgcacuuugagagugcugaaccucguugaaaauuggcuuaacaauaacacacaauucugcaucaaggugcugaaucccuacaugccgagcgucauagagaaaauggaaaccuugcagaggaaguacggaggcgcgcuggugcgaaacccucucucaagaaauuccacucaugagauguauugggucaguaacgcuacaggcaauauugugagcucuguuaacaugaucucccguauguuaaucaauagauuuaccaugaaacacaagaaggcaacguacgagccagauguagaccuggggucaggaacccgcaacauugguauagaaaacgagauccccaaucuugacauuaucggcaaaaggauugaaaagaucaaacaggagcacgaaacaagcuggcauuaugaucaggaccacccuuacaagacuugggccuaucaugggucguacgagaccaaacaaacaggaucugcuaguuccauggugaacggcgucgugaagcugcuaacuaagccaugggauguugugcccauggucacccagauggccaugacagacaccacuccguucggucagcagcggguguuuaaagagaagguagauacgagaacacaagaaccuaaagaggggaccaagaaacucaugcgcauaacugcagaauggcuguggaaggaguugggaaagaaaaagacccccaggauguguacacgagaggaguucacgcggaaagugagaagcaaugccgcucugggcgcgaucuuuaccgacgagaacaaguggaaaucagccagggaagcaguugaggauucccgcuucugggaacucgucgaccgugagcggaaucuucaccuggagggcaagugcgaaacuuguguguauaacaugauggggaaaagagagaagaaguuaggagaauuugguaaagcuaagggcucuagggccauuugguacauguggcugggggcacgcuucuuggaguuugaagcccucggauuccugaaugaggaucacugguuuagccgaggcaacagucuauccgguguggagggggaaggacuucauaaacugggcuacauccuccgggacgucagcaagaaagagggcggggcuauguaugccgaugacacagcgggaugggacaccagaauuacucuggaagauuugaagaaugaggaaaugguuacaaaccacaugaagggugagcauaaaaagcuggcagaggccaucuucaaacucaccuaccagaauaaggugguaagggugcagcgcccaacaccuagaggcacugucauggacauuauaucucggaaagaucagagggggucaggacaagugggcaccuauggucuuaacacguucaccaauauggaagcucagcugauccgucagauggagggggaaggaauuuuuaagaguauccaacacuuaacaguuacugaggagaucgccgugcagaacuggcuggcacgagucggccgcgaaagauugucccggauggcuauuagcggcgacgauugcgugguaaagccccucgacgauagguucgccucugcucugaccgcccuaaaugacauggggaaaguucgcaaggauauacagcagugggagccaucgagaggauggaacgacuggacacaagugcccuuuugcucacaucacuuccacgaacuugucaugaaagauggucgggugcugguggucccuuguaggagccaggacgagcucaucggccgagcacguauuucccagggggcgggauggagucugaaggaaacugccugcuugggcaaaucuuacgcucagauguggaccuuaauguauuuucauagacgcgaucugcggcucgccgcaaacgcuaucuguagcgccguuccaucccacugggugccgacgucaaggacaaccuggaguauucaugcaaagcacgaguggaugacuacagaggacaugcuugccguauggaauagaguguggauccaagaaaaccccuggauggaggacaagacccuggucgaaucuugggaggaagugccuuaccuagguaaacgcgaggaucaguggugcgggagccugauaggacucacuucccgggcgaccugggcuaagaauauccagacagccauuaaccagguuaggucauugaucggcaaugaggaauauacggacuacaugccaagcaugaaacgauucagaaaggaggaagaggaagcaggcgugcugugguga

SEQ ID NO: 14626 - RNA, 9876 nt, Artificial Sequence
  derived and/or modified CDS sequence (opt3) from DENV-2__EU482551__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaccauggccgcaaucuuggccuacacgauuggcacuacacacuuucagcgcguucucaucuucauucugcugaccgcuguggcaccauccaugacuaugagaugcaucgggauaucuaacagggauuuugucgaaggagugucggguggcucauggguagacauuguucucgagcacgggagcugugugacaaccauggccaagaauaagcccacguuagauuucgaacugaucaaaaccgaggcuaagcagccugccacacuucggaaauauugcauugaagcgaaguugacuaacaccacaacugagagucgcuguccaacccaaggagagcccucccugaaugaagagcaggacaaacgauuuaucugcaagcauucuauggucgauagaggcugggguaacggguguggacuauucggcaagggcgggaucgugacaugcgcaauguuuaccugcaaaaagaauauggaaggaaaagugguccucccugagaaccuggaauacacuauuguuauaacgccacacagcggugaggagcaugccgugggcaaugacacagggaagcacggaaaagaaaucaagauuaccccgcaguccucaaucacugaggcugaacuuaccggcuaugguacaguaaccauggaguguagucccaggacugggcuggauuucaacgaaaugguguugcuccagauggaggacaaagccuggcugguccaccggcaaugguuuuuagaucugccucucccauggcuucccggcgcagacacacagggaagcaauuggauacagaaggagacgcuggugaccuucaagaacccucaugcuaaaaagcaggacguuguggucuugggcucucaagaaggggccaugcacacugcgcuaacaggagccaccgagauucagauguccucagguaaucugcucuuuacaggccaucugaaaugccgucuucgcauggauaagcugcaguugaaagggaugagcuacaguauguguacuggaaaguucaagaucgugaaagaaaucgcagagacccaacacggcacgauuguaaucagaguucaguaugagggugacgggucuccaugcaagauucccuucgaaauaauggaucucgagaaaaggcaugugcugggccgguuaaucaccgucaacccgauugugacagaaaaggacuccccugucaacaucgaggcugaacccccauuuggagauagcuacaucauuauaggcguggagccugggcagcugaaacuaaauugguucaagaagggaucgucuaucggucagauguuugagacuaccaugcgaggcgccaaacgcauggcuauucucggggacacagccugggauuucggaucccugggcgguguuuuuacuucaaucgggaaggcacuucaccaaguguucggcgccauuuacggagcugcguuuaguggcguaagcuggaccaugaaaaucuugauaggggucaucauuacguggaucggaaugaacuccagaucuacaagccugucagugagucucguucuggugggcauugucacccuuuaucugggugugaugguacaggcagacacugggugugugguuuccuggaagaauaaagaauugaagugcggaagcggcaucuucauaacagauaacguccacaccuggacugagcaguacaaguuucagcccgaaucuccaucaaaacucgccagugcuauucaaaaggcccaugaggaagguaucuguggcauuaggagcgugacccggcuggagaauuuaauguggaaacagaucacacccgagcugaaccacauacuauccgaaaaugaggugaagcucacgaucaugaccggggacauuaaaggaaucaugcaggcaggcaagcgcucucugagaccucagccaacugaacuuaaauauucguggaagacaugggggaaggccaaaauguugagcaccgagucccauaaccaaacauuccugauugauggaccggaaacugcugagugccccaauaccaacagggccuggaauucacucgaggucgaagacuacggcuuugguguuuucaguacgaacaucuggcugaaguuacgugagaaacaggacguguuuugugauucuaagcugaugagcgcagcgauaaaagacaaucgggcugugcacgccgauaugggguauuggauugaauccgcacuuaacgacacauggaagauggagaaggccucauucaucgagaucaaaagcugccacuggccuaagucucauaccuugugguccaauggaguacucgaaagugagaugauuaucccaaaaaacuucgcuggccccgucagccagcacaacuaccgaccugguuaucauacucagaccgccggcccauggcaccuggggaagcuagaaauggauuuugacuucugugagggaacaacugugguugugaccgaagauugcggcaauagagggcccucucugaggacaacgaccgcauccggaaaacucauuacugaguggugcugucgcucaugcacacugccgccucuucgguacagaggcgaggacgguuguugguacgggauggaaauaaggccauugaaggagaaggaagagaaccuggucaauaguuuagugaccgcuggacauggccaaaucgauaacuuuagccucgguguucugggcauggcccuuuuccuggaagagauguugcgcacucgaguggggacaaaacacgcgauucuccugguagccgucucguuugugacccuaaucacgggaaauauguccuuccgggaccugggccgugugauggucaugguuggggcuacuaugaccgaugacauuggaaugggcgugacauaucucgcacugcuugccgcuuuuaagguaagacccaccuucgccgcagguuugcuguuaaggaaacucacuucuaaggagcugaugauggcgacaaucgggauagcccuucugagccagucaaccaucccugaaacaauucuagagcucacugaugcucuggccuugggaaugauggugcugaaaaucguccgcaacauggaaaaguaccaguuagcagugaccauuauggcuaucaguugcguucccaaugccgugauacuccaaaacgcauggaaggucuccuguacgauucuggccgcugugucuguuagcccacuucuguugacauccucacagcagaaagcggacuggaucccucucgcccugaccaucaagggccuaaaucccacugcaauuuuucugaccacacuuagccggacuaguaaaaagagaucuuggccacucaacgaggcugugauggccgucggcaugguauccauacuggccagcucguugcugaaaaaugacaucccgaugaccgggccuuuaguggcuggaggucuccugacgguuugcuaugugcuuacaggcaggucagcagaucuggaauuggagaaggccgcggacgucaaaugggaggaucaggcugaaauuucugggaguucccccauccucagcauuaccaucucugaggacggaagcauguccauaaagaacgaagaggaggaacacacucugacaauccuaauucgaaccggccugcuugugaucucagguguauucccagugaguauucccaucacugccgcagccugguaccucugggaggucaagaaacaacgcgcugggguucugugggaugugccuagcccacccccugugggaaaggcagaauuggaggacggcgccuaucggauaaaacagagaggcauuuuuggguacucucagaucggagcgggugucuauaaggaaggcacauuccauaccauguggcacgugacgaggggggcuguuuuaaugcaucguggaaaacgcaucgagccguccugggccgauguaaagaaggaccugauuucauacggcgguggguggaaacucgagggagaauggaaggagggcgaagaggugcagguccuggcacuugaaccaggcaaaaauccccgggccgugcaaacuaagccugggcuguuuaaaaccaacacaggaaccaucggugcuguuaguuuggauuucagcccaggcacauccgggucucccauaguggacagaaagggaaaggucgugggccuauacgguaaugggguagucacuaggucgggagccuaugugagcgcaauugcucagaccgagaaaucaaucgaggauaacccugaaauugaggacgauaucuuccgaaagaaacggcugacgauaauggaccuccacccgggcgccggcaagacaaaacgcuaccugcccgcgauuguuagagaagccaucaagagggggcuucggacuuuaauccuggcaccaacccgaguggucgcugccgagauggaagaggcucucagaggauugccuauucgcuaucagacacccgcaaucagggccgagcauaccggucgugaaauuguggaccugaugugucacgccacuuuuaccaugcggcuccuguccccaguuagagugccuaacuacaaucuuauaaucauggaugaggcucacuucacagaccccgcgaguauugcagccaggggcuauaucucuacgcgcgucgaaaugggggaggcugccggaaucuuuaugacugcaaccccaccgggcagccgagauccuuucccccaguccaacgccccaauuauggacgaggaaagagagauacccgaacggucauggaauucuggucaugagugggugacagauuuuaaggggaaaaccguaugguucgugccuagcaucaaggcuggaaacgacauugcggccugccugaggaaaaauggcaagaaaguuauccaauugagucgcaagacuuuugauuccgaauacgucaagacacgugcaaacgacugggauuucguggugaccacggacauuagcgagaugggcgcuaauuuuagagccgagcgggucaucgauccaaggcgcuguaugaaacccguaauacuaacugacggggaagagcgagugauccuggcaggaccuaugccgguuacacacucuucagccgcucagagacgggguaggauuggccgcaacccaaagaaugaaaacgaccaguauaucuacaugggggagccccucgaaaaugaugaggacugcgcccauuggaaagaggcgaagauguuacuggauaacauuaauaccccugaaggaaucauacccuccauguucgagccagaaagagagaaaguggacgcaauugauggcgaauacaggcuucggggugaggcccguaagaccuuugucgaccugaugcgccgaggggaucucccugugugguuggcuuauagaguugccgcugagggcaucaacuacgcagacaggcggugguguuucgauggaauuaaaaauaaccaaauccuggaagagaacguggaagucgagauauggacuaaggagggcgaacgcaagaaacucaagcccagauggcuggacgccaggaucuauagugauccacuugcucuaaaagaguucaaggaauuugccgcagggcggaaaagccugacauugaauuuaauuaccgagaugggacgacugccuacauucaugacucagaaggcgagagacgcccucgauaaccuggcugugcuucacacggccgaaguagguggccgcgcauacaaucacgcucugucggagcucccggagaccuuggaaacacugcuacugcucacucuucuggccaccgugacagggggaaucuuuuuauucuugaugucuggcaaggguauugggaaaaugacccugggcaugugcugcaucauaacugcauccauucuccugugguaugcccagauccagccccauuggaucgcugcgagcauuauccuugaguuuuuccugauaguucucuugauuccagaaccugagaagcaaaggacgccccaggacaaccagcugaccuacgucgugaucgccauuuuaacaguggucgcagcuacuauggccaaugaaaugggauuucuagagaaaaccaagaaagaccugggccucgggucaaucacaacccaggagagugaaucuaacauacuugauaucgaccugcggccagccuccgcauggacuuuguaugcuguugccacaacguucgugaccccuaugcugcgucacagcauugagaauucaaguguaaacgugagccucacugcgaucgcuaaucaagccacaguccugaugggacuugguagaggcuggccccucuccaagauggauauuggggugccgcuguuggcaaucggauguuacucucagguuaacccaauuacccugaccgccgcuuuacuacugcucguggcacauuacgccaucauaggcccuggucuucaggcgaaggcuacaagggaagcccagaaacgcacugcagccgggauuaugaagaaucccacggucgacggcaucaccguaaucgaucuggagccaauucccuaugacccuaaauuugaaaagcaauugggacaggugaugcugcucguucugugcgugacacagguccuuaugaugcggacuaccugggcuuuaugugaggcccugacacucgcaaccggcccgauaagcacuuugugggaggggaaccccggacgauucuggaauacgacaaucgcuguguccauggccaacauuuuuagaggcucauaccuggcgggugccgggcuacuguucucuaucaugaaaaauaccacuaacaccaggcgcggaacaggcaauauuggugaaacucucggcgagaaguggaagagucggcuuaacgcacuggggaaaucggaauuucagaucuauaagaaaagcggaauacaagaggucgauagaaccuuggcuaaggagggcaucaaacguggggaaacagaccaccaugccguguccaggggaucugcaaagcugcggugguucguugagcgcaacauggugacgccagaaggcaaaguaguggaucucgguugcgggcgaggaggcuggucauacuauugugguggccugaagaaugucagagagguuaagggguuaaccaaaggaggcccugggcacgaagagcccauuccuaugagcacuuacggauggaaccuugugaggcugcaguccggcgucgacguguucuuuacaccacccgagaagugcgauacccuccuaugugacaucggugaaaguucuccuaauccaacuauugaggcugggcggacacugcgcguauugaaccugguggaaaauuggcucaacaauaacacccaguucugcguuaaagugcuuaaucccuauaugccgagcgucaucgagaagauggaaacgcugcaaagaaaauacggaggcgccuuggugaggaacccucugucacgaaauuccacccacgagauguacugggucaguaacgccacaggcaauauagugagcucuguuaacaugauuucccggaugcucaucaaucguuuuacuaugaagcauaagaaagcgaccuaugagccagauguagacuuagggucaggaacaagaaacaucgguauugaaaacgagauacccaaucuggacaucauuggcaagcgcaucgaaaaaauuaagcaggagcacgaaacuagcuggcauuacgaucaggaccacccuuauaaaaccugggcuuaccacgggucguaugagacaaagcagaccggaucugcaaguuccauggugaacggcgucgugaagcuucugacuaaaccaugggauguugugcccauggucacgcaaauggccaugacagacaccacuccguucggucagcagaggguguuuaaggagaaaguagauacccggacacaggaaccuaaggaggggacgaaaaagcuaaugagaaucaccgcugaauggcucuggaaggagcugggaaaaaagaaaacuccccgcauguguacaagggaggaauucacccgaaaggugcggagcaaugccgcauugggcgccauauuuacugacgagaacaaauggaagucagcuagagaagcgguugaggauuccagguucugggaacuggucgaccgcgagcguaaucuccaucuugagggcaaaugcgaaacauguguguacaacaugauggggaagcgggagaagaaacugggagaauuugguaaggccaaaggcucuagagcaaucugguauaugugguuaggggcuagguuccuggaguuugaagccuugggauuccucaaugaggaucacugguuuagccgcggcaacagucuguccgguguggagggggaaggacuacauaagcuuggcuacauucugcgagacgucagcaaaaaggagggcggggcaauguacgccgaugacaccgcuggaugggacacacggaucacucucgaagaucugaagaaugaggaaaugguuaccaaccacaugaaaggugagcauaagaaauuggccgaggcgauuuucaagcugacguaucaaaauaaagugguaagagugcagaggccaaccccucgcggcacagucauggacaucauuucuagaaaggaucagcgggggucaggacaggugggcacuuacggucucaacaccuucacaaauauggaagcacaacuuauaaggcagauggagggggaaggaaucuuuaagaguauucagcgucugacuguuaccgaggagaucgccgugcaaaacugguuagcucgagucggccgcgaaagacugucccggauggccaucagcggcgacgauugcgugguaaaacccuuggacgauagguucgcaucugcucucacggcccugaaugacauggggaagguucgcaaagauauucagcagugggagccaucgagaggauggaacgacuggacacaggugcccuuuugcucacaccacuuccaugaacuagucaugaaggauggucggaugcuuguggugccuuguaggaaccaagacgagcugauaggccgagcucguaucagccagggggccggauggucccucaaagaaaccgcaugccugggcaagaguuaugcgcagauguggacuuugauguacuuucacagacgcgauuuacggcuggccgcuaaugccauuuguucugcagucccaagccauuggguuccgacauccaggaccacuuggucaauccacgcuaagcacgaguggaugaccacagaggacaugcucgccguguggaacagaguauggauucaggaaaaucccuggauggaggacaaaacgccuguggaaaguugggaggaagucccauaucuugguaagcgcgaggaucaauggugcgggucucugaucggacuaaccagccgggcaacuugggccaaaaacauacagacagcgaucaaucaggugaggucccugauuggcaacgaggaauacaccgacuauaugcccucaaugaagcgauucagaaaagaggaagaggaagcuggcguucucugguga

SEQ ID NO: 14627 - RNA, 9876 nt, Artificial Sequence
  derived and/or modified CDS sequence (opt3) from DENV-2__EU482552__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaacugggaaggcccuucaccaaguuuucggcgcuauuuacggagcggcauuuaguggcgugagcuggaccaugaaaaucuugauagggguaaucauuacguggaucggaaugaacuccagaucuacaagccugucagucagucucgugcugguuggcguggucacccuuuaucugggugugaugguacaggccgacacugggugugugguuuccuggaagaauaaagaauugaagugcggaagcggcauuuucaucacagauaacguccacaccuggacugagcaguacaaguuucagcccgaaucuccaucaaaacucgcuagugccauacaaaaggcacaugaggaagguauuuguggcaucaggagcgugacccggcuggagaauuuaauguggaaacagauuacacccgagcugaaccacauccuauccgaaaaugaggugaagcucacgauaaugaccggggacaucaaaggaauuaugcaggccggcaagcgcucucugagaccucagccaacugaacuuaaauauucguggaagacaugggggaaggcuaaaauguugagcaccgagucccauaaccaaacauuccugaucgauggaccggaaacugccgagugccccaauaccaacagggcauggaauucacucgaggucgaagacuacggcuuugguguuuucaguacgaacauuuggcugaaguuacgugagaaacaggacguguuuugugauucuaagcugaugagcgcggcuaucaaagacaaucgggccgugcacgcagauaugggguauuggauagaauccgcccuuaacgacacauggaagauggagaaggcuucauucauugagaucaaaagcugccacuggccuaagucucauaccuugugguccaauggaguacucgaaagugagaugaucauuccaaaaaacuucgccggccccgucagccagcacaacuaccgaccugguuaucauacucagaccgcaggcccauggcaccuggggaagcuagaaauggauuuugacuucugugagggaacaacugugguugugaccgaagauugcggcaauagagggcccucucugaggacaacgaccgcuuccggaaaacucaucacugaguggugcugucgcucaugcacacugccgccucuucgguacagaggcgaggacgguuguugguacgggauggaaauuaggccauugaaggagaaggaagagaaccuggucaauaguuuagugaccgccggauauggccaaauagauaacuuuagccucgguguucugggcauggcgcuuuuccuggaagagauguugcgcacucgaguggggacaaaacaugccauccuccugguagcugucucguuugugacccuaauuacgggaaauauguccuuccgggaccugggccgugugauggucaugguuggggcaacuaugaccgaugacaucggaaugggcgugacauaccucgcccugcuugcugccuuuaagguaagacccaccuucgcagcggguuugcuguuaaggaaacucacuucuaaggagcugaugauggccacaauugggaucgcucuucugagccagucaaccauaccugaaacaauccuagagcucacugaugcccuggcauugggaaugauggugcugaaaauuguccgcaacauggaaaaguaucaguuagcugugaccaucauggccauuaguugcguucccaaugcagugauccuccaaaacgccuggaaggucuccuguacgauacuggcugcggugucuguuagcccacuucuguugacauccucacagcagaaagccgacuggauuccucucgcacugaccaucaagggccuaaaucccacugcuaucuuucugaccacacuuagccggacuaguaaaaagagaucuuggccacucaacgaggccauuauggccgugggcauggucuccauacuggcuagcucguugcugaaaaaugacaucccgaugaccgggccuuuaguagcaggaggucuccugacggugugcuacguucuuacaggcaggucagccgaucuggaauuggagcgagcggcugacgugaagugggaggaucaggccgaaauuucugggaguucccccauccucagcauuaccaucucugaggacggaagcauguccauaaaaaacgaagaggaggaacacacucugacaauccuaauucgcaccggccugcuugucaucucagguguguucccaguaaguauucccaucacugcagccgcuugguaucucugggaggugaagaagcaacgggcagggguccugugggauguuccuagcccacccccugugggaaaagccgaauuggaggacggcgcguacagaauaaagcagaggggcauuuuuggguauucucagaucggagcugguguguacaaagaaggcacauuccacaccauguggcaugucacgcguggggccguguuaaugcaccgcggaaagcggaucgagccguccugggcagauguuaaaaaggaccugauuucauacggcgguggguggaagcucgagggagaauggaaagagggcgaagagguacaggugcuggcccuugaaccaggcaagaaucccagagcuguccaaacuaaaccugggcuguuuaagaccaacacaggaaccaucggugccgugaguuuggauuucagcccaggcacauccgggucucccauaguugacaggaaaggaaagguggucggccuauaugguaauggggugguaacucgaucgggagcauacgucagcgcuauugcccagaccgagaagucaaucgaggauaacccugaaauugaggacgauaucuuccggaaaaagcgccugacgauaauggaccuccauccgggcgcgggcaaaacaaagagauaucugcccgccauugugagggaagcaaucaaacgggggcuucgaacuuuaauccuggcuccaaccagaguuguggccgcugagauggaagaggcacuccgcggauugccuauuagguaccagacacccgccauccgugccgagcacaccggucgggaaauugucgaccugaugugucaugcuacuuuuaccaugagacuccuguccccagugaggguuccuaacuauaaucuuauaaucauggaugaggcgcacuucacagaccccgcaaguauugccgcucgcggcuacaucucuacgcgaguggaaaugggggaggccgcaggaaucuuuaugacugccaccccaccgggcagcagagauccuuucccccaguccaacgcuccaauuauggacgaggaacgggagauacccgaaaggucauggaauucuggucacgagugggucacagauuuuaaggggaagaccgugugguucguaccuagcaucaaagcgggaaacgacauugccgcaugccugcgcaagaauggcaaaaaggugauccaauugagucguaaaacuuuugauuccgaauauguuaagacaagagcuaacgacugggauuucgucgugaccacggacauuagcgagaugggcgccaauuuucgggcagagagggugaucgauccacgccgauguaugaagcccgucauacuaacugacggggaagagagaguaauccuggccggaccuaugccggugacacauucuucagcugcccagcggaggggucgcauuggcagaaacccaaaaaaugaaaacgaccaguacaucuacaugggggagccccucgaaaaugaugaggacugcgcgcacuggaaggaggcaaaaauguuacuggauaacauuaauaccccugaaggaaucauacccuccauguucgagccagaaagggagaagguugacgccauugauggcgaauaucggcuucguggugaggcucgcaaaaccuuuguggaccugaugcgaagaggggaucucccugucugguuggccuacaggguggcugcagagggcaucaacuaugccgaccggcgcugguguuucgauggaauuaagaauaaccaaauccuggaagagaacguugaaguggagauauggacuaaagagggcgaaagaaagaagcucaaacccagguggcuggacgcucggaucuacagugauccacuugcccuaaaggaguucaaagaauuugcagcggggcgaaagagccugacauugaauuuaauuaccgagaugggaagacugccuacauucaugacucagaaagcccgcgacgcucucgauaaccuggccguccuucauacggcagaaguggguggcagggcuuauaaucacgcccugucggagcucccggagaccuuggaaacacugcuacugcucacucuucuggcaaccguaacagggggaaucuuuuuauucuugaugucuggcaaggguauugggaagaugacccugggcaugugcugcaucauaacugccuccauucuccugugguacgcucagauccagccccacuggaucgcggccagcauuauccuugaguuuuuccugauagugcucuugauuccagaaccugagaaacaacggacgccccaggacaaccagcugaccuauguugucaucgcaauuuuaacagugguggcugccacuauggccaaugaaaugggauuucuagagaagaccaaaaaggaccugggccucgggucaaucacaacccaggagagugaaucuaacauacuugauaucgaccugcguccagcauccgcuuggacuuuguacgccgucgcgacaacguucguuaccccuaugcugagacauagcauugagaauucaagugugaacguaagccucacugcuaucgccaaucaagcaacagugcugaugggacuugguaggggcuggccccucuccaaaauggauauuggggucccgcuguuggccaucggauguuacucucaggugaacccaauuacccugaccgcugcauuacuacugcucguugcccacuaugcgaucauaggcccuggucuucaggcuaaggccacacgcgaagcacagaagcggacugccgcugggauuaugaaaaaucccacgguggacggcaucaccgucaucgaucuggagccaauucccuacgacccuaaguuugaaaaacaauugggacagguaaugcugcucgugcugugcguuacacaggugcuuaugaugcgaacuaccugggccuuaugugaggcacugacacucgcuaccggcccgauaagcacuuugugggaggggaaccccggaagauucuggaauacgacaaucgccgucuccauggcgaacauuuuuaggggcucauaucuggccggugcagggcuacuguucucuaucaugaagaauaccacuaacacccgccggggaacaggcaauauuggugaaacucucggcgagaaauggaagaguagacuuaacgcucuggggaagucggaauuucagaucuacaaaaagagcggaauacaagagguggaucguaccuuggccaaagagggcaucaagaggggggaaacagaccaucacgcagucucccggggaucugcuaaacugcgcugguucguggagcgaaacaugguuacgccagaaggcaaggugguagaucucgguugcgggagaggaggcuggucauauuacugugguggccugaaaaaugugagggaggucaagggguuaaccaagggaggcccugggcaugaagagcccauuccuaugagcacuuauggauggaaccuuguucggcugcaguccggcguggacgucuucuuuacaccacccgagaaaugcgauacccuccuaugugacaucggugaaaguucuccuaauccaacuauugaggccgggcgcacacugagaguguugaaccugguagaaaauuggcucaacaauaacacccaguucugcgugaagguucuuaaucccuacaugccgagcgugaucgagaaaauggaaacgcugcaaaggaaguacggaggcgccuugguccgaaacccucugucacggaauuccacccacgagauguauugggugaguaacgcgacaggcaauauagucagcucugugaacaugauuucccguaugcucaucaauagauuuacuaugaaacacaagaaggcuaccuacgagccagauguugacuuagggucaggaacacgcaacaucgguauugaaaacgagauacccaaucuggacaucauuggcaaaaggaucgaaaagauuaaacaggagcaugaaacuagcuggcacuaugaucaggaccauccuuacaagaccugggcauaucacgggucguacgagacaaaacagaccggaucugccaguuccaugguaaacggcguggucaagcuucugacuaagccaugggaugugguucccauggugacgcaaauggcuaugacagacaccacuccguucggucagcagcgggucuuuaaagagaagguggauaccagaacacaggaaccuaaagaggggacgaagaaacuaaugcgcaucaccgccgaauggcucuggaaggagcugggaaagaaaaagacucccaggauguguacacgagaggaauucacccggaaaguaagaagcaaugcagccuugggcgcuauauuuacugacgagaacaaguggaaaucagcgagggaagccguggaggauucccgcuucugggaacugguugaccgugagcggaaucuccaccuugagggcaagugcgaaacaugugucuauaacaugauggggaaaagagagaagaagcugggagaauuugguaaagcaaagggcucuagggcuaucugguacaugugguuaggggcccgcuuccuggaguuugaagcauugggauuccucaaugaggaucauugguuuagccgaggcaacagucuguccgguguggagggggaaggacuacacaaacuuggcuacauucugcgggacgugagcaagaaagagggcggggccauguaugcugaugacaccgccggaugggacacaagaaucacucucgaagaucugaagaaugaggaaauggucaccaaccauaugaagggugagcacaaaaaguuggcggaggcaauuuucaaacugacguaccaaaauaagguugugaggguacagcgcccaaccccuagaggcacagugauggacaucauuucucggaaagaucagagggggucaggacaggucggcacuuauggucucaacaccuucacaaauauggaagcccaacuuauacgucagauggagggggaaggaaucuuuaagaguauucagcgacugacugugaccgaggagaucgcuguucaaaacugguuagcccgcgugggcagagaacggcuguccaggauggcaaucagcggcgacgauugcgucgugaagcccuuggacgaucgcuucgcuucugcccucacggcucugaaugacauggggaaaguaagaaaggauauucagcagugggagccaucgcggggauggaacgacuggacacagguucccuuuugcucacaucacuuccacgaacuagugaugaaagaugguaggguccuuguggugccuugucgaaaccaagacgagcugauaggccgugccagaaucagccagggggcaggauggucccucaaggaaaccgcgugccugggcaaaaguuacgcccagauguggacuuugauguauuuucaucgccgggauuuaaggcuggcugccaaugcaauuuguucugcugucccaagccacuggguuccgacauccagaaccacuuggucaauccaugccaagcacgaguggaugaccacagaggacaugcucgcaguguggaaccgcguauggauucaggaaaaucccuggauggaggacaagacgccuguggaaaguugggaggaagucccauaccuugguaaacgggaggaucaauggugcgggucucugaucggacuaaccagcagggccacuugggcgaagaacauacagacagcuaucaaucaggugcgaucccugauuggcaacgaggaauauaccgacuacaugcccucaaugaaaagauuccggaaggaggaagaggaagccggcguucucugguga

SEQ ID NO: 14628 - RNA, 9876 nt, Artificial Sequence
  derived and/or modified CDS sequence (opt3) from DENV-2__EU482554__SS-prME
accgccggagugaucauuaugcugauacccacagcuauggcauuccaccucacuacgcggaauggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacugcuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggacuauucggcaagggcgggauuguaaccugcgccauguuuacaugcaaaaagaauauggaaggaaccguggugcucccugagaaccuggaauacacuauagucaucacgccacacagcggugaggagcaugcuguuggcaaugacacagggaaacacggaaaggaaauuaaaaucaccccgcaguccucaauaacugaggccgaacuuaccggcuaugguacagugaccauggaguguagucccaggacugggcuggauuucaacgaaaugguauugcuccagauggaggacaaggcauggcuggugcaccggcaaugguuuuuagaucugccucucccauggcuucccggcgcugacacacagggaagcaauuggauucagaaagagacgcuggucaccuucaagaacccucaugccaagaaacaggacgugguuguguugggcucucaagaaggggcgaugcacacugcccuaacaggagcaaccgagauccagauguccucagguaaucugcucuuuacaggccaucugaagugccgucuucgcauggauaaacugcaguugaaggggaugagcuacaguauguguacuggaaaauucaagaucgucaaggaaauugcugagacccaacacggcacgaucgugauuagaguacaguaugagggugacgggucuccaugcaaaauacccuucgaaaucauggaucucgagaagagguacguucugggccgguuaauuaccgugaacccgaucgucacagaaaaagacuccccugugaacaucgaggccgaacccccauuuggagauagcuacauuauaaucggcgucgagccugggcagcugaagcuaaauugguucaaaaagggaucgucuauuggucagauguuugagacuaccaugcgaggcgcuaagcgcauggccauccucggggacacagcaugggauuucggaucccugggcgguguguuuacuucaauugggaaagcccuucaucaaguuuucggcgcuaucuauggagcggcauuuaguggcgugagcuggaccaugaagauauugaucgggguaauuaucacguggauuggaaugaacuccagaucuacaagccugucagucagucucgugcugguuggcguggucacccuuuaccugggugugaugguacaggccgacuccgggugugugguuagcuggaaaaauaaggaauugaaaugcggaucuggcaucuucauaacugauaacguccacacauggaccgagcaguauaaguuucagcccgaaucaccaaguaagcucgcuagcgccauucaaaaagcacacgaggaagguaucuguggcauuagguccgugacucggcuggagaauuuaauguggaagcagaucacccccgagcugaaccauauacuaucugaaaaugaggugaaacucacaaucaugacgggggacauuaagggaaucaugcaggccggcaaacgcucgcugagaccucagccaaccgaacuuaaguacagcuggaaaacuugggggaaggcuaagauguuguccacagagucacacaaccaaaccuuccugauugauggaccggaaacagccgagugccccaauacuaacagggcauggaauagucucgaggucgaagacuauggcuuugguguuuucucuaccaacaucuggcugaaauuacgugagaagcaggacguguuuugugauagcaaacugauguccgcggcuauaaaggacaaucgggccgugcaugcagauaugggguacuggauugaaucagcccuuaacgacacguggaaaauggagaaggcuagcuucaucgagguaaagucuugccacuggccuaaaucccacacauuguggaguaauggaguccucgaaagcgagaugaucauuccaaagaacuucgccggccccgugucucagcauaacuaucgaccugguuaccacacccagacugcaggcccauggcaucuggggaaacuagaaauggauuuugacuucugugagggaaccacaguuguggucacugaagauugcggcaauagagggcccucccugaggaccacaacggcuucaggaaagcucaucaccgaguggugcugucgcaguugcacucugccgccucuucgguacagaggcgaggacgguuguugguaugggauggaaauuaggccauugaaagagaaggaagagaaccuggugaauagcuuaguuacagccggacacggccaaauagauaacuuuucgcucggugugcugggcauggcgcuuuuccuggaagagauguugcgcacccgaguagggacuaagcaugccauccuccuggucgcuguguccuuugugacacuaauuaccggaaauaugucuuuccgggaccugggccgugucaugguuauggugggggcaacgaugacugaugacaucggaaugggcguaaccuaccucgcccugcuugcugccuuuaaagugagacccacauucgcagcggguuugcuguuaaggaagcucaccagcaaagagcugaugauggccacuauugggaucgcacuucugucacagaguacaauaccugaaaccauccuagagcucacagaugcccuggcauugggaaugaugguccugaagauugugcgcaacauggaaaaauaucaguuagcuguuacuaucauggccauucucugcgugcccaaugcagucauccugcaaaacgccuggaagguguccuguaccauacuugcugcgguuucugugagcccacuguugcucacguccucacagcagaaggccgacuggauuccucuggcacuaacaaucaaaggccugaaucccaccgcuaucuuucuuacuacccucagccggacaaguaagaaaagaucuuggccacugaacgaggccgucauggccguaggcaugguguccauuuuggcuagcucgcuguuaaagaaugacauaccgaugacugggccucucguugcaggaggucugcuuaccgugugcuacguccugacgggcaggucagccgauuuggaacucgagcgagcggcugacgugaaaugggaggaucaggccgaaaucucugggaguucccccauucugagcaucacaauuucugaggacggaagcauguccaucaagaacgaagaggaggaacaaacccuaacuauacugauccgcacaggccuucucguaauuucagguguguucccagucaguauccccauuaccgcagccgcuugguaucugugggagguuaaaaagcagcgggcagggguguugugggaugugccuagcccacccccugucggaaaggccgaauuagaggacggcgcguacagaaucaaacagaggggcauauuuggguauucucagauuggagcugguguguacaaggaaggcacuuuccacacaauguggcacguuacccguggggccguacugaugcaucgcggaaaacggaucgagccguccugggcagaugugaagaaagaccucaucucauacggcgguggguggaagcuggagggagaauggaaggagggcgaagagguccaagugcuugcccuggaaccaggcaaaaaucccagagcuguucagacgaagccuggguuguuuaaaacuaacaccggaacaauuggugccgugagucuagauuucagcccaggcaccuccgggucucccaucgucgacaggaagggaaaagugguaggccuguaugguaauggggucgugacacgaucgggagcauacguuagcgcuauagcccagacugagaagucaauugaggauaacccugaaaucgaggacgauauuuuccggaagaaacgccucaccaucauggaccugcacccgggcgcgggcaagacgaaaagauaucuucccgccauagugagggaagcaauuaagcggggguuacgaacacugauccucgcuccaacuagagucguggccgcugagauggaagaggcauugcgcggacugccuaucagguaccagacccccgccauucgugccgagcauacaggucgggaaaucguugaccucaugugucacgcuaccuuuacuaugagacugcuuuccccagugagggucccuaacuauaaucugauuauaauggaugaggcgcauuucaccgaccccgcaaguaucgccgcucgcggcuacauuucuacacgaguggaaaugggggaggccgcaggaaucuuuaugacggccacuccaccgggcagcagagauccuuucccccaauccaacgcuccaaucauggacgaggaacgggagauucccgaaaggucauggaacucuggucacgaguggguaaccgauuuuaaagggaagacagugugguucguuccuagcauaaaggcgggaaacgacaucgccgcaugcuugcgcaaaaauggcaagaaagucauucagcuaagucguaagaccuuugauuccgaauaugugaaaacuagagcuaacgacugggauuucguggucacaaccgacaucagcgagaugggcgccaauuuucgggcagagaggguaauugauccacgccgauguaugaagcccgugauccugacggacggggaagagagaguuauacucgccggaccuaugccggugacucacucuucagcugcccagcggaggggucgcaucggcagaaacccaaagaaugaaaacgaccaauacauuuacaugggggagcccuuagaaaaugaugaggacugcgcgcauuggaaagaggcaaagaugcugcuugauaacaucaauacaccugaaggaauuauccccuccauguucgagccagaaagggagaaagucgacgccauagauggcgaauaucggcugcguggugaggcucgcaagaccuuuguggaccucaugcgaagaggggauuugccuguuuggcuggccuacaggguggcugcagagggcauuaacuaugccgaccggcgcugguguuucgauggaaucaaaaauaaccagauucucgaagagaacgucgaaguggagaucuggaccaaggagggcgaaaggaagaaacugaaacccagguggcuugacgcucggauauacagugauccacuagcccugaaagaguucaaggaauuugcagcggggcgaaagagcuugacuuuaaaucugaucacagagaugggaagacucccuaccuucaugacacagaaggcccgcgacgcucuggauaaccuugccguacugcacacugcagaaguggguggcagggcuuauaaucaugcccucucggaguugccggagacgcuggaaacccuacugcuccuuacacuguuagcaacuguuaccgggggaauauuuuuguuccugaugucuggcaaagguaucgggaagaugacacucggcaugugcugcauuaucaccgccuccauacugcuuugguacgcucagauucaaccccacuggaucgcggccagcaucauucuggaguuuuuccucaucgucuugcugauaccagaaccugagaagcagcggacuccccaggacaaccaguuaacguauguggugauugcaauccuaaccgucguugcugccacaauggccaaugaaaugggauuucuggagaaaacuaagaaagaccucggccuugggucaauuaucacccaagagagugaaucuaacauacuggauaucgacuugcguccagcauccgcuuggacacuguacgccguggcgaccacuuucguaacaccuaugcucagacacagcauugaaaauucaagugugaacgucagccugacggcuaucgccaaucaggcaaccgugcuuaugggacucgguaggggcuggccccuguccaagauggauauugggguuccguugcuggccaucggauguuacucucaggugaacccaauuacuuuaacagcugcacuacugcuccuugucgcccauuaugcgaucauaggcccuggucugcaggcuaaagccacccgcgaagcacaaaagcgggccgcugccgggauuaugaagaaucccaccguagacggcaucacagugaucgauuuggagccaauucccuacgacccuaaauuugaaaagcagcugggacagguuaugcuccuggugcuuugcgucacucagguguuaaugaugcgaacgaccugggcacugugugaggcucucacauuggccacuggcccgauaagcacccugugggaggggaaccccggaagauucuggaauacaaccaucgcggucuccauggccaacauuuuuaggggcucauaucuagcuggugcugggcuacucuucucuaucaugaaaaauacuacgaacacacgccggggaaccggcaauauuggugaaacucuuggcgagaaguggaaaaguagacugaacgccuuggggaagucggaauuucaaaucuacaagaaaagcggaauacaggagguggaucguacccuggcaaaggagggcaucaaaagaggggaaacagaccaccaugcuguuucccggggaucugccaagcuccgcugguucguggagcgaaacaugguaacuccagaaggcaaaguggucgaucuggguugcgggagaggaggcuggucauauuacugugguggcuuaaagaauguuagggaggugaaagggcuuaccaagggaggcccugggcacgaagaacccauuccuaugagcacauauggauggaaccugguccggcuccaguccggcguggacguauucuuuacgccacccgagaagugcgauacccuacugugugacaucggugaaaguucuccuaauccaacuauugaggccgggcgcacauugagagugcugaaccucguugaaaauuggcuuaacaauaacacccaauucugcaucaaagugcugaaucccuacaugccgagcgucauagagaagauggaaacuuugcagaggaaauacggaggcgcgcuggugcgaaacccucucucaagaaauuccacacaugagauguauugggucaguaacgcuaccggcaauauugugagcucuguuaacaugaucucccguauguuaaucaauagauuuacgaugaagcacaaaaaggcaaccuacgagccagauguagaccuggggucaggaacacgcaacauugguauagaaaacgagauccccaaucuugacauuaucggcaagaggauugagaaaaucaagcaggagcacgaaacuagcuggcauuaugaucaggaccacccuuacaaaaccugggccuaucaugggucguacgagacaaagcaaacuggaucugcuaguuccauggugaacggcgucgugcggcugcuaaccaaaccaugggauguugugcccauggucacacagauggccaugaccgacacuacgccguucggucagcagagaguguuuaaggagaagguagauacacgcacccaagaaccuaaagaggggacuaagaaacucaugaggauaaccgcagaauggcuguggaaggaguugggcaaaaagaagacaccccgaauguguacgcgggaggaguucaccagaaaagugaggagcaaugccgcucugggcgcgaucuuuacugacgagaacaaguggaaaucagcccgcgaagcaguugaggauucccguuucugggaacucgucgaccgggagagaaaucuucaccuggagggcaagugcgaaacauguguguauaacaugauggggaaaagggagaagaaauuaggagaauuugguaaggcuaagggcucucgcgccauuugguacauguggcugggggcacgauucuuggaguuugaagcccucggauuccugaaugaggaucacugguuuagccggggcaacagucuauccgguguggagggggaaggacuucauaaacugggcuacauccucagagacgucagcaagaaagagggcggggcuauguaugccgaugacaccgcgggaugggacacuaggauuacacuggaagauuugaagaaugaggaaaugguuaccaaccacaugaaaggugagcauaagaagcuggcagaggccaucuucaaacucacauaccagaauaaggugguacgcgugcagagaccaacuccucggggcaccgucauggacauuauaucuaggaaagaucagcgugggucaggacaagugggcacguauggucuuaacaccuucacaaauauggaagcucagcugauccgacagauggagggggaaggaauuuuuaagaguauccaacacuuaacuguuaccgaggagaucgccgugcagaacuggcuggcacgcgucggcagagaacgguuguccaggauggcuauuagcggcgacgauugcgugguaaaaccccucgacgaucgcuucgccucugcucugacagcccuaaaugacauggggaagguuagaaaggauauacagcagugggagccaucgcggggauggaacgacuggacucaagugcccuuuugcucacaucacuuccacgaacuugucaugaaagaugguagggugcugguggucccuugucgaagccaggacgagcucaucggccgugcaagaauuucccagggggcgggauggagucugaaggaaaccgccugcuugggcaaaucuuacgcucagauguggacguuaauguauuuucaucgccgggaucugaggcucgccgcaaacgcuaucuguagcgccguuccaucccacugggugccgacaucaagaaccacuuggaguauucaugcaaagcacgaguggaugacaaccgaggacaugcuugccguauggaaucgcguguggauccaagaaaaccccuggauggaggacaaaacucuggucgaaucuugggaggaagugccuuaccuagguaagcgggaggaucaguggugcgggagccugauaggacucaccuccagggcgacaugggcuaagaauauccagacggccauuaaccagguucgaucauugaucggcaaugaggaauauaccgacuacaugccaagcaugaaaagauuccggaaggaggaagaggaagcaggcgugcugugguga

SEQ ID NO: 14629 - RNA, 9876 nt, Artificial Sequence
  derived and/or modified CDS sequence (opt3) from DENV-2__EU482556__SS-prME
accgccggcgugaucauuaugcugauaccaacagcuauggcuuuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuguucggcaagggcgggauuguaaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcugguaagccacgaaaugguguugcuccagauggaggauaaagcauggcugguccaucggcaaugguucuuagaccugccucucccauggcuucccggcgcugauacucagggaucuaacuggauucagaaggagacacuggugacguuuaagaauccucacgccaaaaagcaggacguuguggucuugggcucccaagaaggggcgaugcauaccgcccugacuggagcaacagagauccagaugucaagcgguaaccuacucuucaccggccaccugaaaugccgucuucgcauggacaagcugcaguugaaagggaugaguuacucuauguguacaggaaaguuuaagaucgugaaagaaauugcugagacucaacauggcaccaucguaauuagaguucaguaugagggugauggguccccaugcaagauacccuucgaaaucauggaccucgagaaaaggcacgugcugggccgguuaauuacggucaauccgaucgugaccgaaaaggauagcccugucaacaucgaggccgaacccccauucggagacucguacauuauaaucggcguggagccugggcagcugaaacuaaacugguuuaagaagggaucuuccauuggucagauguucgagacaacuaugcgaggcgcuaaacgcauggccguucucggggauaccgcaugggacuuuggaucacugggcgguguguucacaaguaucgggaaggcccuucaccaaguauuuggcgcuauuuacggagcggcauucagcggcgucuccuggacuaugaaaaucuugauaggggugaucauuaccuggaucggaaugaacucuagaagcacgucacugaguguuucccucgugcuggucggcgugguaacacuuuaucugggugugaugguucaggccgauaccgggugugucgugagcuggaagaacaaagaauugaagugcggaucuggcauuuuuaucacugacaaugugcauacauggaccgagcaguacaaguuccagcccgaaucaccaaguaaacucgcuagcgccauacaaaaggcacacgaggaagguauuuguggcaucagguccgucacucggcuggagaacuuaauguggaaacagauuacccccgagcugaaucauauccuaucugaaaacgagguuaagcucacaauaaugacgggggauaucaaaggaauuaugcaggccggcaagcgcucgcugagaccucagccaaccgaacuuaaauauagcuggaagacuugggggaaggcuaaaauguuguccacagagucacacaaucaaaccuuucugaucgacggaccggaaacagccgagugccccaacacuaauagggcauggaacagucucgagguggaagauuacggcuucgguguguuuucuaccaauauuuggcugaaguuacgugagaaacaggacguauucugugacagcaagcugauguccgcggcuaucaaagauaaccgggccguccacgcagacaugggguauuggauagaaucagcccuuaaugauacguggaagauggagaaggcuagcuuuauugagaucaaaucuugccauuggccuaagucccacacauuguggaguaacggagugcucgaaagcgagaugaucauucccaaaaauuucgccggccccguuucucagcauaacuaccgaccugguuaucacacccagacugcaggcccauggcaucuggggaagcuagaaauggacuucgauuuuugugagggaaccacaguggucgugacugaagacugcggcaacagagggcccucccugaggaccacaacggcuucaggaaaacucaucaccgaguggugcugucgcaguugcacucugccgccucuucgguacagaggcgaggaugguuguugguacgggauggaaauuaggccauugaaggagaaggaagagaaucugguuaacagcuuagugacagccggacacggccaaauagacaauuucucgcucgguguacugggcauggcgcuuuuucuggaagagauguugcgcacccgagucgggacuaaacacgccauccuccugguggcuguguccuucgucacacuaauuaccggaaacaugucuuuucgggaucugggccguguuauggugaugguaggggcaacgaugacugacgauaucggaaugggcgugaccuaucucgcccugcuugcugccuucaaggucagacccacauuugcagcggguuugcuguuaaggaaacucaccagcaaggagcugaugauggccacuauugggaucgcacuucugucacagaguacaauaccugaaaccauccuagagcucacagacgcccuggcauugggaaugauggugcugaaaauuguucgcaauauggaaaaguaccaguuagcugugacuaucauggccauuuccugcguccccaacgcagugauccuccaaaaugccuggaagguuucuuguaccauacuggcugcggugagcgucuccccacuucuguugacgucaagccagcagaaagccgauuggauuccucucgcacugacaaucaagggccuaaaccccaccgcuaucuuccugacuacccuuagucggacaucuaaaaagagauccuggccacucaaugaggccguaauggccgugggcaugguuagcauucuggcuucgucauugcugaaaaacgacauaccgaugacugggccuuuaguggcaggaggucuccugaccgucugcuaugugcuuacgggcaggucugccgaccuggaauuggagcgagcggcugauguaaagugggaggaccaggccgaaaucaguggguccagccccauucucucuaucacaauuagcgaggauggauccaugucaaucaaaaaugaagaggaggaacauacccugacuauacuaauccgcacaggccugcuugugauuaguggugucuuuccaguuagcauccccauuaccgcagccgcuugguaccucugggaggugaagaagcaacgggcaggggugcugugggacgucccuucuccacccccugugggaaaagccgaauuggaggauggcgcguauagaaucaagcagaggggcauauucggguacucccagauuggagcugguguuuauaaagaaggcacuuuucacacaauguggcauguaacccguggggccguguuaaugcaccgcggaaagcggaucgagccgucaugggcagacgucaaaaaggaucugaucaguuacggcgguggguggaagcucgagggagaauggaaagagggcgaagaggugcagguucuggcccuugaaccaggcaagaaccccagagcugugcaaacgaaaccugggcuguucaagacuaauaccggaacaauuggugccgucagcuuggacuuuuccccaggcaccucugggucgcccaucguggauaggaaaggaaagguagucggccuauacgguaacggggugguuacacgaagcggagcauaugugucagcuauagcccagacugagaaguccauugaggacaauccugaaaucgaggaugacauuuuccggaaaaagcgccugaccaucauggaucuccauccgggcgcgggcaaaacgaagagauaccugcccgccauagucagggaagcaauuaaacgggggcuucgaacauuaauccuggcuccaacuagagugguugccgcugagauggaagaggcacuccgcggauugccuaucagguaucagacccccgccauucgugccgagcacacaggucgggaaaucguggaccugaugugucacgcuaccuucacuaugagacuccugaguccagucagggugccuaacuacaaccuuauuauaauggacgaggcgcauuuuaccgaucccgcaucuaucgccgcucgcggcuauauuagcacacgaguagaaaugggggaggccgcaggaaucuucaugacggccacuccaccgggcuccagagacccuuuuccccagucaaaugcuccaaucauggaugaggaacgggagauucccgaaaggucuuggaacagcggucacgagugggugaccgacuucaaggggaagacaguuugguuugucccuaguauaaaagcgggaaaugauaucgccgcaugccugcgcaagaacggcaaaaaggugauucaauugucccguaaaaccuucgacagcgaauacgugaagacuagagcuaaugauugggacuuugucguaacaaccgauaucucugagaugggcgccaacuuccgggcagagagggugauugacccacgccgauguaugaagcccguuauccuaacggauggggaagagagagugauacuggccggaccuaugccggucacucauucauccgcugcccagcggaggggucgcaucggcagaaaucccaaaaaugaaaaugaccaguauauuuacaugggggagccccucgaaaacgacgaggauugcgcgcacuggaaggaggcaaaaauguuacuggacaauaucaacacaccugaaggaauuauccccaguauguuugagccagaaagggagaagguggaugccauagacggcgaauaccggcuucguggugaggcucgcaaaaccuucguugaucugaugcgaagaggggaccucccugugugguuggccuauagggucgcugcagagggcauuaauuacgccgaucggcgcugguguuuugacggaaucaagaacaaucaaauucuggaagagaacguggaaguagagaucuggaccaaagagggcgaaagaaagaagcucaaacccagguggcuggaugcucggauauauagcgacccacuugcccuaaaggaguucaaagaguucgcagcggggcgaaagucgcugacuuugaacuuaaucacagagaugggaagacugccuacccucaugacacagaaagcccgcgaugcucuggacaaucuugccgugcugcacacugcagaaguugguggcagggcuuacaaccaugcccucucugaguugccggagacgcuggaaacccuacugcuccuuacacuguuagcaacugucaccgggggaauauuuuuguuccugauguccggcaaggguaucgggaagaugacacucggcaugugcugcauuaucaccgccagcauacugcuuugguaugcucagauucagccccacuggaucgcggccucaaucauucuggaguuuuuccucaucguguugcugauaccagaaccugagaaacaacggacuccccaggauaaucaguuaacguacguggucauugcaauccuaaccguuguggcugccacaauggccaacgaaaugggauuucuggagaagacuaaaaaggaccucggccuugggaguauuaccacacaggagucugaauccaauauccuggacauagauuugcguccagcaagcgcuuggacccuguaugccguagcgacuacauucgugacgccuaugcucagacauucaaucgagaacaguagcgucaaugugucccugaccgcuauugccaaccaagcaacuguucuuaugggacucgguaggggcuggccccugucuaaaauggacaucggggugccguugcuggccauuggauguuacagccaggucaauccaaucacauuaaccgcugcacuacugcuccuuguagcccacuacgcgauuaucggcccuggucugcaggcuaaggccacccgcgaagcacagaagcggacagccgcugggauaaugaaaaaccccacuguggauggcauuacgguuaucgacuuggagccaauccccuaugauccuaaguuugaaaaacaacugggacaggugaugcuccugguccuuugcgugacccaggucuuaaugaugcgaacaacuugggcccugugugaggcacucaccuuggcuacaggcccgauuuccacccugugggaggggaaucccggaagauucuggaacacuacgauagccgugucaauggcgaauaucuuuaggggcucuuaccuagccggugcagggcuacucuucaguauuaugaagaacacaaccaauacucgccggggaaccggcaacaucggugaaacacuuggcgagaaauggaagucgagacugaaugcuuugggaaagagcgaauuucagauuuauaaaaaguccggaauccaagagguugaccguacucuggccaaagagggcauaaagagaggggaaaccgaucaucacgcagugucucggggaucagcuaaacuccgcugguucguagagcgaaacauggugacaccagaaggcaaggucguugaccuggguugcgggagaggaggcuggagcuacuauugugguggccuuaaaaacgugagggaggucaaggggcuaacgaagggaggcccugggcacgaagaaccaaucccuauguccaccuacggauggaaucuggugcggcuccagaguggcguagauguguuuuucacuccacccgagaaaugcgacacacuacugugugauauuggugaaucuagcccuaacccaaccaucgaggccgggcgcacuuugagaguucugaaucucguggaaaacuggcuuaauaacaauacacaguucugcgucaaggugcugaaccccuauaugccgucagucauugagaaaauggaaaccuugcaaaggaaguacggaggcgcccuggugcgaaauccucucucccggaacaguacgcaugagauguacuggguuagcaaugcgaccggcaacaucguaucuuccgugaauaugauaucacguauguuaauuaacagauuuacaaugaaacacaagaaggcuacuuaugagccagacgucgaucuggggagcggaacccgcaauaucgguaucgaaaacgagauucccaaccuugacauaaucggcaaaaggauugaaaagaucaaacaggagcaugaaacaucguggcacuacgaccaggaucacccuuauaagacuugggcauaccaugggucuuaugagaccaaacagacaggaagugccuccagcauggugaauggcguugugaagcugcuaaccaagccaugggacgucgugcccaugguaacucaaauggcuaugacggauacaaccccguucggucagcagcggguguuuaaagagaagguugacacuagaacccaggaaccuaaagaggggacaaagaaacucaugcgcauuacggccgaauggcuguggaaggaguugggaaagaaaaagacccccaggauguguacucgagaggaguucacacggaaagucagaucaaacgcagcccugggcgcuaucuuuaccgaugagaauaaguggaaauccgcgagggaagccguggaggacucucgcuucugggaacucguggaucgugagcggaaccuucaccuggagggcaagugcgaaacuugugucuacaauaugauggggaaaagagagaagaaguuaggagaauuugguaaagcaaagggcagcagggcuauaugguauauguggcugggggcccgcuucuuggaguuugaagcacucggauuccugaacgaggaccauugguuuagucgaggcaauucccuaagcgguguugagggggaaggacuucacaaacugggcuacauccuccgggaugugucuaagaaagagggcggggccauguacgcugacgauacagccggaugggacaccagaauuacacuggaagacuugaagaacgaggaaaugguaacuaaucauaugaagggugagcacaaaaagcuggcggaggcaaucuucaaacucaccuaucaaaacaagguggucagggugcagcgcccaacgccuagaggcaccguuauggauauuaucucacggaaagaccagagggggaguggacaggugggcacauacggucuuaauacuuuuaccaacauggaagcccaacugauucgucagauggagggggaaggaauauucaaguccauccagcgauuaacagucacugaggagauugcugugcaaaauuggcugguacgcguuggcagagaacgguugagcaggauggccgugucuggcgaugacugcgucgugaagccccucgaugaccgcuucgcaucggcucugaccgcccuaaacgauauggggaaagugagaaaggacauccagcagugggagccaucacggggauggaaugauuggacgcagguccccuuuugcagccaccauuuccacgaacuuguuaugaaagacgguagggugcugguagugccuugucgaaaccaagaugagcucaucggccgugcuagaauuucccagggggccggauggagucugaaggaaacagcaugcuugggcaaaucuuaugcgcagauguggaccuuaauguacuuucaucgccgggaccugaggcucgccgcuaacgccauauguagcgcagucccaucccacugggugccgacuucaagaacaaccuggaguauccacgcuaagcaugaguggaugacuaccgaggauaugcuugccguuuggaaucgcguguggauucaggaaaaccccuggauggaggacaagacaccugucgaaucuugggaggaagugccauaucuggguaaacgggaggaccaauggugcgggagccuaaucggacugacguccagggcaaccugggccaagaauauucagacugcgaucaaccagguacgaucacucauaggcaaugaggaauacacagauuauaugcccagcaugaaaagauuccggaaggaggaagaggaagcuggcguuuugugguga

SEQ ID NO: 14630 - RNA, 9876 nt, Artificial Sequence
  derived and/or modified CDS sequence (opt3) from DENV-2__EU529693__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaccauggccgcaaucuuggccuacacgauuggcacuacacacuuucagcgcgcucucaucuucauucugcugaccgcaguugccccauccaugacuaugagaugcaucgggauaucuaacagggauuuuguggaaggagucucggguggcucauggguggacauuguacucgagcacgggagcuguguuacaaccauggcuaagaauaagcccacguuagauuucgaacugaucaaaaccgaggccaagcagccugcgacacuucggaaauauugcauugaagcaaaguugacuaacaccacaacugagagucgcuguccaacccaaggagagcccucccugaaugaagagcaggacaaacgauuuaucugcaagcauucuaugguggauagaggcugggguaacggguguggacuauucggcaagggcgggaucgucacaugcgccauguuuaccugcaaaaagaauauggaaggaaaaguggugcucccugagaaccuggaauacacuauugucauaacgccacacagcggugaggagcaugcuguuggcaaugacacagggaagcacggaaaagaaaucaagauuaccccgcaguccucaaucacugaggccgaacuuaccggcuaugguacagugaccauggaguguagucccaggacugggcuggauuucaacgaaaugguauugcuccagauggaggacaaagcauggcuggugcaccggcaaugguuuuuagaucugccucucccauggcuucccggcgcugacacacagggaagcaauuggauacagaaggagacgcuggucaccuucaagaacccucaugccaaaaagcaggacgugguuguguugggcucucaagaaggggcgaugcacacugcccuaacaggagcaaccgagauucagauguccucagguaaucugcucuuuacaggccaucugaaaugccgucuucgcauggauaagcugcaguugaaagggaugagcuacaguauguguacuggaaaguucaagaucgucaaagaaaucgcugagacccaacacggcacgauugugaucagaguacaguaugagggugacgggucuccaugcaagauucccuucgaaauaauggaucucgagaaaaggcauguucugggccgguuaaucaccgugaacccgauugucacagaaaaggacuccccugugaacaucgaggccgaacccccauuuggagauagcuacaucauuauaggcgucgagccugggcagcugaaacuaaauugguucaagaagggaucgucuaucggucagauguuugagacuaccaugcgaggcgcuaaacgcauggccauucucggggacacagcaugggauuucggaucccugggcgguguguuuacuucaaucgggaaggcccuucaccaaguuuucggcgcuauuuacggagcggcauuuaguggcgugagcuggaccaugaaaaucuugauagggguaaucauuacguggaucggaaugaacuccagaucuacaagccugucagucagucucgugcugguuggcauugugacccuuuaucugggugucauggugcaggccgacacuggguguguaguguccuggaagaauaaagaauugaagugcggaagcggcaucuucauaacagauaacguucacaccuggacugagcaguacaaguuucagcccgaaucuccaucaaaacucgcuagugccauucaaaaggcacaugaggaagguaucuguggcauuaggagcgucacccggcuggagaauuuaauguggaaacagaucacacccgagcugaaccacauacuauccgaaaaugaggugaagcucacgaucaugaccggggacauuaaaggaaucaugcaggccggcaagcgcucucugagaccucagccaacugaacuuaaauauucguggaagacaugggggaaggcuaaaauguugagcaccgagucccauaaccaaacauuccugauugauggaccggaaacugccgagugccccaauaccaacagggcauggaauucacucgagguggaagacuacggcuuuggugucuucaguacgaacaucuggcugaaguuacgugagaaacaggacguuuuuugugauucuaagcugaugagcgcggcuauaaaagacaaucgggccgugcacgcagauaugggguauuggauugaauccgcccuuaacgacacauggaagauggagaaggcuucauucaucgagaucaaaagcugccacuggccuaagucucauaccuugugguccaauggagugcucgaaagugagaugauuaucccaaaaaacuucgccggccccguaagccagcacaacuaccgaccugguuaucauacucagaccgcaggcccauggcaccuggggaagcuagaaauggauuuugacuucugugagggaacaacugucgugguuaccgaagauugcggcaauagagggcccucucugaggacaacgaccgcuuccggaaaacucauuacugaguggugcugucgcucaugcacacugccgccucuucgguacagaggcgaggacgguuguugguacgggauggaaauaaggccauugaaggagaaggaagagaaccuggugaauaguuuagucaccgccggacauggccaaaucgauaacuuuagccucggugugcugggcauggcgcuuuuccuggaagagauguugcgcacucgaguugggacaaaacacgccauucuccugguggcuguaucguuugucacccuaaucacgggaaauauguccuuccgggaccugggccgugugauggugauggucggggcaacuaugaccgaugacauuggaaugggcguuacauaucucgcccugcuugcugccuuuaaggugagacccaccuucgcagcggguuugcuguuaaggaaacucacuucuaaggagcugaugauggccacaaucgggauagcucuucugagccagucaaccaucccugaaacaauucuagagcucacugaugcccuggcauugggaaugaugguacugaaaaucgugcgcaacauggaaaaguaccaguuagcugucaccauuauggccaucaguugcgugcccaaugcaguuauacuccaaaacgccuggaagguguccuguacgauucuggcugcggucucugugagcccacuucuguugacauccucacagcagaaagccgacuggaucccucucgcacugaccaucaagggccuaaaucccacugcuauuuuucugaccacacuuagccggacuaguaaaaagagaucuuggccacucaacgaggccguuauggccgugggcauggucuccauacuggcuagcucguugcugaaaaaugacaucccgaugaccgggccuuuaguagcaggaggucuccugacggugugcuauguucuuacaggcaggucagccgaucuggaauuggagcgagcggcugacgugaagugggaggaucaggccgaaauuucugggaguucccccauccucagcauuaccaucucugaggacggaagcauguccauaaaaaacgaagaggaggaacacacucugacaauccuaauucgcaccggccugcuugucaucucagguguguucccaguaaguauucccaucacugcagccgcuugguaccucugggaggugaagaagcaacgggcagggguccugugggauguuccuagcccacccccugugggaaaagccgaauuggaggacggcgcguauagaauaaagcagaggggcauuuuuggguacucucagaucggagcugguguguauaaagaaggcacauuccauaccauguggcacgucacgcguggggccguguuaaugcaucgcggaaagcggaucgagccguccugggcagauguuaaaaaggaccugauuucauacggcgguggguggaagcucgagggagaauggaaagagggcgaagagguacaggugcuggcccuugaaccaggcaagaaucccagagcuguccaaacuaaaccugggcuguuuaagaccaacacaggaaccaucggugccgugaguuuggauuucagcccaggcacauccgggucucccauaguugacaggaaaggaaagguggucggccuauacgguaauggggugguaacucgaucgggagcauaugucagcgcuauugcccagaccgagaagucaaucgaggauaacccugaaauugaggacgauaucuuccggaaaaagcgccugacgauaauggaccuccacccgggcgcgggcaaaacaaagagauaccugcccgccauugugagggaagcaaucaaacgggggcuucgaacuuuaauccuggcuccaaccagaguuguggccgcugagauggaagaggcacuccgcggauugccuauuagguaucagacacccgccauccgugccgagcauaccggucgggaaauugucgaccugaugugucacgcuacuuuuaccaugagacuccuguccccagugaggguuccuaacuacaaucuuauaaucauggaugaggcgcacuucacagaccccgcaaguauugccgcucgcggcuauaucucuacgcgaguggaaaugggggaggccgcaggaaucuuuaugacugccaccccaccgggcagcagagauccuuucccccaguccaacgcuccaauuauggacgaggaacgggagauacccgaaaggucauggaauucuggucaugagugggucacagauuuuaaggggaagaccgugugguucguaccuagcaucaaagcgggaaacgacauugccgcaugccugcgcaagaauggcaaaaaggugauccaauugagucguaaaacuuuugauuccgaauacguuaagacaagagcuaacgacugggauuucgucgugaccacggacauuagcgagaugggcgccaauuuucgggcagagagggugaucgauccacgccgauguaugaagcccgucauacuaacugacggggaagagagaguaauccuggccggaccuaugccggugacacacucuucagcugcccagcggaggggucgcauuggcagaaacccaaaaaaugaaaacgaccaguauaucuacaugggggagccccucgaaaaugaugaggacugcgcgcauuggaaggaggcaaaaauguuacuggauaacauuaauaccccugaaggaaucauacccuccauguucgagccagaaagggagaagguugacgccauugauggcgaauaccggcuucguggugaggcucgcaaaaccuuuguggaccugaugcgaagaggggaucucccugucugguuggccuauaggguggcugcagagggcaucaacuacgccgaccggcgcugguguuucgauggaauuaagaauaaccaaauccuggaagagaacguugaaguggagauauggacuaaagagggcgaaagaaagaagcucaaacccagguggcuggacgcucggaucuauagugauccacuugcccuaaaggaguucaaagaauuugcagcggggcgaaagagccugacauugaauuuaauuaccgagaugggaagacugccuacauucaugacucagaaagcccgcgacgcucucgauaaccuggccguccuucacacggcagaaguggguggcagggcuuacaaucacgcccugucggagcucccggagaccuuggaaacacugcuacugcucacucuucuggcaaccguaacagggggaaucuuuuuauucuugaugucuggcaaggguauugggaagaugacccugggcaugugcugcaucauaacugccuccauucuccugugguaugcucagauccagccccauuggaucgcggccagcauuauccuugaguuuuuccugauagugcucuugauuccagaaccugagaaacaacggacgccccaggacaaccagcugaccuacguugucaucgcaauuuuaacagugguggcugccacuauggccaaugaaaugggauuucuagagaagaccaaaaaggaccugggccucgggucaaucacaacccaggagagugaaucuaacauacuugauaucgaccugcguccagcauccgcuuggacuuuguaugccgucgcgacaacguucguuaccccuaugcugagacacagcauugagaauucaagugugaacguaagccucacugcuaucgccaaucaagcaacagugcugaugggacuugguaggggcuggccccucuccaaaauggauauuggggucccgcuguuggccaucggauguuacucucaggugaacccaauuacccugaccgcugcauuacuacugcucguugcccauuacgcgaucauaggcccuggucuucaggcuaaggccacacgcgaagcacagaagcggacugccgcugggauuaugaaaaaucccacgguggacggcaucaccgucaucgaucuggagccaauucccuaugacccuaaguuugaaaaacaauugggacagguaaugcugcucgugcugugcguuacacaggugcuuaugaugcgaacuaccugggccuuaugugaggcacugacacucgcuaccggcccgauaagcacuuugugggaggggaaccccggaagauucuggaauacgacaaucgccgucuccauggcgaacauuuuuaggggcucauaccuggccggugcagggcuacuguucucuaucaugaagaauaccacuaacacccgccggggaacaggcaauauuggugaaacucucggcgagaaauggaagaguagacuuaacgcucuggggaagucggaauuucagaucuauaaaaagagcggaauacaagagguggaucguaccuuggccaaagagggcaucaagaggggggaaacagaccaccaugcagucucccggggaucugcuaaacugcgcugguucguggagcgaaacaugguuacgccagaaggcaaggugguagaucucgguugcgggagaggaggcuggucauacuauugugguggccugaaaaaugugagggaggucaagggguuaaccaagggaggcccugggcacgaagagcccauuccuaugagcacuuacggauggaaccuuguucggcugcaguccggcguggacgucuucuuuacaccacccgagaaaugcgauacccuccuaugugacaucggugaaaguucuccuaauccaacuauugaggccgggcgcacacugagaguguugaaccugguagaaaauuggcucaacaauaacacccaguucugcgugaagguucuuaaucccuauaugccgagcgugaucgagaaaauggaaacgcugcaaaggaaguacggaggcgccuugguccgaaacccucugucacggaauuccacccacgagauguacugggugaguaacgcgacaggcaauauagucagcucugugaacaugauuucccguaugcucaucaauagauuuacuaugaaacauaagaaggcuaccuaugagccagauguugacuuagggucaggaacacgcaacaucgguauugaaaacgagauacccaaucuggacaucauuggcaaaaggaucgaaaagauuaaacaggagcacgaaacuagcuggcauuacgaucaggaccacccuuauaagaccugggcauaccacgggucguaugagacaaaacagaccggaucugccaguuccaugguaaacggcguggucaagcuucugacuaagccaugggaugugguucccauggugacgcaaauggcuaugacagacaccacuccguucggucagcagcgggucuuuaaagagaagguggauaccagaacacaggaaccuaaagaggggacgaagaaacuaaugcgcaucaccgccgaauggcucuggaaggagcugggaaagaaaaagacucccaggauguguacacgagaggaauucacccggaaaguaagaagcaaugcagccuugggcgcuauauuuacugacgagaacaaguggaaaucagcgagggaagccguggaggauucccgcuucugggaacugguugaccgugagcggaaucuccaucuugagggcaagugcgaaacaugugucuacaacaugauggggaaaagagagaagaagcugggagaauuugguaaagcaaagggcucuagggcuaucugguauaugugguuaggggcccgcuuccuggaguuugaagcauugggauuccucaaugaggaucacugguuuagccgaggcaacagucuguccgguguggagggggaaggacuacauaaacuuggcuacauucugcgggacgugagcaagaaagagggcggggccauguacgcugaugacaccgccggaugggacacaagaaucacucucgaagaucugaagaaugaggaaauggucaccaaccacaugaagggugagcauaaaaaguuggcggaggcaauuuucaaacugacguaucaaaauaagguugugaggguacagcgcccaaccccuagaggcacagugauggacaucauuucucggaaagaucagagggggucaggacaggucggcacuuacggucucaacaccuucacaaauauggaagcccaacuuauacgucagauggagggggaaggaaucuuuaagaguauucagcgacugacugugaccgaggagaucgcuguucaaaacugguuagcccgcgugggcagagaacggcuguccaggauggcaaucagcggcgacgauugcgucgugaagcccuuggacgaucgcuucgcuucugcccucacggcucugaaugacauggggaaaguaagaaaggauauucagcagugggagccaucgcggggauggaacgacuggacacagguucccuuuugcucacaccacuuccaugaacuagugaugaaagaugguaggaugcuugucgugccuugucgaaaccaagacgagcugauaggccgugccagaaucagccagggggcaggauggucccucaaggaaaccgcgugccugggcaaaaguuaugcccagauguggacuuugauguacuuucaccgccgggauuuaaggcuggcugccaaugcaauuuguucugcugugccaagccauugggucccgacauccagaaccacuuggucaauccacgccaagcacgaguggaugaccacagaggacaugcucgcaguuuggaaccgcguguggauucaggaaaaucccuggauggaggacaagacgccuguagaaaguugggaggaagugccauaucuugguaaacgggaggaucaauggugcgggucucugaucggacuaaccagcagggccacuugggcgaagaacauacagacagcuaucaaucagguccgaucccugauuggcaacgaggaauacaccgacuauaugcccucaaugaaaagauuccggaaggaggaagaggaagccggcgugcucugguga

SEQ ID NO: 14631 - RNA, 9876 nt, Artificial Sequence
  derived and/or modified CDS sequence (opt3) from DENV-2__EU482557__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauuccaaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcucuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacacacacugaccauacuaauccgcacuggccugcuuguaauuagugguguguucccagucagcauccccauuacagcagccgcuugguaccucugggagguuaagaagcaacgggcaggggugcugugggaugugccuucuccacccccugucggaaaagccgaauuggaggacggcgcguauagaaucaagcagaggggcauauuuggguacucccagauuggagcugguguguauaaagaaggcaccuuccauacuauguggcacguuacacguggggccguauuaaugcaucgcggaaagcggaucgagccgucaugggcagaugugaaaaaggaccugaucaguuacggcgguggguggaagcucgagggagaauggaaagagggcgaagagguccaggugcuggcccuugaaccaggcaagaaucccagagcuguucaaaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccacccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcauaccggucgggaaaucguugaccugaugugucacgcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccagucaaacgcuccaaucauggacgaggaacgggagauucccgaaaggucuuggaauagcggucaugaguggguaacugauuuuaaggggaagaccgugugguucguuccuaguauaaaagcgggaaacgacaucgccgcaugccugcgcaagaauggcaaaaaggucauucaauugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcacucauccgcugcccagcggaggggucgcaucggcagaaacccaaaaaaugaaaacgaccaguauauuuacaugggggagccccucgaaaaugaugaggacugcgcgcauuggaaggaggcaaaaauguuacuggauaacaucaauacuccugaaggaauuauccccaguauguucgagccagaaagggagaaggucgacgccauagauggcgaauaccggcuucguggugaggcucgcaaaacauuuguggaccugaugcgaagaggggaucucccuguuugguuggccuauaggguggcugcagagggcauuaacuacgccgaccggcgcugguguuucgauggaaucaagaauaaccaaauucuggaagagaacgucgaaguggagaucuggaccaaagagggcgaaagaaagaagcucaaacccagguggcuggacgcucggauauauagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucacacagcagaaguggguggcagggcuuacaaucacgcccugucugagcucccggagacuuuggaaacgcugcuacugcucacccuucuggcaacaguuacugggggaauuuuuuuauucuugauguccggcaaggguaucgggaagaugacccugggcaugugcugcauuaucacagccagcauacuccugugguaugcucagauucagccccauuggaucgcggccucaaucauucuugaguuuuuccugaucguccucuugauaccagaaccugagaaacaacggaccccccaggacaaccagcugacuuacguggugauugcaaucuuaacggucguugcugccaccauggccaaugaaaugggauuucuagagaagacaaaaaaggaccugggccucgggaguauuacuacccaggagucugaauccaacauccuugauauagaccugcguccagcaagcgcuuggacauuguaugccguggcgaccacuuucguaacaccuaugcugagacacucaaucgagaauaguagcgugaacgucucccucacggcuauugccaaucaagcaaccgugcugaugggacuugguaggggcuggccccucucuaaaauggauaucgggguuccgcuguuggccauuggauguuacagccaggugaacccaaucacucugacagcugcauuacuacugcucgucgcccauuacgcgauuaucggcccuggucuucaggcuaaggccacccgcgaagcacagaagcggaccgccgcugggauaaugaaaaaucccacaguagacggcauuacugugaucgaucuggagccaauccccuaugacccuaaguuugaaaaacaauugggacagguuaugcugcucgugcugugcgucacgcaggugcuuaugaugcgaaccacaugggccuuaugugaggcacugacucucgcuaccggcccgauuuccacauugugggaggggaaccccggaagauucuggaauaccacuauagccgucucaauggcgaacaucuuuaggggcucuuaccuggccggugcagggcuacuguucaguauuaugaagaauacgacaaacacccgccggggaacuggcaauaucggugaaacccucggcgagaaauggaagucgagacuuaacgcucuggggaagagcgaauuucagauuuauaaaaaguccggaauccaagagguggaucguacauuggccaaagagggcauaaagaggggggaaacugaccaccaugcaguuucucggggaucagcuaaacugcgcugguucguggagcgaaacaugguaaccccagaaggcaagguggucgaucucgguugcgggagaggaggcuggagcuacuauugugguggccugaaaaauguuagggaggugaagggguuaacaaagggaggcccugggcacgaagagcccaucccuauguccacguacggauggaaccuuguccggcugcagaguggcguggacguauucuuuaccccacccgagaaaugcgauacucuccuaugugacauuggugaaucuagcccuaauccaacaaucgaggccgggcgcacccugagaguguugaaccugguugaaaauuggcucaacaauaacacucaguucugcauuaaggugcuuaaucccuauaugccgucagucaucgagaaaauggaaacacugcaaaggaaguacggaggcgccuuggugcgaaacccucugucccggaauaguacccacgagauguacugggucagcaacgcgacgggcaauauagugucuuccguuaacaugauuucacguaugcucaucaauagauuuaccaugaaacauaagaaggcuacauaugagccagauguagacuuagggagcggaacucgcaacaucgguauugaaaacgagauacccaaucuggacaucauuggcaaaaggaucgaaaagauuaaacaggagcacgaaaccucguggcauuacgaucaggaccacccuuauaagacaugggcauaccacgggucuuaugagacuaaacagaccggaagugccuccagcauggugaacggcgucgugaagcuucugacaaagccaugggauguugugcccauggucacccaaauggcuaugacugacacgacaccguucggucagcagcggguguuuaaagagaagguagauaccagaacucaggaaccuaaagaggggaccaagaaacuaaugcgcaucacagccgaauggcucuggaaggagcugggaaagaaaaagacgcccaggauguguacccgagaggaauucacucggaaagugagaucaaaugcagccuugggcgcuauauuuacagacgagaacaaguggaaauccgcgagggaagccguugaggauucucgcuucugggaacuggucgaccgugagcggaaucuccaucuugagggcaagugcgaaaccuguguguacaacaugauggggaaaagagagaagaagcugggagaauuugguaaagcaaagggcagcagggcuaucugguauaugugguuaggggcccgcuuccuggaguuugaagcauugggauuccucaaugaggaucacugguuuagucgaggcaacucccugagcgguguggagggggaaggacuacauaaacuuggcuacauucugcgggacgucucuaagaaagagggcggggccauguacgcugaugacacugccggaugggacacaagaaucacccucgaagaucugaagaaugaggaaaugguuacaaaccacaugaagggugagcauaaaaaguuggcggaggcaauuuucaaacugacuuaucaaaauaaggugguaagggugcagcgcccaaccccuagaggcacggucauggacaucauuucacggaaagaucagagggggaguggacaggugggcaccuacggucucaacacauucacuaauauggaagcccaacuuauacgucagauggagggggaaggaaucuuuaaguccauucagcgacugaccguuacagaggagaucgcugugcaaaacugguuagcccgcgucggcagagaacggcugagcaggauggcaaucucuggcgacgauugcgugguaaagcccuuggacgaucgcuucgcuucggcccucacugcucugaaugacauggggaaaguuagaaaggauauucagcagugggagccaucacggggauggaacgacuggacccaggugcccuuuugcagccaccacuuccaugaacuagucaugaaagaugguagggugcuuguggucccuugucgaaaccaagacgagcugauaggccgugccagaaucucccagggggcaggauggagucucaaggaaacggcgugccugggcaaaucuuaugcccagauguggacauugauguacuuucaccgccgggauuuaaggcuggcugccaaugcaauuuguagcgcuguuccaucccauugggugccgaccucaagaacuacauggaguauccacgccaagcacgaguggaugaccacugaggacaugcucgcaguauggaaccgcguguggauucaggaaaaucccuggauggaggacaagaccccugucgaaucuugggaggaagugccauaucuugguaaacgggaggaucaauggugcgggagccugaucggacuaacauccagggccacgugggcgaagaacauacagaccgcuaucaaucagguucgaucacugauuggcaacgaggaauacacugacuauaugcccagcaugaaaagauuccggaaggaggaagaggaagccggcgugcucugguga

SEQ ID NO: 14632 - RNA, 9876 nt, Artificial Sequence
  derived and/or modified CDS sequence (opt3) from DENV-2__EU482560__SS-prME
accgccggcgugaucguaaugcugauucccacaguuauggcuuuccaccucacuacgcggaacggggaaccucauaugauagugggaaggcaggaaaaggguaaaagccuucuguuuaagaccgaagacggcaucaauaugugcacauugauggcaauugauuuaggggaacugugugaagacacuaucaccuacaaaugcccacuacucaagcaaaacgaaccggaggauauugacuguuggugcaauuccacaucuaccugggugacuuauggaacauguaccacgacuggcgagcaccggcgcgaaaaacgaucaguggcccuggucccccauguggguauggggcuugagacccguacagaaacuuggaugaguagcgagggagcguggaagcacguucagagaaucgagaccuggauacugaggcauccuggcuucacaaucauggcugccauuuuggcauacaccaucggcacgacucacuuucagcgggcccucauuuucauccugcugacagcuguggcaccauccaugaccaugcgcugcauagggauuucuaacagagauuuugucgaaggagugucggguggcucauggguagacaucguucucgagcacgggagcugugugacuacaauggccaagaauaaacccaccuuagauuucgaacugauuaagacggaggcuaaacagccugccacccuuaggaaguauugcaucgaagcgaaauugacaaacacuaccacagagagucgguguccaacucaaggagagcccucccugaaugaagaacaggacaagcgcuuuaucugcaagcauucuauggucgaucgaggcugggguaacggguguggacuauucggcaaaggcgggauugugaccugcgcaauguuuacaugcaagaaaaauauggaaggaaaggugguccagccugagaaccucgaauacaccauaguuaucacuccacacagcggugaggagcaugccgugggcaaugacacggggaaacacggaaaggaaauuaaaaucacaccgcaguccucaauaaccgaggcugaacugacuggcuaugguaccguaacaauggaguguagucccagaaccgggcuugauuucaacgaaauggugcuguugcaaauggaggacaaggccuggcucguccacaggcagugguuucuggauuuaccucugccauggcuccccggcgcagacacucagggaagcaauuggauucagaaggagacacuugugacguucaaaaacccucaugcuaagaaacaagacguugugguccugggcucucaggaaggggccaugcacaccgcguugacuggagccacagagauccagauguccucagguaaucuacuguuuaccggccaucucaagugccggcugcguauggauaaacuucaacugaaggggaugagcuacaguauguguacaggaaaguucaaaaucgugaaggaaauugcagagacucagcacggcaccaucguaauucgcguucaguaugagggugacgggucuccaugcaaaauacccuucgaaaucacggauuuggagaagagacaugugcucggcaggcugauuaccgucaacccgaucgugacagaaaaagacuccccugucaacaucgaggcugaacccccauuuggagauagcuacauuauaaucggcguggagccugggcaguuaaagcugaauugguucaagaaaggaucgucuauuggucaaauguuugagacuaccaugcggggcgccaagcgaauggcuauccuaggggacacagccugggauuucggaucccucggcgguguuuuuacuucaauugggaaagcacugcaccagguguucggcgccaucuacggagcugcguuuaguggcguaagcuggaccaugaagauacuuaucggggucauuaucacguggauuggaaugaacucccgcucuacuagcuugucagugagucugguucucgugggcgucgugacccuguaucuuggugcaaugguacaggccgacuccgggugugugguuagcuggaaaaauaaggaacugaagugcggaucuggcaucuucauaacugauaacguccacacauggaccgagcaguacaaauuucaacccgaaucaccaaguaaguuggcuagcgccauucagaaagcacaugaggaagguaucuguggcauuagauccgugacuaggcucgagaaucugauguggaagcagaucacccccgaguuaaaccacauacugucugaaaaugaggugaaacuaacaaucaugacgggggacauuaagggaaucaugcaggccggcaaacggucgcuccgcccucaaccaaccgaacugaaguauagcuggaagacuugggggaaagcuaagaugcuuuccacagagucacauaaccagaccuucuugauugauggaccggaaacagccgagugccccaauacuaacagagcauggaauagucuggaggucgaagacuacggcuuugguguuuucaccacgaacaucuggcucaaacugagggagaagcaggacgcguuuugugauucuaaauuaaugagcgcugccauaaaggacaaucgugcagugcacgccgauaugggguauuggauugaauccgcucugaacgacacauggaagauggagaaagccucauucaucgagguaaagagcugccacuggccuaaaucucauacccuuugguccaauggaguauuggaaagugagaugaucauuccaaagaacuucgcaggccccgucagccagcacaaccaucggccugguuaccacacucaaaccgcuggcccauggcaucucgggaaacuggaaauggauuuugacuucugugagggaacaacugugguugugaccgaagauugcggcaaucgagggcccucucuaagaacaacgaccgccuccggaaagcugaucacugaguggugcuguaggucaugcacacucccgccucugcgcuaucggggcgaggacgguuguugguacgggauggaaauuagaccacuuaaggagaaagaagagaacuuggucaauagucuggugaccgcgggacacggccagauagauaacuuuagcuuagguguucucggcauggcccuguuccuugaagagaugcugaggacucgcguggggacaaagcacgcuaucuugcucguagcagucucgcuggugacccuaauuacgggaaauauguccuuucgagaccugggccgggugauggucaugguuggggccacuaugaccgaugacaucggaaugggcgugacauaccucgcucugcuugccgcauucaaaguacgucccaccuuugcggccgguuugcuguuaagaaagcucacuucuaaagagcugaugauggcuacaauugggaucgcccuucugagccagucaaccauaccugaaacaauccuagagcucacugaugcacuggcuuugggaaugauggugcugaagauugucaggaacauggaaaaguaucaauuagccgugaccaucauggcaauuaguugcguucccaaugccgugauccuccagaacgcuuggaaagucuccuguacgauacuggcggccgugucuguuagcccacuucuguugacauccucacagcagaaggcagacuggauuccucucgcucugaccaucaaaggccuaaaucccacugccaucuuccugaccacacuuagccgcacaaguaagaaacggucuuggccacucaacgaggccauuauggcugugggcauggucuccauacuggcaagcucguugcugaagaaugacaucccgaugaccgggccuuuaguagccggaggucuccugacggugugcuacguucuuacaggcagaucagcggaucuggaauuggagagggcugccgacgugaaaugggaggaucaagcagaaauuucugggaguucccccauccucagcauuaccaucucugaggacggaagcauguccauaaagaacgaagaggaggaacagacucugacaauccuaauucgaaccggccugcuugucaucucagguguguuuccaguaaguauucccaucacugccgcugcaugguaucucugggaggugaagaaacagcgcgccgggguccugugggauguuccuagcccacccccuguggaaaaggcggaguuggaagacggagcuuaccggauaaaacagagaggcuucuuaggcuauucucaaauuggggccggaguguacaaggaggguacauuucauaccauguggcacgucacgaggggcgcagugcugaugcaucgugggaaacgcaucgagccguccugggccgauguuaagaaggaccucaucucauauggaggcgguuggaaacuggaaggggaguggaaggaaggagaggaaguacaggugcuugcucuggagccaggcaaaaauccccgggccguccagacuaagccuggcauuuucaaaaccaacacagggaccaucggagcagugaguuuggauuuuagcccagguacauccggcucucccauaguugacagaaaggggaagguggucggacuauacggcaauggugugguaacuaggucgggggcuuacgucagcgccauugcgcagaccgagaaaucaaucgaaaacaacccugagauugaagaugacaucuuccgaaagaaacggcugacgauaauggaucuccacccgggagccggcaagacaaaacgcuaucugcccgcaauugugagagaggcuaucaagaggggccuucggacuuuaauccuggccccaacccgaguuguggcugcagaaauggaggaggcccucagaggguugccuauucgcuaccaaacacccgccaucagggcugaacauaccggacgugagauugucgaccugaugugucacgcgacuuucaccaugcggcuccuguccccagugagaguuccuaauuauaaccuuauaaucauggacgaagcacacuuuacagaucccgccaguauugcugccagggguuacaucucuacgcgcguggagaugggcgaggcagccgggaucuucaugacugcuaccccaccgggaagccgagacccuuuuccccaguccaaugcgccaauuauggaugaagagagagaaauacccgagcggucauggaacucuggccaugaaugggucacagacuucaaggguaaaaccgugugguuuguaccuagcaucaaggccgggaaugauauugcagcuugccugaggaaaaacggaaagaaagugauccaguugagucgcaagacuuucgacuccgaguauguuaagacacgugccaaugauugggacuuugucgugaccacggauauuagcgagaugggcgcaaacuucaaagccgaaagagugaucgacccacggagguguaugaagcccgucauacuaacugauggcgaggaacgcguaauccuggcugggccuaugccggugacacacucuucagccgcgcaacgaagaggacggauugguaggaaucccaaaaacgagaaugaccaguacaucuauaugggcgaaccccucgagaacgacgaggauugcgcacauuggaaggaagccaaaauguuacuggacaauauuaacaccccugaggggaucauacccuccauguuugaaccagagcgcgaaaagguugaugcuauugacggagaguacagacuuaggggcgaggcccggaaaaccuucguggaucugaugcgucgcggugaccucccugucugguuggcuuacaagguggcagccgaagggaucaauuaugcugaucgaaagugguguuuugacggcauuaaaaacaaccagauccuggaggaaaauguugagguggagauauggacuaaggaaggagagaggaaaaagcucaaacccagauggcuggaugcccggaucuacagugacccacuugcacuaaaggaguucaaggaguucgcggccggccgcaaaagccugacauugaacuuaauuaccgaaauggggagacugccuacauuuaugacucagaaggcuaggaaugcccucgauaaccuggcaguccuucacacggcugaggccggaggucgggcauauaaucacgcccugucggagcucccggaaaccuuggagacacugcuacugcucacucuucuggcuaccgugacaggcgggaucuucuuauuuuugaugucuggaaaaggcauugguaagaugacccuggggaugugcugcaucauaacugcguccauucuccugugguacgcccaaauccagccccauuggaucgcagcuagcauuauccuugaguucuuucugauaguacucuugauuccagagccugaaaaacagcgaacgccccaggacaaccaacugaccuaugugguuaucgccauuuuaacagucguggccgcaacuauggcuaaugagaugggcuuccuagagaagaccaagaaagaucugggacucggcucaaucacaacccaggaaagugagucuaacauacuugacaucgaccugagaccagccuccgcguggacuuuguacgcuguggccacaacguuugucaccccuaugcugcgccacagcauugaaaauucaaguguuaacgugagccucacugcaaucgccaaucaggcuacaguacugauggggcuuggaaaggguuggccccucuccaaaauggauauuggcgugccgcuguuggcaaucggguguuauucucaggucaacccaauuacccugaccgccgcguuacuacugcucguggcucauuacgccaucauaggaccuggccuucaagcaaaggccacaagggaggcucagaaacgggccgcagcugguauuaugaagaaucccacuguugacgggaucacggugaucgaucuggaaccaauucccuacgacccuaaguucgagaaacaguugggccaggucaugcugcucauacugugcguaacccaagugcuuaugaugcguacaacuugggccuuaugugaggcgcugacccucgccacaggaccgaucagcaccuugugggaaggcaaccccgggagauuuuggaauacuacgauugcaguuuccauggcuaacaucuucaggggaucauaucuggccggcgcaggucuacuguuuucuauuaugaagaauacaaccaacacucgccgggggaccggaaacaucggcgagacacucggugaaaaauggaagagucgacuuaaugcucugggcaaaucggaguuccagauauacaagaaaagcgggauccaggagguggauagaacuuuggccaaggaaggaauuaagaggggcgagaccgaccaccaugccgucucccgcgggucugcgaaacugcggugguuuguggaaagaaacauggucacaccagagggaaaggugguugaucucggcugcggucgugggggauggucauauuacuguggcggucugaaaaaugugagggaaguaaagggcuuaacgaaagggggaccuggccacgaggagcccaucccuaugagcaccuauggguggaaccuugugcggcugcaauccggagucgacguuuucuucacuccacccgaaaagugcgauacacuccuaugugacauuggcgagaguucuccuaauccaaccaucgaagcuggucgcacucugcgaguguugaaccuggucgagaauuggcucaacaauaacacacaguuuugcauaaaggugcuuaaucccuacaugccgagcguaauugagaaaauggagacccugcagagaaaguaugggggagcauuggugaggaacccucugucaagaaauuccacgcacgagauguacuggguuaguaacgccaccggcaauaucgugagcucugucaacaugaucucccgcaugcucauuaacagauucacaaugaaacauaagaaagcuacuuacgaaccagauguggacuuaggcucagggaccaggaauauaggaaucgagagcgaaauucccaaccuggauaucauugguaagcgaaucgagaagauaaaacaggaacacgagacaucguggcauuaugaccaagaccacccuuacaagacuugggccuaucacggcucuuacgagaccaaacagacagggagugcauccagcauggucaauggagugguucggcuucugaccaagccaugggauguagugcccauggucacucagauggccaugacggacacaaccccguuuggccagcaacguguguucaaagaaaagguugauacuagaacccaggagccuaaggaagguaccaaaaagcuaaugaaaaucacggcugaguggcucuggaaggagcuggggaaaaagaaaacaccacgcguguguacuagggaagaguuuacacggaaggucagaucaaacgcggccuugggagcaauuuucaccgacgaaaauaaguggaaauccgcucgcgaggccguggaagauggcagguuuugggagcugguagaccgagagcggaaccuccaucuugaaggcaagugcgagacuuguguguauaauaugauggggaaaagagaaaagaaacugggagaguucgguaaggcaaagggcucuagggccaucugguacaugugguuaggggcucgcuuucuggaguucgaggccuugggauuucucaacgaggaucacugguucagccguggcaauagucuguccgguguugaaggggagggacuacaucggcuuggcuauauucugagagacgucggcaaaaaggaagggggagcgauguacgcagaugacacagccgguugggauaccaggaucacacucgaggaccugaaaaacgaagagauggugacuaaucacaugaagggcgagcauaaaaaguuggcugaagccauuuuuaagcugaccuaccagaacaaagugguccgcguucagcgaccaacgccucgggggaccgugauggacauaaucagcagaagggaucaacgcggaucuggccagguagguacauaugggcucaauacuuucaccaacauggaggcacagcuuauuagacaaauggaaggagagggcaucuucaagucaauccagcaccugacagcuacugaggaaauugccgugcagaauugguuagcucgggucggcagggagcgucugagucgaauggccauauccggggacgauugcgugguuaaacccaucgacgaucgcuuugcaagcgcguugaccgcccucaacgacaugggaaaggugagaaaagauauucagcaaugggaaccaucucgggguuggaacgacuggacgcagguccccuucugcucgcaccauuuucacgagcuggugaugaaggauggcaggguccuaguugugccuugucgcaaucaggacgaacuuaucgggagagcucggauuucacagggagccggcuggagccugaaggagacagcaugccucgguaaauccuacgcucaaauguggacccugauguauuuccauaggcgagauuugcguuuagccgcaaacgccaucuguagugcggucccaucucacugggugccgacuagcagaacaaccugguccauacacgcuaagcaugaguggaugacuaccgaagacaugcuggccguguggaaucgcgucuggauccaggagaaccccuggauggaagauaaaacaccuguugagucaugggaagaggugccauaccucgggaagcgggaggaccaguggugcggaagucuuauuggccugacgucuagggcaaccugggccaaaaauauccagacugcuauuagccaaguaagaucccuaaucggcaacgaagaguauacagacuacaugcccucaaugaagcgcuuucggagggaagaggaagaggccggggugcugugguga

SEQ ID NO: 14633 - RNA, 9876 nt, Artificial Sequence
  derived and/or modified CDS sequence (opt3) from DENV-2__EU482561__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcucuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucacaacuaauauuuggcugaaguuacgugagaaacaggacguguuuugugauagcaagcugauguccgccgcaaucaaagacaaccgggccgugcacgcugauaugggguauuggauagaaucagcccuuaaugacaccuggaagauggagaaggcaagcuucauugagguaaaaucuugccacuggccuaagucccauacguuguggaguaacggaguccucgaaagcgagaugaucaucccaaaaaauuucgcuggccccgugucucagcacaacuaccgaccugguuaucauacacagaccgccggcccauggcaccuggggaagcuagaaauggauuuugacuucugugagggaacuaccguuguggucacagaagauugcggcaacagagggcccucccugaggacuaccacagcgucaggaaaacucauuacggaguggugcugucgcaguugcacccugccgccucuucgguacagaggcgaggacgguuguugguacgggauggaaaucaggccauugaaggagaaggaagagaaucuggugaacagcuuaguuacugccggacauggccaaauugauaauuuuucgcucggugugcugggcauggcucuuuuccuggaagagauguugcgcacacgaguagggaccaaacacgcaaugcuccuggucgugguguccuuugucacucuaauaacaggaaacaugucuuuccgggaccugggccguguuauggugaugguaggggccaccaugacggaugacaucggaaugggcauuacuuaucucgcucugcuugccgcauuuaaggugagacccaccuucgcggccgguuugcuguuaaggaaacucacaagcaaggagcugaugauggcuaccaucgggauugcccuucugucacagaguacuaucccugaaacaauacuagagcucaccgaugcacuggcuuugggaaugaugguccugaaaaucgugcgcaauauggaaaaguaccaguuagccguuacaauuauggcaaucuccugcgugcccaacgccgucauucuccaaaaugcuuggaaggugucuuguacuauccuggcggccguuagcguguccccacuucuguugaccucaagccagcagaaagcagacuggauaccucucgcucugacgauuaagggccuaaaccccacagccaucuuucugaccacucuuagucggaccucuaaaaagagauccuggccacucaaugaggccaucauggcugucggcaugguaagcauucuggcaucgucauugcugaaaaacgacauaccgaugacagggccuuuaguggccggaggucuccugacuguuugcuaugugcuuaccggcaggucugcggaucuggaauuggagcgagcugccgacgucaagugggaggaucaggcagaaaucaguggguccagccccauucucucuaucacgauuagcgaggacggauccaugucaaucaaaaaugaagaggaggaacaaacacugaccauacuaauccgcacuggccugcuugugauuagugguguauucccagugagcauccccauuacagccgcugcaugguaccucugggaggucaagaagcagcgggccgggguucugugggaugugccuucuccacccccugugggaaaagcggaauuggaggacggcgcuuauagaaucaagcagaggggcauauuaggguacucccagauuggagccggugucuauaaagaaggcaccuuucacacuauguggcaugugacacguggggcaguucugaugcaccgcggaaagcggaucgagccgucaugggccgauguaaaaaaggaccucaucaguuacggcgguggguggaagcuggagggagaauggaaagagggcgaagaggugcaaguccuugcucuggaaccaggcaagaaccccagagccgugcagaccaaaccuggguuguucaagacgaauacuggaaccauuggugcaguuagccuagauuuuuccccaggcacaucugggucgcccaucguggacaggaaaggaaaggucgugggccuguacgguaacgggguagucacccgaagcggagcuuaugugucagccauagcgcagacagagaaguccauugaggauaauccugaaaucgaggacgauauuuuccggaaaaagcgccucacuaucauggaccugcauccgggcgccggcaaaaccaagagauaccuucccgcaauaguuagggaagcuauuaaacggggguuacgaacgcugauccucgccccaacaagaguggucgcugcagagauggaagaggccuugcgcggacugccuaucagguaucagacucccgccauucgugcugagcacaccggucgggaaaucguggaccucaugugucaugcgacauucaccaugagacugcuuaguccaguuagggugccuaacuacaaccugauuauaauggaugaggcacacuuuacugaccccgccucuaucgcugcccgcggcuauauuagcacccgagucgaaaugggggaggcagccggaaucuucaugacagcuacgccaccgggcuccagagauccuuuuccccaaucaaaugcgccaaucauggacgaggaacgggagauucccgaaaggucuuggaacagcggucacgagugggugacugauuucaaggggaagaccguaugguuugugccuaguauaaaagccggaaaugacaucgcagcuugcuugcgcaagaacggcaaaaagguuauucagcuaucccguaaaacauucgauagcgaauacgucaagaccagagccaaugacugggauuuuguggugacuacagacaucucugagaugggcgcaaacuucaaggccgagcgggucauugauccaaggcgcuguaugaaacccguaauccugaccgacggggaagagcgagugauacucgcuggaccuaugccgguuacgcauucauccgccgcgcagagacgggguaggaucggccgcaauccaaagaacgaaaaugaccaauauauuuacaugggggagcccuuagaaaacgaugaggacugcgcacacuggaaagaggccaagaugcugcuugauaauaucaacacuccugaaggaauuauccccaguauguuugagccagaaagagagaaaguggacgcuauagauggcgaauacaggcugcggggugaggcccguaagacauucgucgaccucaugcgccgaggggauuugccuguguggcuggcuuauagaguugcagccgagggcauuaauuacgcugacaggcggugguguuuugauggaaucaaaaacaaucagauucucgaagagaacguggaagucgagaucuggaccaaggagggcgaacgcaagaaacugaagcccagauggcuugacgccaggauauauagcgauccacuagcacugaaagaguucaaggaauucgcggccgggcggaaaucguugaccuuaaaccugaucacugagaugggacgacucccuacauuuaugacccagaaggcuagagacgcccuggauaaucuugcagugcugcauacagcugaagccgguggccgcgcauacaaccacgcccucucugaguugccggagacucuggaaacgcuacugcuccuuacccuguuagcuacaguaacugggggaauuuucuuguuucugauguccggcaaggguaucgggaaaaugacccucggcaugugcugcauuaucacagcgagcauacugcuuugguaugcccagauucaaccccacuggaucgcagcuucaaucauucuggaguucuuucucaucguguugcugauaccagaaccugagaagcagaggaccccccaggacaaucaguuaacuuacguugucauugccauccuaacggugguggccgcaaccauggcuaacgaaaugggauuccuggagaaaacaaagaaagaccucggccuugggaguauugccacucaagagucugaauccaauauccuggauauagacuugcggccagcgagcgcuuggacccuguaugccgucgcaacaaccuuuguuacuccuaugcuccgucauucaaucgagaacaguagcgugaauguaucccugacagccauugcuaaccaggcaacggugcuuaugggacucgguaagggcuggccccugucuaagauggauaucggggucccguugcuggccauuggauguuacagccaggugaauccaaucaccuuaacugcggcucuacugcuccuuguugcccacuacgcaauuaucggcccuggucugcaggccaaagcuacaagagaagcccaaaagagggcagcugccgggauaaugaaaaaccccaccguggacggcauuaccgucaucgauuuggagccaauccccuaugacccuaaguucgaaaaacagcugggacagguaaugcuccugauucuuugcgugacacagguuuuaaugaugcgcacuacgugggcgcugugugaggcccucaccuuggcaacaggcccgauauccacucugugggaggggaaucccggacgguuuuggaacaccacaaucgcugugucaauggccaauauuuuccgaggcucuuaccuagcaggugcugggcugcucuuuaguaucaugaagaacaccacuaauacgagaaggggaacaggcaacauuggugaaacccuuggcgagaaguggaaaucgcgccugaaugccuuggggaagagcgaauuccaaaucuauaaaaaguccggaauacaggaggucgaucggacucuggccaaagagggcaucaagagaggggaaaccgaccaucacgcggugucucguggaucagcuaaacucaggugguuugucgagcggaacauggugacaccagaaggcaagguuguggaucuggguugcgggcgcggaggcuggagcuacuauugugguggcuuaaagaacguacgagaggugaaagggcuuacuaagggaggcccugggcaugaagagcccauuccuauguccaccuacggauggaaucuggucagacuccagaguggcguugacguguucuucacaccacccgagaaaugcgauacgcuacugugugacaucggugaaucuagcccuaacccaaccauugaggcagggaggacuuugcggguccugaaucucguggaaaacuggcuuaauaacaauacacaauuuugcaucaagguacugaaccccuauaugccgucagugauagagaaaauggaaaccuugcagcgcaaguacggaggcgcccugguuagaaauccucucuccaggaacaguacucacgagauguacugggugagcaaugcuacaggcaacauugucucuuccgugaauaugaucucacgaauguuaaucaaccgguucaccaugaagcacaaaaaggccacguaugagccagaugucgaccuggggagcggaacccguaauauugguauagaaucggagauccccaaccuugacauuaucggcaaaagaauugaaaagaucaaacaggagcaugaaacaucuuggcacuacgaucaggaccauccuuauaagacuugggcauaccacgggaguuaugagaccaagcaaacaggauccgccagcucaauggugaacggcguuguacgccugcuaacuaaaccaugggaugugguccccauggugacccagauggcuaugacagacaccacuccguuuggucagcagaggguuuucaaggagaaaguggauacgcggacacaagaaccuaaggaggggaccaaaaagcucaugaagauaacugcggaauggcuguggaaagaguugggaaagaaaaagacccccagaauguguacacgcgaggaauuuacgaggaaaguccgauccaaugccgcacugggcgcuaucuucaccgacgagaacaaguggaaaucugcccgggaagcaguggaggauagcagauuuugggaacucauugacagggagcgcaaucuucaccuggagggcaagugcgaaacuuguguauacaacaugauggggaagcgugagaaaaaguuaggagaauucgguaaagccaagggcagucgggcuaucugguauauguggcugggggccagauuuuuggaguucgaagcgcucggauuucugaaugaggaucauugguucuccaggggcaacagccuaucugguguggagggggaaggacuucaccgccugggcuacauucuccgagacguuucaaaaaaggagggcggggcaauguacgccgaugacacagcuggaugggacacccggaucacucuggaagauuugaagaaugaggaaauggucacaaaccauaugaaaggugagcacaagaaacuggccgaggcaauuuuuaagcucaccuaucagaauaaaguggugagaguccagaggccaacaccucgcggcacuguuauggacauaaucaguagacgggaucagaggggguccggacaagugggcaccuacggucuuaacacguucaccaauauggaagcucagcugauucgucagauggagggggaaggaaucuucaagagcauccaacauuuaacaguaacugaggagauugccgugcagaacuggcuggcucgagucggccgcgaaagauugucucggauggccauaucgggcgacgauugcgugguuaagccccucgacgauagguuugcaucagcgcugaccgcccuaaaugacauggggaaagugcgcaaggauauccagcagugggagccaagcagaggauggaacgacuggacacaaguccccuucugcucccaccacuuucaugaacuuauuaugaaagauggucgggugcugguaguuccuuguaggaaucaggacgagcucaucggccgagcucguauuagucagggggccggauggucucugaaggaaacugcaugcuugggcaaaagcuaugcucagauguggaccuuaauguacuuccacagacgcgaucugcggcucgccgcaaacgccaucuguuccgcggugccaucacauugggucccgacgaguaggacaaccuggucuauacacgcuaagcacgaguggaugacuacagaggacaugcuugccguguggaacagaguguggauccaagaaaaucccuggauggaggacaagaccccugucgaaagcugggaggaaguuccauaucuggguaaacgcgaggaucaguggugcgggucccuaauuggacugacuucacgggcaaccugggccaagaacauccagacagcuauuaaucaggugaggagccucaucggcaacgaggaauacacggacuauaugcccucuaugaaacgauuuagacgggaggaagaggaagccggcguauugugguga

SEQ ID NO: 14634 - RNA, 9876 nt, Artificial Sequence
  derived and/or modified CDS sequence (opt3) from DENV-2__EU569703__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauuccaaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcucuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacacacacugaccauacuaauccgcacuggccugcuuguaauuagugguguguucccagucagcauccccauuacagcagccgcuugguaccucugggagguuaagaagcaacgggcaggggugcugugggaugugccuucuccacccccugucggaaaagccgaauuggaggacggcgcguauagaaucaagcagaggggcauauuuggguacucccagauuggagcugguguguauaaagaaggcaccuuccauacuauguggcacguuacacguggggccguauuaaugcaucgcggaaagcggaucgagccgucaugggcagaugugaaaaaggaccugaucaguuacggcgguggguggaagcucgagggagaauggaaagagggcgaagagguccaggugcuggcccuugaaccaggcaagaaucccagagcuguucaaaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccacccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcauaccggucgggaaaucguugaccugaugugucacgcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccagucaaacgcuccaaucauggacgaggaacgggagauucccgaaaggucuuggaauagcggucaugaguggguaacugauuuuaaggggaagaccgugugguucguuccuaguauaaaagcgggaaacgacaucgccgcaugccugcgcaagaauggcaaaaaggucauucaauugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcacucauccgcugcccagcggaggggucgcaucggcagaaacccaaaaaaugaaaacgaccaguauauuuacaugggggagccccucgaaaaugaugaggacugcgcgcauuggaaggaggcaaaaauguuacuggauaacaucaauacuccugaaggaauuauccccaguauguucgagccagaaagggagaaggucgacgccauagauggcgaauaccggcuucguggugaggcucgcaaaacauuuguggaccugaugcgaagaggggaucucccuguuugguuggccuauaggguggcugcagagggcauuaacuacgccgaccggcgcugguguuucgauggaaucaagaauaaccaaauucuggaagagaacgucgaaguggagaucuggaccaaagagggcgaaagaaagaagcucaaacccagguggcuggacgcucggauauauagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucacacagcagaaguggguggcagggcuuacaaucacgcccugucugagcucccggagacuuuggaaacgcugcuacugcucacccuucuggcaacaguuacugggggaauuuuuuuauucuugauguccggcaaggguaucgggaagaugacccugggcaugugcugcauuaucacagccagcauacuccugugguaugcucagauucagccccauuggaucgcggccucaaucauucuugaguuuuuccugaucguccucuugauaccagaaccugagaaacaacggaccccccaggacaaccagcugacuuacguggugauugcaaucuuaacggucguugcugccaccauggccaaugaaaugggauuucuagagaagacaaaaaaggaccugggccucgggaguauuacuacccaggagucugaauccaacauccuugauauagaccugcguccagcaagcgcuuggacauuguaugccguggcgaccacuuucguaacaccuaugcugagacacucaaucgagaauaguagcgugaacgucucccucacggcuauugccaaucaagcaaccgugcugaugggacuugguaggggcuggccccucucuaaaauggauaucgggguuccgcuguuggccauuggauguuacagccaggugaacccaaucacucugacagcugcauuacuacugcucgucgcccauuacgcgauuaucggcccuggucuucaggcuaaggccacccgcgaagcacagaagcgggccgcugccgggauaaugaaaaaucccaccguagacggcauuacagugaucgaucuggagccaauccccuaugacccuaaguuugaaaaacaauugggacagguuaugcugcucgugcugugcgucacucaggugcuuaugaugcgaacgaccugggcauuaugugaggcucugacacucgccacuggcccgauuuccaccuugugggaggggaaccccggaagauucuggaauacaaccauagcggucucaauggccaacaucuuuaggggcucuuaccuggcaggugcugggcuacuguucaguauuaugaagaauacuacgaacacacgccggggaaccggcaauaucggugaaacucucggcgagaaauggaagucgagacuuaacgcccuggggaagagcgaauuucagauuuauaaaaaguccggaauccaagagguggaucguaccuuggcaaaagagggcauaaagaggggggaaacagaccaccaugcuguuucucggggaucagccaaacugcgcugguucguggagcgaaacaugguaacuccagaaggcaagguggucgaucucgguugcgggagaggaggcuggagcuacuauugugguggccugaaaaauguuagggaggugaagggguuaaccaagggaggcccugggcacgaagagcccaucccuauguccacauacggauggaaccuuguccggcugcagaguggcguggacguauucuuuacgccacccgagaaaugcgauacccuccuaugugacauuggugaaucuagcccuaauccaacuaucgaggccgggcgcacacugagaguguugaaccugguugaaaauuggcucaacaauaacacccaguucugcauuaaggugcuuaaucccuauaugccgucagucaucgagaaaauggaaacucugcaaaggaaguacggaggcgcguuggugcgaaacccucugucccggaauaguacacacgagauguacugggucagcaacgcuaccggcaauauagugucuuccguuaacaugauuucacguaugcucaucaauagauuuacgaugaaacauaagaaggcaaccuaugagccagauguagacuuagggagcggaacacgcaacaucgguauugaaaacgagauacccaaucuggacaucauuggcaaaaggaucgaaaagauuaaacaggagcacgaaacuucguggcauuacgaucaggaccacccuuauaagaccugggccuaccacgggucuuaugagacaaaacagacuggaagugcuuccagcauggugaacggcgucgugcggcuucugaccaagccaugggauguugugcccauggucacacaaauggccaugaccgacacuacgccguucggucagcagagaguguuuaaggagaaaguagauacacgcacccaggaaccuaaggaggggacuaaaaagcuaaugaggaucaccgcagaauggcucuggaaagagcugggaaagaagaaaacaccccgaauguguacgcgggaggaauucaccagaaaggugaggucaaaugccgcuuugggcgcgauauuuacugacgagaacaaauggaaguccgcccgcgaagcaguugaggauucucguuucugggaacuggucgaccgggagagaaaucuccaucuugagggcaaaugcgaaacauguguguacaacaugauggggaagagggagaaaaagcugggagaauuugguaaggcuaaaggcagccgcgccaucugguauaugugguuaggggcacgauuccuggaguuugaagccuugggauuccucaaugaggaucacugguuuagucggggcaacucccugagcgguguggagggggaaggacuacauaagcuuggcuacauucugagagacgucucuaaaaaggagggcggggcuauguacgccgaugacaccgcgggaugggacacuaggaucacacucgaagaucugaaaaaugaggaaaugguuaccaaccacaugaagggugagcauaagaaauuggcagaggccauuuucaagcugacauaucaaaauaaagugguacgcgugcagagaccaacuccucggggcaccgucauggacaucauuucaaggaaggaucagcgugggaguggacaggugggcacguacggucucaacaccuucacaaauauggaagcucaacuuauacgacagauggagggggaaggaaucuuuaaauccauucagcgccugacuguuaccgaggagaucgccgugcaaaacugguuagcaagagucggccgggaaaggcugagccgcauggcuaucucuggcgacgauugcgugguaaagcccuuggacgauagauucgccucggcucucacagcccugaaugacauggggaagguucggaaagauauucagcagugggagccaucaaggggauggaacgacuggacucaggugcccuuuugcagccaccacuuccaugaacuagucaugaaggauggucgagugcuuguggucccuugucguaaccaagacgagcugauaggcagagcacgcaucucccagggggcgggauggagucucaaagaaaccgccugccugggcaagucuuaugcucagauguggacguugauguacuuucaccggagggauuuaagacuggccgcaaaugcuauuuguagcgccguuccaucccauugggugccgacaucacgcaccacuuggaguauccacgcaaaacacgaguggaugacaaccgaggacaugcucgccguauggaaccggguguggauucaggaaaaucccuggauggaggacaagacuccugucgaaucuugggaggaagugccauaucuugguaagagggaggaucaauggugcgggagccugaucggacuaaccucccgagcgacaugggcuaaaaacauacagacggccaucaaucagguuagaucacugauuggcaacgaggaauacaccgacuauaugcccagcaugaagcgguucaggaaagaggaagaggaagcaggcgugcucugguga

SEQ ID NO: 14635 - RNA, 9876 nt, Artificial Sequence
  derived and/or modified CDS sequence (opt3) from DENV-2__EU529694__SS-prME
accgcaggcguguucauaaugcugauucccacagcuauggcauuucaccucacuacgagaaacggggagccucauaugauagucgggaggcaggaaaaggguaaaagccuucuguucaagaccgaggacggcguuaauaugugcacauugauggccauggauuuaggggaacugugugaggacacuaucaccuacaaaugcccacugcuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauucugcggcauccuggcuuuacaaucauggccgcaauauuggccuacaccaucggcacgacucacuuccagcgcgcucucauuuuuauccugcugacagcaguugccccauccaugaccaugagaugcauugggaucucuaacagggauuucguggaaggagucucggguggcucauggguggacauaguacucgagcacgggagcuguguuacuacaauggcuaagaauaagcccaccuuagauuuugaacugauuaaaacggaggccaagcagccugcgacccuucggaaauauugcaucgaagcaaaguugacaaacacuaccacagagagucgcuguccaacucaaggagagcccucccugaaugaagaacaggacaaacgauucgugugcaagcauucuauggucgauagaggcugggguaacggguguggacuguuuggcaagggcgggauugugaccugcgccauguucacaugcaaaaagaauauggaaggaaaagugguccucccugagaaccuggaauacaccaucguuaucacuccacacagcggugaggagcaugcugugggcaaugacacggggaagcacggaaaagaaauuaagauaacaccgcaguccucaaucaccgaggccgaacuuacuggcuaugguaccguaacaauggaguguagucccaggaccgggcuggauuuuaacgaaaugguguugcuccagauggaggacaaagcauggcugguccaccggcaaugguucuuagaucugccucucccauggcuucccggcgcugacacucagggaagcaauuggauucagaaggagacacuggugacguuuaagaacccucaugccaaaaagcaggacguuguggucuugggcucucaagaaggggcgaugcacaccgcccuaacuggagcaacagagauccagauguccucagguaaucuacucuucaccggccaucugaaaugccgucuucgcauggauaagcugcaguugaaagggaugagcuacaguauguguacaggaaaguucaagauagugaaagaaauugcugagacucaacacggcaccaucguaaucagaguucaguaugagggugacgggucuccaugcaagauucccuuugaaaucauggaucucgagaaaaggcaugugcugggccgguuaauuacggucaacccgauaguggccgaaaaggacuccccugucaacaucgaggcugaacccccauucggagauagcuacauuaucaucggcguggagccugggcagcugaaacuaaauugguuuaagaagggaucgucuauuggucagauguucgagaccacaaugcgaggcgccaaacgcauggcaauacucggggacacugccugggauuuuggaucccugggcgguguuuucaccucaaucgggaaggcacuucaccaaguguuuggcgcgauuuacggagcagccuucaguggcguaagcuggacaaugaaaaucuugauuggggucaucauaacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuuuaucacagauaauguccacaccuggacugagcaguacaaguuccagcccgaaaguccaagcaaacucgcauccgccauucaaaaggcucaugaggaagguaucuguggcauaaggucugugacacggcuggagaacuuaauguggaaacagauuacccccgagcugaaucacauccuaucggaaaacgaggugaagcucacuauuaugaccggggacaucaaaggaauaaugcaggccggcaagcgcagccugagaccucagccaacagaacuuaaauauuccuggaagacgugggggaaggcaaaaauguugucaaccgagagucauaaucaaacuuuucugaucgauggaccggaaacagcggagugccccaacaccaauagggcuuggaacucucucgaggucgaagacuacggcuucgguguuuuuacaacuaauauuuggcugaaguuacgugagaaacaggacguguucugugauagcaagcugauguccgccgcaaucaaagacaaccgggccgugcacgcugauaugggguauuggauugaaucagcccuuaaugacaccuggaagauggagaaggcuucauucaucgagguaaaaucuugccacuggccuaagucccauacguuguggaguaacggaguccucgaaagcgagaugauaauucccaaaaauuuugcuggccccgugucucagcacaacuaccgaccugguuaucauacacagaccgccggcccauggcaccuggggaagcuagaaauggauuucgacuuuugugagggaacuaccguuguggucacagaagauugcggcaacagagggcccucccugaggacuaccacagcgucaggaaaacucaucacggaguggugcugucgcaguugcacccugccgccucuucgguacagaggcgaggacgguuguugguacgggauggaaaucaggccauugaaggagaaggaagagaaucuggugaacagcuuaguuacugccggacauggccaaauugauaauuucucgcucggugugcugggcauggcucuuuuucuggaagagauguugcgcacacgaguagggaccaaacacgcaaugcuccuggucgccguguccuucgugacucuaaucacaggaaacaugucuuuucgggaccugggccgugucaugguuauggugggggcuaccaugacggaugacauuggaaugggcauaacuuaucucgcccugcuugcagcguucaagguaagacccaccuuugccgcugguuugcuguuaaggaaacucacaagcaaggagcugaugauggccaccaucgggauugcacuucugucacagaguacuaucccugaaacaauucuagagcucaccgaugcucuggccuugggaaugauggugcugaaaaucguccgcaauauggaaaaguaccaguuagcagugacaauaauggccaucuccugcguucccaacgcugugauucuccaaaaugcguggaaggucucuuguacuauccuggccgcagugagcguuuccccacuucuguugaccucaagccagcagaaagcugacuggauuccucucgcccugacgaucaagggccuaaaccccacagccauauuccugaccacucuuagucggaccucuaaaaagagauccuggccacucaaugaggcuauuauggcagugggcauggucagcauccuggccucgucauugcugaaaaacgacaucccgaugacagggccuuuaguagcgggaggucuccugacugugugcuauguucuuaccggcaggucugcugaucuggaauuggagcgagccgcagacgugaagugggaggaucaggccgaaauuaguggguccagccccauacucucuaucacgauuagcgaggacggauccaugucaaucaaaaaugaagaggaggaacaaacacugaccauucuaauccgcacuggccugcuugucauaagugguguguuuccaguaagcauccccauuacagcugcagccugguaccucugggaggugaagaagcagcgggcggggguccugugggauguuccuucuccacccccugugggaaaagcugaauuggaggacggcgccuauagaaucaagcagaggggcauuuuaggguacucccagaucggagccgguguguauaaagaaggcaccuuccacacuauguggcaugucacacguggggccgugcugaugcaccgcggaaagcggauagagccgucaugggcugauguuaaaaaggaccucauuaguuacggcgguggguggaagcuggagggagaauggaaagagggcgaagagguacaagugcuugcccuggaaccaggcaagaaccccagagcaguccagaccaaaccuggguuguuuaagacgaauacuggaaccaucggugcugugagccuagauuucuccccaggcacaucugggucgcccaucguugacaggaaaggaaagguggucggccuguacgguaacggggugguaacccgaagcggagccuaugucucagcgauugcccagacagagaaguccaucgaggauaauccugaaauagaggacgauauuuuccggaaaaagcgccucacuaucauggaccugcauccgggcgcaggcaaaaccaagagauaccuucccgcuauugugagggaagccaucaaacggggguuacgaacgcugauacucgcuccaacaagaguuguggcagccgagauggaagaggccuugcgcggacugccuauuagguaucagacucccgcuauccgugcggagcacaccggucgggaaaucgucgaccucaugugucaugcaacauuuaccaugagacugcuuaguccagugaggguuccuaacuacaaccugauuaucauggaugaggcccacuucacugaccccgcuucuauugccgcacgcggcuauauaagcacccgaguggaaaugggggaggccgcuggaaucuuuaugacagcgacgccaccgggcuccagagauccuuucccccaaucaaaugccccaauuauggacgaggaacgggagauccccgaaaggucuuggaacagcggucacgagugggucacugauuuuaaggggaagaccgugugguucguaccuaguaucaaagcaggaaaugacauugcugccugcuugcgcaagaacggcaaaaaggugauacagcuaucccguaaaacauuugauagcgaauacguuaagaccagagcaaaugacugggauuucgucgugacuacagacaucucugagaugggcgccaacuuuaaggcugagcgggugauugauccaaggcgcuguaugaaacccgucauccugaccgacggggaggaacgaguaauucucgccggaccuaugccggugacgcauucauccgcggcacagagacgggguaggaucggccgcaauccaaagaacgaaaaugaccaauauauauacaugggggagcccuuagaaaacgaugaggacugcgcccacuggaaagaggcuaagaugcugcuugauaauaucaacacuccugaaggaauuauccccaguauguucgagccagaaagagagaaaguugacgccauugauggcgaauacaggcugcggggugaggcucguaagacauuuguggaccucaugcgccgaggggauuugccugucuggcuggcauauagaguggccgcugagggcaucaauuacgccgacaggcggugguguuucgauggaaucaaaaacaaucagauucucgaagagaacguugaaguggagaucuggaccaaggagggcgaacgcaagaaacugaagcccagauggcuugacgcaaggauuuauagcgauccacuagcgcugaaagaguucaaggaauuugccgcugggcggaaaucguugaccuuaaaccugaucacugagaugggacgacucccuacauucaugacccagaaggccagagacgcacuggauaaucuugcuguccugcauacagccgaagccgguggacgcgcauacaaccacgcucucucugaguugccggagacucuggaaacgcuacugcuccuuacccuguuagcgacagugacugggggaauauuuuuguuccugauguccggcaaggguaucgggaaaaugacccucggcaugugcugcauuaucacagccagcauucugcuuugguaugcacagauccaaccccacuggauagcugccucaauuauccuggaguuuuuccucaucguauugcugauuccagaaccugagaagcagaggaccccacaggacaaucaguuaacuuacgugguuaucgccauacuaacggucguggcagcuaccauggccaacgaaaugggauuucuggagaaaacaaagaaagaccucggccuugggaguauugcgacucaagagucugaauccaauauccuggauauugacuugcggccagcuagcgccuggacccuguaugcaguggccacaaccuucgucacuccuaugcuccgucauucaaucgagaacaguagcguuaaugugucccugacagcuauagcaaaccaggccacgguacuuaugggacucgguaagggcuggccccugucuaagauggauaucggggugccguugcuggcgauuggauguuacagccaggucaauccaaucaccuuaacugcugcccuacugcuccuuguggcacacuacgccauuaucggcccuggucugcaggcuaaagccacaagagaagcacaaaagagggcugccgcggggauuaugaaaaaccccaccguugacggcaucaccgugauagauuuggagccaauucccuaugacccuaaguuugaaaaacagcugggacaggucaugcuccugauccuuugcguaacacagguguuaaugaugcgcacuacgugggcccugugugaggcacucaccuuggcuacaggcccgaucuccacucugugggaggggaaucccggacgguucuggaacaccacaauugccguuucaauggcaaauauauuucgaggcucuuaccuagcuggugccgggcuacucuucaguaucaugaagaacaccacuaauacgagaaggggaacaggcaacauuggugaaacccuuggcgagaaguggaaaucgcgccugaaugccuugggaaagagcgaauuucaaaucuauaaaaaguccggcauucaggagguggaucggacucuggcgaaagagggcaucaagagaggggaaaccgaccaucacgcugucucucguggaucagcaaaacucaggugguucguggagcggaacauggucacaccagaaggcaaggugguugaucuggguugcgggcgcggaggcuggagcuacuauugugguggcuuaaagaacgugcgagagguaaaagggcuuacuaagggaggcccugggcaugaggaacccauaccuauguccaccuacggauggaaucuggugagacuccagaguggcgucgacguuuucuuuacaccacccgagaaaugcgauacgcuacugugugacaucggugaaucuagcccuaacccaaccauugaggccgggaggacuuugcgggugcugaaucucgucgaaaacuggcuuaauaacaauacacaauucugcaucaaggugcugaaccccuauaugccgucaguaauugagaaaauggaaaccuugcagcgcaaguacggaggcgcucuggugagaaauccucucuccaggaacaguacucacgagauguacuggguuagcaaugccacaggcaacaucgugucuuccgucaauaugauaucacgaauguuaauuaaccgguuuaccaugaagcacaaaaaggcaacguaugagccagauguggaccuggggagcggaacccguaauaucgguaucgaaucggagauucccaaccuugacauaaucggcaaaagaauugaaaagaucaaacaggagcaugaaacaucuuggcacuacgaucaggaccauccuuauaagacuugggccuaccacgggaguuaugagaccaagcaaacaggauccgcuagcucaauggucaacggcgugguucgccugcuaacuaaaccaugggauguagugcccauggucacccagauggcgaugacagacaccacuccguucggucagcagaggguguuuaaggagaaaguugauacgcggacacaagaaccuaaggaggggaccaaaaagcucaugaagauuacugccgaauggcuguggaaagaguugggaaagaaaaagacccccagaauguguacacgcgaggaguucacgaggaaagugcgauccaaugcagcucugggcgccaucuuuaccgacgagaacaaguggaaaucugcacgggaagccgucgaggauagcagauucugggaacucauagacagggagcgcaaucuucaccuggagggcaagugcgaaacuuguguguacaacaugauggggaagcgugagaaaaaguuaggagaauuugguaaagcuaagggcagucgggccaucugguauauguggcugggggcgagauucuuggaguuugaagcacucggauuccugaaugaggaucauugguuuuccaggggcaacagccuaucugguguagagggggaaggacuucaccgccugggcuacauucuccgagacgugagcaaaaaggagggcggggccauguacgcugaugacacagccggaugggacacccggaucacucuggaagauuugaagaaugaggaaaugguuacaaaccauaugaaaggugagcacaagaaacuggcagaggcuauuuucaagcucaccuaucagaauaaagucgugagagugcagaggccaacaccucgcggcacugucauggacaucauuaguagacgggaucagaggggguccggacaaguuggcaccuacggucuuaacacguucaccaauauggaagcccagcugauacgucagauggagggggaaggaaucuuuaagagcauucaacauuuaacagugacugaggagaucgcuguacagaacuggcuggcccgagugggccgcgaaagauugucucggauggcaaucucgggcgacgauugcgucgugaagccccucgacgauagguucgcgucagcccugaccgcucuaaaugacauggggaaaguucgcaaggauauucagcagugggagccaagcagaggauggaacgacuggacacaagugcccuuuugcucccaccacuuccaugaacuugucaugaaagauggucgggugcugguaguuccuuguaggaaucaggacgagcucauaggccgagcccguaucagucagggggcaggauggucucugaaggaaacugcuugcuugggcaaaagcuaugcccagauguggaccuuaauguacuuucacagacgcgaucugcggcucgcagccaacgcgauuuguuccgcugugccaucacauugggucccgacgaguaggacaaccuggucuauccacgccaagcacgaguggaugacuacagaggacaugcuugcaguguggaacagaguguggauucaagaaaaucccuggauggaggacaagaccccugucgaaagcugggaggaaguuccauaucuggguaaacgcgaggaucaguggugcgggucccuaaucggacugacuucacgggccaccugggcuaagaacauacagacagccaucaaucaggugaggagccucauuggcaacgaggaauacacggacuauaugcccucuaugaaacgauucagacgggaggaagaggaagcaggcguauugugguga

SEQ ID NO: 14636 - RNA, 9876 nt, Artificial Sequence
  derived and/or modified CDS sequence (opt3) from DENV-2__EU529695__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauuccaaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcucuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacaaacacugaccauacuaauccgcacuggccugcuuguaauuagugguguguucccagucagcauccccauuacagcagccgcuugguaccucugggagguuaagaagcagcgggcaggggugcugugggaugugccuucuccacccccugucggaaaagccgaauuggaggacggcgcguauagaaucaagcagaggggcauauuuggguacucccagauuggagcugguguguauaaagaaggcaccuuccacacuauguggcauguuacacguggggccguauuaaugcaccgcggaaagcggaucgagccgucaugggcagaugugaaaaaggaccugaucaguuacggcgguggguggaagcucgagggagaauggaaagagggcgaagagguccaagugcuggcccuugaaccaggcaagaaucccagagcuguucagaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccauccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcacaccggucgggaaaucguugaccugaugugucaugcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccaaucaaacgcuccaaucauggacgaggaacgggagauucccgaaaggucuuggaauagcggucacgaguggguaacugauuuuaaggggaagaccgugugguucguuccuaguauaaaagcgggaaacgacaucgccgcaugccugcgcaagaauggcaaaaaggucauucaguugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcauucauccgcugcccagcggaggggucgcaucggcagaaacccaaaaaaugaaaacgaccaauauauuuacaugggggagccccucgaaaaugaugaggacugcgcgcacuggaaggaggcaaaaauguuacuggauaacaucaauacuccugaaggaauuauccccaguauguucgagccagaaagggagaaggucgacgccauagauggcgaauaccggcuucguggugaggcucgcaaaacauuuguggaccugaugcgaagaggggaucucccuguuugguuggccuauaggguggcugcagagggcauuaacuacgccgaccggcgcugguguuucgauggaaucaagaauaaccagauucuggaagagaacgucgaaguggagaucuggaccaaagagggcgaaagaaagaagcucaaacccagguggcuggacgcucggauauauagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucauacagcagaaguggguggcagggcuuacaaucacgcccugucugagcucccggagacuuuggaaacgcugcuacugcucacccuucuggcaacaguuacugggggaauuuuuuuauucuugauguccggcaaggguaucgggaagaugacccugggcaugugcugcauuaucacagccagcauacuccugugguaugcucagauucaaccccacuggaucgcggccucaaucauucuugaguuuuuccugaucguccucuugauaccagaaccugagaaacagcggaccccccaggacaaccagcugacuuacguggugauugcaaucuuaacggucguugcugccaccauggccaaugaaaugggauuucuagagaagacaaaaaaggaccugggccucgggaguauuaucacucaagagucugaauccaacauacuugauaucgaccugcguccagcaagcgcuuggaccuuguaugccguggcgacaaccuucguaacuccuaugcugagacauucaauugagaauaguagcgugaacgucucccucacagcuaucgccaaucaggcaacggugcugaugggacuugguaggggcuggccccucucuaaaauggauauugggguuccgcuguuggccaucggauguuacagccaggugaacccaauuacccugacugcugcauuacuacugcucgucgcccacuacgcgaucauaggcccuggucuucaggcuaaggccacacgcgaagcacaaaagcgggccgcugccgggauuaugaaaaaucccaccguagacggcaucaccgugaucgaucuggagccaauucccuaugacccuaaguuugaaaaacaguugggacagguuaugcugcucgugcugugcgucacacaggugcuuaugaugcgaacuacgugggcauuaugugaggcucugacccucgccacaggcccgauauccacuuugugggaggggaaccccggaagauucuggaauaccacaaucgcggucucaauggccaacauuuuuaggggcucuuaccuggcaggugcugggcuacuguucaguaucaugaagaauaccacuaacacgcgccggggaacaggcaauauuggugaaacccucggcgagaaauggaagucgagacuuaacgcccuggggaagagcgaauuucaaaucuauaaaaaguccggaauacaggagguggaucguacuuuggcaaaagagggcaucaagaggggggaaaccgaccaucacgcuguuucucggggaucagccaaacugcgcugguucguggagcgaaacaugguaacaccagaaggcaagguggucgaucucgguugcgggagaggaggcuggagcuacuauugugguggccugaaaaauguuagggaggugaagggguuaacuaagggaggcccugggcaugaagagcccauuccuauguccaccuacggauggaaccuuguccggcugcagaguggcguggacguauucuuuacaccacccgagaaaugcgauacgcuccuaugugacaucggugaaucuagcccuaauccaaccauugaggccgggcgcacucugagaguguugaaccugguugaaaauuggcucaacaauaacacacaauucugcaucaaggugcuuaaucccuauaugccgucagucauagagaaaauggaaacccugcagaggaaguacggaggcgcguuggugcgaaacccucugucccggaauaguacucacgagauguacugggucagcaacgcuacaggcaauauugugucuuccguuaacaugaucucacguaugcucaucaauagauuuaccaugaaacacaagaaggcaacguaugagccagauguagacuuagggagcggaacccgcaacauugguauagaaaacgagauccccaaucuggacauuaucggcaaaaggauugaaaagaucaaacaggagcaugaaacaucguggcacuacgaucaggaccauccuuauaagacuugggccuaccacgggucuuaugagaccaaacaaacaggaagugcuuccagcauggugaacggcgucgugcggcuucugacuaagccaugggauguugugcccauggucacccagauggccaugacagacaccacuccguucggucagcagagaguguuuaaggagaaaguagauacgcgcacacaagaaccuaaggaggggaccaaaaagcuaaugaggauaacugcagaauggcucuggaaagagcugggaaagaagaaaaccccccgaauguguacacgggaggaauucacgagaaaggugaggucaaaugccgcuuugggcgcgaucuuuaccgacgagaacaaauggaaguccgcccgcgaagcaguugaggauucucguuucugggaacuggucgaccgggagagaaaucuccaccuugagggcaaaugcgaaacuuguguguacaacaugauggggaagagggagaaaaagcugggagaauuugguaaggcuaaaggcagccgcgccauuugguauaugugguuaggggcacgauuccuggaguuugaagccuugggauuccucaaugaggaucauugguuuagucggggcaacucccugagcgguguggagggggaaggacuacacaagcuuggcuacauccugagagacgucucuaaaaaggagggcggggcuauguacgccgaugacacagcgggaugggacaccaggauuacucucgaagaucugaaaaaugaggaaaugguuacaaaccauaugaagggugagcacaagaaauuggcagaggccaucuucaagcugaccuaucagaauaaagugguacgcgugcagagaccaacaccucggggcacugucauggacauuauaucaaggaaggaucagcgugggaguggacaagugggcaccuacggucucaacacguucaccaauauggaagcucagcuuauccgacagauggagggggaaggaauuuuuaaauccauccaacaucugacaguuacugaggagaucgccgugcagaacugguuagcacgcgucggcagagaacggcugagcaggauggcuauuucuggcgacgauugcgugguaaagcccuuggacgaucgcuucgccucggcucucaccgcccugaaugacauggggaagguuagaaaagauauacagcagugggagccaucacggggauggaacgacuggacacaagugcccuuuugcagccaccacuuccaugaacuagucaugaaggaugguagggugcuuguggucccuugucgaaaccaggacgagcugaucggccgugcaagaauuucccagggggcgggauggagucucaaagaaacugccugccugggcaagucuuaugcucagauguggaccuugauguacuuucaccgccgggauuuaaggcuggccgcaaaugcuaucuguagcgccguuccaucccauugggugccgacgucaagaacaaccuggaguauucacgcaaaacacgaguggaugacuacagaggacaugcucgccguauggaaccgcguguggauccaagaaaaucccuggauggaggacaagaccccugucgaaucuugggaggaagugccauaucuugguaagcgggaggaucaguggugcgggagccugauaggacuaacuuccagggcgaccugggcuaaaaacauccagacagccauuaaucagguucgaucacugaucggcaacgaggaauacacggacuauaugcccagcaugaagagauuccggaaagaggaagaggaagcaggcgugcucugguga

SEQ ID NO: 14637 - RNA, 9876 nt, Artificial Sequence
  derived and/or modified CDS sequence (opt3) from DENV-2__EU482562__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccgaaaaggacuccccugucaacaucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaccaaguguucggcgcuauuuacggagcggcauuuaguggcguaagcuggacuaugaaaaucuugauaggggucaucauuaccuggaucggaaugaacuccagaucuacgagccugucagugagucucguucuggugggcgucgugauucuuuaucugggugccaugguacaggcugacuccgggugugugguuagcuggaagucuaaagaauugaagugcggaucaggcaucuucauaacagauaauguccacaccuggacugagcaguacaaguuucagcccgaaaguccaagcaaacucgccuccgcaauucaaaaggcccaugaggaagguaucuguggcauuaggucugugacacggcuggagaacuuaauguggaaacagaucacccccgagcugaaucacauacuaucggaaaacgaggugaagcucacuaucaugaccggggacauuaaaggaaucaugcaggcuggcaagcgcagccugagaccucagccaacagaacuuaaauauuccuggaagacgugggggaaggccaaaauguugucaaccgagagucauaaucaaacuuuccugauugauggaccggaaacagcagagugccccaacaccaauagggcguggaacucucucgaggucgaagacuacggcuuugguguuuucacaacuaauaucuggcugaaguuacgugagaaacaggacguguuuugugauagcaagcugauguccgcugccauaaaagacaaccgggcagugcacgccgauaugggguauuggauugaaucagcucuuaaugacaccuggaagauggagaaggccagcuucaucgagguaaaaucuugccacuggccuaagucccauacguuguggaguaacggaguccucgaaagcgagaugaucauuccaaaaaauuucgcaggccccgugucucagcacaacuaccgaccugguuaucauacacagaccgcuggcccauggcaccuggggaagcuagaaauggauuuugacuucugugagggaacuaccguuguggucacagaagauugcggcaacagagggcccucccugaggacuaccacagccucaggaaaacucaucacggaguggugcugucgcaguugcacccugccgccucuucgguacagaggcgaggacgguuguugguacgggauggaaauuaggccauugaaggagaaggaagagaaucuggugaacagcuuaguuacugcgggacauggccaaauagauaauuuuucgcucggugugcugggcauggcccuuuuccuggaagagauguugcgcacacgaguagggaccaaacacgcuauccuccuggucgcaguguccuuugugacucuaauuacaggaaacaugucuuuccgggaccugggccgugucaugguuauggugggggccaccaugacggaugacaucggaaugggcguaacuuaucucgcucugcuugccgcauuuaaggugagacccaccuucgcggccgguuugcuguuaaggaaacucacaagcaaggagcugaugauggcuaccauugggaucgcccuucugucacagaguacuauaccugaaacaauccuagagcucaccgaugcacuggcuuugggaaugaugguccugaaaauugugcgcaauauggaaaaguaccaguuagccguuacaaucauggcaauuuccugcgugcccaacgccgucauccuccaaaaugcuuggaaggugucuuguacuauacuggcggccguuagcguguccccacuucuguugaccucaagccagcagaaagcagacuggauuccucucgcucugacgaucaagggccuaaaccccacagccaucuuucugaccacucuuagucggaccucuaaaaagagauccuggccacucaaugaggccauuauggcugucggcaugguaagcauacuggcaucgucauugcugaaaaacgacaucccgaugacagggccuuuaguggccggaggucuccugacuguuugcuaugugcuuaccggcaggucugcggaucuggaauuggagcgagcugccgacgucaagugggaggaucaggcagaaauuaguggguccagccccauccucucuauuacgaucagcgaggacggauccaugucaauaaaaaaugaagaggaggaacaaacacugaccauccuaauucgcacuggccugcuugugaucagugguguauucccagugagcauucccaucacagccgcugcaugguaccucugggaggucaagaagcagcgggccgggguucugugggaugugccuucuccacccccugugggaaaagcggaauuggaggacggcgcuuauagaauaaagcagaggggcauuuuaggguacucccagaucggagccggugucuauaaagaaggcaccuuucacacuauguggcaugugacacguggggcaguucugaugcaccgcggaaagcggaucgagccgucaugggccgauguaaaaaaggaccucauuaguuacggcgguggguggaagcuggagggagaauggaaagagggcgaagaggugcaaguccuugcucuggaaccaggcaagaaccccagagccgugcagaccaaaccuggguuguucaagacgaauacuggaaccaucggugcaguuagccuagauuuuuccccaggcacaucugggucgcccauaguggacaggaaaggaaaggucgugggccuguacgguaacgggguagucacccgaagcggagcuuaugugucagccauugcgcagacagagaaguccaucgaggauaauccugaaauugaggacgauaucuuccggaaaaagcgccucacuauaauggaccugcauccgggcgccggcaaaaccaagagauaccuucccgcaauuguuagggaagcuaucaaacggggguuacgaacgcugauccucgccccaacaagaguggucgcugcagagauggaagaggccuugcgcggacugccuauuagguaucagacucccgccauccgugcugagcacaccggucgggaaauuguggaccucaugugucaugcgacauucaccaugagacugcuuaguccaguuagggugccuaacuacaaccugauaaucauggaugaggcacacuuuacugaccccgccucuauugcugcccgcggcuauaucagcacccgagucgaaaugggggaggcagccggaaucuucaugacagcuacgccaccgggcuccagagauccuuuuccccaaucaaaugcgccaauuauggacgaggaacgggagauacccgaaaggucuuggaacagcggucacgagugggugacugauuucaaggggaagaccguaugguuugugccuaguaucaaagccggaaaugacauugcagcuugcuugcgcaagaacggcaaaaagguuauccagcuaucccguaaaacauucgauagcgaauacgucaagaccagagccaaugacugggauuuuguggugacuacagacauuucugagaugggcgcaaacuucaaggccgagcgggucaucgauccaaggcgcuguaugaaacccguaauacugaccgacggggaagagcgagugauccucgcuggaccuaugccgguuacgcauucauccgccgcgcagagacgggguaggauuggccgcaauccaaagaacgaaaaugaccaauauaucuacaugggggagcccuuagaaaacgaugaggacugcgcacacuggaaagaggccaagaugcugcuugauaauauuaacacuccugaaggaaucauacccaguauguuugagccagaaagagagaaaguggacgcuauugauggcgaauacaggcugcggggugaggcccguaagacauucgucgaccucaugcgccgaggggauuugccuguguggcuggcuuauagaguugcagccgagggcaucaauuacgcugacaggcggugguguuuugauggaauuaaaaacaaucagauccucgaagagaacguggaagucgagauauggaccaaggagggcgaacgcaagaaacugaagcccagauggcuugacgccaggaucuauagcgauccacuagcacugaaagaguucaaggaauucgcggccgggcggaaaucguugaccuuaaaccugauuacugagaugggacgacucccuacauuuaugacccagaaggcuagagacgcccuggauaaucuugcagugcugcauacagcugaagccgguggccgcgcauacaaccacgcccucucugaguugccggagacucuggaaacgcuacugcuccuuacccuguuagcuacaguaacugggggaaucuucuuguuucugauguccggcaaggguauugggaaaaugacccucggcaugugcugcaucauaacagcgagcauucugcuuugguaugcccagauccaaccccacuggaucgcagcuucaauuauccuggaguucuuucucauaguguugcugauuccagaaccugagaagcagaggaccccccaggacaaucaguuaacuuacguugucaucgccauucuaacggugguggccgcaaccauggcuaacgaaaugggauuccuggagaaaacaaagaaagaccucggccuugggaguaucacuacccaagagucugaauccaauauacuggauaucgacuugcggccagccagcgcguggacacuguaugcugucgccaccacuuuuguuacaccuaugcuccgucauucaauugagaacaguagcgugaauguaucccugacggcaaucgccaaccaggcuaccgugcuuaugggacucgguaagggcuggccccugucuaagauggauauuggggucccguugcuggcaaucggauguuacagccaggugaauccaauuacuuuaacagccgcgcuacugcuccuuguugcucacuacgccaucauaggcccuggucugcaggcaaaagccaccagagaagcucaaaagagggccgcagcugggauuaugaaaaaccccaccguggacggcaucacagucaucgauuuggagccaauucccuaugacccuaaguucgaaaaacagcugggacagguaaugcuccugauacuuugcgugacucagguuuuaaugaugcgcacgaccugggcccugugugaggcgcucacauuggccacuggcccgaucuccacccugugggaggggaaucccggacgguuuuggaacacaaccauugcagugucaauggcuaauaucuuccgaggcucuuaccuagccggugcagggcugcucuuuaguauuaugaagaacacuacgaauacaagaaggggaaccggcaacaucggugaaacucuuggcgagaaguggaaaucgcgccugaaugcuuuggggaagagcgaauuccaaauauauaaaaaguccggaauccaggaggucgaucggacccuggccaaagagggcauuaagagaggggaaacagaccaucacgccgugucucguggaucagcgaaacucaggugguuugucgagcggaacauggugacuccagaaggcaagguuguggaucuggguugcgggcgcggaggcuggagcuacuauugugguggcuuaaagaacguacgagaggugaaagggcuuaccaagggaggcccugggcaugaagagcccaucccuauguccacauacggauggaaucuggucagacuccagaguggcguugacguguucuucacgccacccgagaaaugcgauacccuacugugugacauuggugaaucuagcccuaacccaacuaucgaggcugggaggacauugcggguccugaaucucguggaaaacuggcuuaauaacaauacccaauuuugcauaaagguacugaaccccuauaugccgucagugauugagaaaauggaaacuuugcagcgcaaguacggaggcgcacugguuagaaauccucucuccaggaacaguacacacgagauguacugggugagcaaugccaccggcaacaucgucucuuccgugaauaugaucucacgaauguuaauuaaccgguucacgaugaagcacaaaaaggcuaccuaugagccagaugucgaccuggggagcggaacacguaauauagguaucgaaucggagauucccaaccuugacaucauuggcaaaagaaucgaaaagauaaaacaggagcaugaaacuucuuggcacuacgaucaggaccauccuuauaagaccugggccuaccacgggaguuaugagacaaagcaaacuggauccgcaagcuuuauggugaacggcguuguacgccugcuaaccaaaccaugggaugugguccccauggugacacagauggccaugaccgacacuacgccguucggucagcagaggguuuuuaaggagaaaguggauacacggacccaagaaccuaaggaggggacuaaaaagcucaugaagaucaccgcugaauggcuguggaaagaguugggaaagaaaaagacacccagaauguguacgcgcgaggaauucaccaggaaaguccgaucaaaugcggcccugggcgcaauuuuuacugacgagaacaaguggaaauccgcucgggaagccguggaggauucuagauucugggaacucaucgacagggagcgcaaucuucaccuggagggcaagugcgaaacauguguauacaacaugauggggaagcgugagaaaaaguuaggagaauuugguaaagcaaagggcagccgggccauuugguauauguggcugggggcuagauucuuggaguuugaagcccucggauuccugaaugaggaucauugguuuaguaggggcaacucccuaagcgguguggagggggaaggacuucaccgccugggcuacauccuccgagacguuucuaaaaaggagggcggggcgauguacgcagaugacaccgccggaugggacacucggauuacacuggaagauuugaagaaugaggaaauggucaccaaccauaugaaaggugagcacaagaaacuggcugaggccauauucaagcucacauaucagaauaaaguggugagaguccagaggccaacuccucgcggcaccguuauggacaucauuucaagacgggaucagagggggaguggacaagugggcacguacggucuuaacaccuucacaaauauggaagcacagcugauccgucagauggagggggaaggaaucuuuaaguccauucaacauuuaacuguaaccgaggagauagcugugcagaacuggcuggcccgagucggccgcgaaagauugagccggauggcuaucucuggcgacgauugcgugguuaagccccucgacgauagguucgccucggcacugacagcgcuaaaugacauggggaaagugcgcaaggauauucagcagugggagccaucaagaggauggaacgacuggacucaaguccccuuuugcagccaccacuuccaugaacuugugaugaaagauggucggguacugguugugccuuguaggaaucaggacgagcucaucggccgagcccguauuucccagggggcuggauggagucugaaggaaaccgccugcuugggcaaaucuuaugcacagauguggacguuaauguacuuucacagacgcgaucugcggcucgcugccaacgcaaucuguagcgccgucccaucccauugggugccgacaucaaggaccacuuggaguauacacgcgaagcacgaguggaugacaaccgaggacaugcuugcuguguggaacagagucuggauccaagaaaaucccuggauggaggacaagacuccuguugaaucuugggaggaagugccauaucuggguaaacgcgaggaucaguggugcgggagccuaauuggacugaccucccgggccacaugggcaaagaacauccagacggccauuaaucagguaaggucacucaucggcaacgaggaauacaccgacuauaugcccagcaugaaacgauucagacgggaggaagaggaagcuggcguguugugguga

SEQ ID NO: 14638 - RNA, 9876 nt, Artificial Sequence
  derived and/or modified CDS sequence (opt3) from DENV-2__EU482565__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauauucugggccgguuaaucacgguuaacccgaucgugaccgaaaaggacuccccugucaacauugaggccgaacccccauuuggagauagcuacauaaucauuggcguggagccugggcagcugaaacuaaauugguucaagaagggaucgucuaucggucagauguuugagacaacuaugcgaggcgcuaaacgcauggccauucucggggacaccgcaugggauuucggaucccugggcggugucuuuacaucaaucgggaaggcccuucaccaaguguucggcgcuauauacggagcggcauuuaguggcguuagcuggacuaugaaaaucuugauuggggugaucauuaccuggaucggaaugaacuccagaucuacgagccugucaguaagucucguccuggugggcguugugacacuuuaucugggugucauggugcaggccgacuccggguguguagugagcuggaagaauaaagaauugaagugcggaucuggcauauucauuaccgauaacguucacacuuggacagagcaguacaaguuucagcccgaaucaccacccaaacucgcuagugccauccaaaaggcacaugaggaagguauuuguggcaucaggagcgucacccggcuggagaauuuaauguggaaacagauaacuccugagcugaaccacauccuauccgaaaaugaggugaagcucaccauuaugacaggggacaucaaaggaauuaugcaggccggcaagcgcucucugagaccacagccgacggaacuuaaauauucguggaagaccugggggaaggcuaaaauguugagcacugagucccauaaccaaacauuccugaucgauggacccgaaaccgccgagugcccuaauacaaacagggcauggaauucacucgagguggaagacuacggcuuuggugucuucaguacuaacauauggcugaaguuacgugagaaacaggacguuuuuugugauucuaagcugaugagcgcggcuauuaaagacaaucgggccgugcacgcagauaugggguauuggaucgaauccgcccuuaacgacaccuggaagauggagaaggcuucauucaucgaggugaaaagcugccacuggccaaagucucauacguugugguccaauggaguacucgaaagugagaugauuauccccaaaaacuucgccggcccugucagccagcacaacuaccgaccagguuaucauacacagaccgcaggccccuggcaccuggggaagcuagaaauggauuuugacuucugugagggaacuaccgugguugugacagaagauugcggcaauagagggccgucucugaggacuaccacagcuuccggaaaacucauuacggaguggugcugucgcucaugcacccugccuccacuucgguacagaggcgaggacgguuguugguacgggauggaaauaaggcccuugaaggagaaggaagagaaccuggucaauaguuuagugacugccggacauggccaaaucgauaacuuuagccucgguguucugggcauggcgcuuuuccuggaagagauguugcgcacacgaguggggaccaaacacgccauucuccugguagcugucucguuugugacucuaaucacaggaaauauguccuuccgggaccugggccgugugauggucaugguuggggcaaccaugacggaugacauuggaaugggcgugacuuaucucgcccugcuugcugccuuuaagguaagaccuaccuucgcagcggguuugcuguuaaggaaacucacaucuaaggagcugaugauggccaccaucgggauagcucuucugagccagucaacuauccccgaaacaauucuagagcucaccgaugcccuggcauugggaaugauggugcugaaaaucguccgcaacauggaaaaguaccaguuagcugugacaauuauggccaucaguugcguuccaaaugcagugauacuccaaaacgccuggaaggucuccuguacuauucuggcugcggugucuguuagcccucuucuguugaccuccucacagcagaaagccgacuggaucccccucgcacugacgaucaagggccuaaauccaacagcuauuuuucugaccacucuuagccggaccaguaaaaagagaucuuggccgcucaacgaggccgugauggccgucggcaugguauccauacuggcuagcucguugcugaaaaaugacaucccuaugacagggcccuuaguggcaggaggucuccugacuguuugcuaugugcuuaccggcaggucagccgaucuggaauuggagcgagcggcugacgucaagugggaggaucaggccgaaauuucugggaguuccccaauccucagcauuacgaucucugaggacggaagcauguccauaaaaaacgaagaggaggaacacacacugaccauccuaauucgcacuggccugcuugugaucucagguguauuccccgugaguauuccuaucacagcagccgcuugguaccucugggaggucaagaagcaacgggcagggguucugugggaugugccaagccccccuccggugggaaaagccgaauuggaggacggcgcguauagaauaaagcagaggggcauuuuuggguacucucagaucggagcuggugucuauaaagaaggcaccuuccauacuauguggcacgugacacguggggccguuuuaaugcaucgcggaaagcggaucgagccauccugggcagauguaaaaaaggaccugauuucauacggcgguggguggaagcucgagggagaauggaaagagggcgaagaggugcagguccuggcccuugaacccggcaagaauccuagagcugugcaaaccaaaccagggcuguuuaagacgaacacuggaaccaucggugccguuaguuuggauuucagccccggcacauccgggucuccuauaguggacaggaaaggaaaggucgugggccuauacgguaaugggguagucacccgaucgggagcauaugugagcgcuauugcccagacagagaagucaaucgaggauaacccggaaauugaggacgauaucuuccggaaaaagcgccugacuauaauggaccuccaccccggcgcgggcaaaaccaagagauaccugccagccauuguuagggaagcaaucaaacgggggcuucgaacguuaauccuggcuccuacaagaguggucgccgcugagauggaagaggcacuccgcggauugcccauuagguaucagacuccagccauccgugccgagcauaccggucgggaaauuguggaccugaugugucacgcuacauuuaccaugagacuccuguccccuguuagggugcccaacuacaaucuuauaaucauggaugaggcgcacuucacugacccagcaaguauugccgcucgcggcuauaucucuacccgagucgaaaugggggaggccgcaggaaucuuuaugacagccacgccgccuggcagcagagaucccuucccacaguccaacgcucccauuauggacgaggaacgggagauaccugaaaggucauggaauucuggucaugagugggugacugauuuuaaggggaagaccguaugguucgugccaagcaucaaagcgggaaacgacauugccgcaugccugcgcaagaauggcaaaaagguuauccaauugagucguaaaacauuugauuccgaauacgucaagaccagagcuaacgacugggauuucguggugacuacagacauuagcgagaugggcgccaauuuucgggcagagagggucaucgauccccgccgauguaugaagccuguaauacuaaccgacggggaagagagagugauccuggccggaccgaugccaguuacgcacucuucagcugcccagcggaggggucgcauuggcagaaaccccaaaaaugaaaacgaccaguauaucuacaugggggagccucucgaaaaugaugaggacugcgcgcauuggaaggaggcaaaaauguuacuggauaacauuaauacucccgaaggaaucauaccauccauguucgagccugaaagggagaagguggacgccauugauggcgaauaccggcuucguggugaggcucgcaaaacauuugucgaccugaugcgaagaggggaucuccccgugugguuggccuauaggguugcugcagagggcaucaacuacgccgaccggcgcugguguuucgauggaauuaagaauaaccaaauccuggaagagaacguggaagucgagauauggaccaaagagggcgaaagaaagaagcucaaaccaagguggcuggacgcucggaucuauagugauccucuugcccuaaaggaguucaaagaauuugcagcggggcgaaagagccugaccuugaauuuaauuacugagaugggaagacugccgacauucaugacccagaaagcccgcgacgcucucgauaaccuggccgugcuucacacagcagaaguagguggcagggcuuacaaucacgcccugucggagcuccccgagacuuuggaaacgcugcuacugcucacccuucuggcaacagugacugggggaaucuuuuuauucuugaugucuggcaaggguauugggaagaugacccugggcaugugcugcaucauaacagccuccauucuccugugguaugcucagauccagccacauuggaucgcggccagcauuauccuugaguuuuuccugauaguucucuugauuccugaacccgagaaacaacggaccccacaggacaaccagcugacuuacgucgugaucgcaauuuuaacgguggucgcugccaccauggccaaugaaaugggauuucuagagaagacaaaaaaggaccugggccucgggucaaucacuacccaggagccugaaaguaacauacuugauaucgaccugcgucccgcaucugcuuggacauuguaugccguugcgaccacuuucgugacaccgaugcugagacacuccauugagaauagcucaguaaacgugagucucacggcuaucgccaaucaagcaaccguccugaugggacuugguaggggcuggccacucagcaaaauggauauuggggugccucuguuggccaucggauguuacucccagguuaaccccauuacucugacagcugcauuacuacugcucguggcccauuacgcgaucauaggcccaggucuucaggcuaaggccacccgcgaagcacagaagcgggccgcugccgggauuaugaaaaaucccaccgucgacggcaucacaguaaucgaucuggagccuauuccguaugaccccaaguuugaaaaacaauugggacaggugaugcugcucguucugugcgugacucagguccuuaugaugcgaacgaccugggcauuaugugaggcucugacacucgccacuggcccaauaucuaccuugugggaggggaacccuggaagauucuggaauacaaccaucgcggugagcauggccaacauuuuuaggggcuccuaccuggcaggugcugggcuacuguucucaaucaugaagaauacuacgaacacacgccggggaaccggcaauauuggugaaacucucggcgagaaauggaagucuagacuuaacgcccuggggaagagugaauuucagaucuauaaaaagucgggaauacaagaggucgaucguaccuuggcaaaagagggcaucaagaggggggaaacagaccaccaugcugugagccggggauccgccaaacugcgcugguucguugagcgaaacauggugacucccgaaggcaagguaguggaucucgguugcgggagaggaggcuggucuuacuauugugguggccugaaaaaugucagggagguuaagggguuaaccaagggaggcccugggcacgaagagccaauucccaugucaacauacggauggaaccuugugcggcugcagagcggcgucgacguguucuuuacgccuccagagaaaugcgauacccuccuaugugacaucggugaauccagucccaauccgacuauugaggccgggcgcacacugagaguauugaaccugguggaaaauuggcucaacaauaacacccaguucugcaucaagguucuuaauccuuauaugccaucugugauagagaaaauggaaacucugcaaaggaaguacggaggcgcguugguccgaaacccccugagccggaauucaacacacgagauguacuggguguccaacgcuaccggcaauauugucaguagcgugaacaugaucucucguaugcucaucaauagauuuacgaugaaacauaagaaggcaaccuaugagccugauguugacuuaggguccggaacacgcaacguagguauugaaaacgagauaccaaaucuggacaucauuggcaaaaggaucgaaaagauuaaacaggagcacgaaacuucauggcauuacgaucaggaccaccccuauaagaccugggccuaccacgggagcuaugagacaaaacagacuggaucggcuucuaguauggugaacggcgucgugcggcuucugaccaagccgugggauguugugccuauggucacacaaauggccaugaccgacacuacgcccuucggucagcagagaguguuuaaggagaaaguagauacacgcacccaggaaccaaaggaggggacuaaaaagcuaaugaggaucaccgcagaauggcucuggaaagagcugggaaagaagaaaacaccucgaauguguacgcgggaggaauucaccagaaaggugagguccaaugccgcuuugggcgcgauauuuacugacgagaacaaauggaagagcgcccgcgaagcaguugaggauucacguuucugggaacuggucgaccgggagagaaaucuccaucuugagggcaaaugcgaaacauguguguacaacaugauggggaagagggagaaaaagcugggagaauuugguaaggcuaaaggcucccgcgccaucugguauaugugguuaggggcacgauuccuggaguuugaagccuugggauuccucaaugaggaucacugguuuucucggggcaacagccugagugguguggagggggaaggacuacauaagcuuggcuacauucugagagacgucuccaaaaaggagggcggggcuauguacgccgaugacaccgcgggaugggacacuaggaucacacucgaagaucugaaaaaugaggaaaugguuaccaaccacaugaagggugagcauaagaaauuggcagaggccauuuucaagcugacauaucaaaauaaagugguacgcgugcagagacccacuccacggggcaccgucauggacaucauuagcaggaaggaucagcgugggucuggacaggugggcacguacggucucaacaccuucacaaauauggaagcucaacuuauacgacagauggagggggaaggaaucuuuaaaucaauucagcgccugacuguuaccgaggagaucgccgugcaaaacugguuagcaagagucggccgggaaaggcugagucgcauggcuaucuccggcgacgauugcgugguaaagcccuuggacgauagauucgccagcgcucucacagcccugaaugacauggggaagguucggaaagauauucagcagugggagccuucuaggggauggaacgacuggacucaggugccauuuugcucgcaccacuuccaugaacuagucaugaaggauggucgagugcuuguggucccgugucguaaccaagacgagcugauaggcagagcacgcaucucacagggggcgggauggagccucaaagaaaccgccugccugggcaaguccuaugcucagauguggacguugauguacuuucaccggagggauuuaagacuggccgcaaaugcuauuuguagugccguucccucucauugggugccuacaagccgcaccacuugguccauccacgcaaaacacgaguggaugacaaccgaggacaugcucgccguauggaaccggguguggauucaggaaaauccauggauggaggacaagacucccgucgaaucaugggaggaagugccuuaucuugguaagagggaggaucaauggugcgggagucugaucggacuaaccucucgagcgacaugggcuaaaaacauacagacggccaucaaucagguuagaagccugauuggcaacgaggaauacaccgacuauaugccauccaugaagcgguucaggaaagaggaagaggaagcaggcgugcucugguga

SEQ ID NO: 14639 - RNA, 9876 nt, Artificial Sequence
  derived and/or modified CDS sequence (opt3) from DENV-2__EU529700__SS-prME
accgccggcgugaucauuaugcugauacccacagcuauggcauuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggauuauucggcaagggcgggauugucacaugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccugacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauucccaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcacuucugucacagaguacuauaccugaaacaauccuagagcucaccgaugcccuggcauugggaaugaugguccugaaaauugugcgcaacuuagaaaaguaccagcucgcuguuacaaucauggccauuuccugcgugcccaaugcagucauccugcaaaacgccuggaaggugucuuguacuauacuugcugcgguuagcguguccccacuguugcucaccucaagccagcagaaagccgacuggauuccucuggcacuaacgaucaagggccugaaucccacagcuaucuuucuuaccacucucagucggaccucuaaaaagagauccuggccacugaacgaggccgucauggccguaggcauggugagcauuuuggcuucgucacugcucaaaaaugacauaccgaugacagggccucuaguugcaggaggucugcuuacugugugcuauguccugaccggcaggucugccgauuuggaacucgagcgagcggcugacgugaagugggaggaucaggccgaaaucaguggguccagccccauucugucuaucacgauuagcgaggacggauccaugucaaucaaaaacgaagaggaggaacaaacacuaaccauacugauccgcacuggccuucucguaauuagugguguguucccagucagcauccccauuacagcagccgcuugguaccugugggagguuaagaagcagcgggcagggguguugugggaugugccuucuccacccccugucggaaaagccgaauuagaggacggcgcguauagaaucaagcagaggggcauauuuggguacucccagauuggagcugguguguauaaagaaggcaccuuccacacuauguggcauguuacacguggggccguacugaugcaccgcggaaagcggaucgagccgucaugggcagaugugaaaaaggaccucaucaguuacggcgguggguggaagcuggagggagaauggaaagagggcgaagagguccaagugcuugcccuggaaccaggcaagaaucccagagcuguucagaccaaaccuggguuguuuaagacgaacacuggaaccauuggugccgugagccuagauuucuccccaggcacaucugggucgcccaucgucgacaggaaaggaaaggugguaggccuguacgguaauggggucgugacccgaagcggagcauauguuucagcuauagcccagacagagaaguccauugaggauaacccugaaaucgaggacgauauuuuccggaaaaagcgccucacuaucauggaccugcauccgggcgcgggcaaaaccaagagauaccuucccgccauagugagggaagcaauuaaacggggguuacgaacgcugauccucgcuccaacaagagucguggccgcugagauggaagaggcauugcgcggacugccuaucagguaucagacucccgccauucgugccgagcacaccggucgggaaaucguugaccucaugugucaugcuacauuuaccaugagacugcuuaguccagugagggucccuaacuacaaucugauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccaaucaaacgcuccaaucauggacgaggaacgggagauucccgaaaggucuuggaauagcggucacgaguggguaacugauuuuaaggggaagaccgugugguucguuccuaguauaaaagcgggaaacgacaucgccgcaugcuugcgcaagaauggcaaaaaggucauucagcuaucccguaaaacauuugauagcgaauacgugaagaccagagcuaacgacugggauuucguggucacuacagacaucucugagaugggcgccaauuuucgggcagagaggguaauugauccacgccgauguaugaagcccgugauccugaccgacggggaagagagaguuauacucgccggaccuaugccggugacgcauucauccgcugcccagcggaggggucgcaucggcagaaaccccaaaaaugaaaacgaccaauauauuuacaugggggagcccuuagaaaaugaugaggacugcgcgcacuggaaggaggcaaaaaugcugcuugauaacaucaauacuccugaaggaauuauccccaguauguucgagccagaaagggagaaggucgacgccauagauggcgaauaccggcugcguggugaggcucgcaaaacauuuguggaccucaugcgaagaggggauuugccuguuuggcuggccuauaggguggcugcagagggcauuaacuacgccgaccggcgcugguguuucgauggaaucaagaauaaccagauucucgaagagaacgucgaaguggagaucuggaccaaagagggcgaaagaaagaagcugaaacccagguggcuugacgcucggauauauagcgauccacuagcccugaaggaguucaaagaauuugcagcggggcgaaagucguugaccuuaaaucugaucacugagaugggaagacucccuacauucaugacccagaaagcccgcgacgcucuggauaaccuugccguacugcauacagcagaaguggguggcagggcuuacaaucacgcccucucugaguugccggagacucuggaaacgcuacugcuccuuacccuguuagcaacaguuacugggggaauauuuuuguuccugauguccggcaaggguaucgggaagaugacccucggcaugugcugcauuaucacagccagcauacugcuuugguaugcucagauucaaccccacuggaucgcggccucaaucauucuggaguuuuuccucaucgucuugcugauaccagaaccugagaaacagcggaccccacaggacaaccaguuaacuuacguggugauugcaauccuaacggucguugcugccaccauggccaaugaaaugggauuucuggagaagaccaaaaaggaccucggccuugggaguauuacuacccaagagucugaauccaacauccuggauauagacuugcguccagcaagcgcuuggacacuguaugccguggcgaccacuuucguaacaccuaugcucagacauucaaucgagaauaguagcgugaacgucucccugacggcuauugccaaucaggcaaccgugcuuaugggacucgguaggggcuggccccugucuaaaauggauaucgggguuccguugcuggccauuggauguuacagccaggugaacccaaucacuuuaacagcugcacuacugcuccuugucgcccacuacgcgauuaucggcccuggucugcaggcuaaggccacccgcgaagcacaaaagcgggccgcugccgggauaaugaaaaaucccaccguagacggcauuacagugaucgauuuggagccaauccccuaugacccuaaguuugaaaaacagcugggacagguuaugcuccuggugcuuugcgucacucagguguuaaugaugcgaacgaccugggcacugugugaggcucucacauuggccacuggcccgauuuccacccugugggaggggaaccccggaagauucuggaauacaaccauagcggucucaauggccaacaucuuuaggggcucuuaccuagcuggugcugggcuacucuucaguauuaugaagaauacuacgaacacacgccggggaaccggcaauaucggugaaacucuuggcgagaaauggaagucgagacugaacgccuugggaaagagcgaauuucaaauuuauaaaaaguccggaauccaggagguggaucguacccuggcaaaagagggcauaaagagaggggaaacagaccaucacgcuguuucucggggaucagccaaacuccgcugguucguggagcgaaacaugguaacuccagaaggcaagguggucgaucuggguugcgggagaggaggcuggagcuacuauugugguggccuuaaaaauguuagggaggugaaggggcuaaccaagggaggcccugggcaugaggaaccaaucccuauguccacauacggauggaaccugguccggcuccagaguggcguggacguauucuuuacgccacccgagaaaugcgauacccuacugugugacauuggugaaucuagcccuaauccaacuaucgaggccgggcgcacauugagagugcugaaccucguugaaaauuggcuuaacaauaacacccaauucugcauuaaggugcugaaucccuauaugccgucagucaucgagaaaauggaaacuuugcagaggaaguacggaggcgcgcuggugcgaaacccucucucccggaauaguacacacgagauguacugggucagcaacgcuaccggcaauauagugucuuccguuaacaugauuucacguauguuaaucaauagauuuacgaugaaacacaagaaggcaaccuaugagccagauguagaccuggggagcggaacacgcaacaucgguauugaaaacgagauacccaaucuugacaucauuggcaaaaggaucgaaaagauuaaacaggagcaugaaacuucguggcacuacgaucaggaccauccuuauaagaccugggccuaccacgggucuuaugagacaaaacaaacuggaagugcuuccagcauggugaacggcgucgugcggcugcuaaccaagccaugggauguugugcccauggucacacagauggccaugaccgacacuacgccguucggucagcagagaguguuuaaggagaaaguagauacacgcacccaagaaccuaaggaggggacuaaaaagcucaugaggaucaccgcagaauggcuguggaaagaguugggaaagaagaaaacaccccgaauguguacgcgggaggaguucaccagaaaggugaggucaaaugccgcucugggcgcgauauuuacugacgagaacaaauggaaguccgcccgcgaagcaguugaggauucucguuucugggaacucgucgaccgggagagaaaucuucaccuggagggcaaaugcgaaacauguguguacaacaugauggggaagagggagaaaaaguuaggagaauuugguaaggcuaaaggcagccgcgccaucugguauauguggcugggggcacgauucuuggaguuugaagcccucggauuccugaaugaggaucauugguuuagucggggcaacucccuaagcgguguggagggggaaggacuucacaagcugggcuacauucucagagacgucucuaaaaaggagggcggggcuauguacgccgaugacaccgcgggaugggacacuaggaucacacuggaagauuugaaaaaugaggaaaugguuaccaaccauaugaagggugagcacaagaaacuggcagaggccauuuucaagcucacauaucagaauaaagugguacgcgugcagagaccaacuccucggggcaccgucauggacaucauuucaaggaaggaucagcgugggaguggacaagugggcacguacggucuuaacaccuucacaaauauggaagcucagcugauacgacagauggagggggaaggaaucuuuaaauccauucaacauuuaacuguuaccgaggagaucgccgugcagaacuggcuggcacgcgucggcagagaacgguugagcaggauggcuaucucuggcgacgauugcgugguaaagccccucgacgaucgcuucgccucggcucugacagcccuaaaugacauggggaagguuagaaaagauauucagcagugggagccaucacggggauggaacgacuggacucaagugcccuuuugcagccaccacuuccaugaacuugucaugaaggaugguagggugcugguggucccuugucgaaaccaggacgagcucauaggccgugcaagaaucucccagggggcgggauggagucugaaagaaaccgccugcuugggcaagucuuaugcucagauguggacguuaauguacuuucaccgccgggaucugaggcucgccgcaaaugcuauuuguagcgccguuccaucccauugggugccgacaucaagaaccacuuggaguauccacgcaaaacacgaguggaugacaaccgaggacaugcuugccguauggaaccgcguguggauucaagaaaaucccuggauggaggacaagacuccugucgaaucuugggaggaagugccauaucuggguaagcgggaggaucaguggugcgggagccuaaucggacugaccuccagggcgacaugggcuaaaaacauacagacggccaucaaucagguucgaucacucauuggcaacgaggaauacaccgacuauaugcccagcaugaagagauuccggaaagaggaagaggaagcaggcguguugugguga

SEQ ID NO: 14640 - RNA, 9876 nt, Artificial Sequence
  derived and/or modified CDS sequence (opt3) from DENV-2__EU529701__SS-prME
accgcaggagugaucauuaugcugauacccacagcuauggcauuccaccucacuacgcggaacggggagccucauaugaucgucggaaggcaggaaaaggguaaaagccuucuguuuaagaccgaggacggaguuaauaugugcacauugauggccauggauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggauugagaccuggauccugcggcauccuggcuucacaauaauggccgcaaucuuggccuacaccauuggcacgacucacuuucagcgcgcucucaucuucauucugcugacagcaguugccccauccaugaccaugagaugcaucgggauaucuaacagggauuuuguggaaggagucucggguggcucauggguggacauuguacucgagcacgggagcuguguuacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuucuaugcaagcauucuaugguggauagaggcugggguaacggguguggacucuucggcaagggcgggaucguaaccugcgccauguuuacaugcaaaaagaauauggaaggaaaaguggugcagccugagaaccuggaauacaccaucgucauuacuccacacagcggugaggagcaugcuguuggcaaugacacggggaagcacggaaaagaaauaaagaucacaccgcaguccucaauuaccgaggccgaacuuacuggcuaugguaccgugacaauggaguguagucccaggaccgggcuggauuucaacgaaaugguauugcuccaaauggaggacaaagcauggcuggugcaccggcagugguuuuuagaucugccucucccauggcuucccggcgcugacacucagggaagcaauuggauccagaaggagacacuggucacguucaagaacccucaugccaaaaagcaagacgugguuguguugggcucucaggaaggggcgaugcacaccgcccuaacuggagcaacagagauacagauguccucagguaaucugcucuuuaccggccaucugaaaugccgucuucgcauggauaagcugcaauugaaagggaugagcuacaguauguguacaggaaaguucaagauugucaaagaaaucgcugagacucagcacggcaccaucgugauuagaguacaguaugagggugacgggucuccaugcaagauccccuucgaaauuauggaucucgagaaaaggcauguucugggccgguuaauaacggugaacccgaucgucaccgaaaaggacuccccugugaacauugaggccgaacccccauuuggagauagcuacaucaucauuggcgucgagccugggcagcugaaacuaaauugguucaagaagggaucgucuauaggucaaauguuugagacaacuaugcgaggcgcuaaacgcauggccauccucggggacaccgcaugggauuucggaucccugggcgguguguuuacaucaguugggaaggcccuucaccagguguucggcgcuauuuacggagcggcauuuaguggcguaagcuggacuaugaaaaucuucauuggggucaucauaaccuggaucggaaugaacuccagaucuacgagcuugucagugagucugguucucgugggcgucgugacacuguaucuuggugccaugguacaggcugacuccgggugugugguuagcuggaagaauaaagaacugaagugcggaucuggcauuuuuaucaccgauaacguccacacuuggacagagcaguacaaguuccaacccgaaucaccaaguaaauuggccagcgcaauucagaaggcccaugaggaagguaucuguggcauaagguccgugacccggcucgagaaucugauguggaaacagauuacucccgaguuaaaccacauccugucugaaaaugaggugaagcuaaccauuaugacaggggacaucaaaggaauaaugcaggcuggcaagcgcucgcucagaccucaaccaacggaacugaaauauagcuggaagaccugggggaaggccaaaaugcuuuccacugagucacauaaccagacauuuuugaucgauggaccggaaaccgcagagugccccaauacaaacagggcguggaauagucuggaggucgaagacuacggcuucgguguuuuuacuaccaacauuuggcucaagcugcgugagaaacaggacguguucugugauucuaaguuaaugagcgcugccaucaaagacaaucgggcagugcacgccgauaugggguauuggauugaauccgcucugaacgacacguggaagauggagaaggccucauucaucgagguaaaaagcugccacuggccuaagucucauacacuuugguccaauggagucuuggaaagugagaugauaauucccaaaaauuuugcaggccccgugagccagcacaacuaccgaccugguuaucauacccaaacugcuggcccauggcaccucgggaagcuggaaauggauuucgacuuuugugagggaaccacaguuguggucacugaagauugcggcaauagagggcccucucuaaggaccacaacggccuccggaaaacugaucaccgaguggugcugucgcucaugcacucucccgccucugcgguacagaggcgaggacgguuguugguacgggauggaaaucaggccacuuaaggagaaggaagagaacuuggugaauagucugguuacagcgggacauggccagauugauaacuucagcuuaggugugcucggcauggcccuguuucuugaagagaugcugcgcacccgaguagggacuaaacacgcuaucuugcucgucgcagugucguucgugacacugauuaccggaaauauguccuuucgggaccuaggccgugucaugguuauggugggggccacgaugacugaugacauaggaaugggcguaaccuaucuggcucuccuggccgcauucaaggugagacccacauuugcggccggucuuuugcugaggaaauuaaccucuaaggagcucaugauggcuacuaucgggauugcccugcuuagccagucaacaaucccugaaaccauucuggagcuaacagaugcacucgcucugggaaugauggucuugaaaaucgugcgcaacauggaaaaguaccaacuggccguuacuauaauggcaaucaguugcgugcccaaugccgucauuuuacagaacgcuuggaagguguccuguaccauccucgcggccguuucugugagcccacugcuucugacguccucacagcagaaagcagacuggauuccuuuggcucucacaaucaagggccugaaucccaccgccauauuccuaacuacccugagccggacaaguaaaaagagaucuuggccacuuaacgaggccauuauggcugucggcaugguauccauccucgcaagcucgcuguugaaaaaugacaucccgaugacugggccucugguggccggagguuuacucaccguuugcuaugugcugacgggcaggucagcggaucuugaacuggagcgagcugccgacgucaagugggaggaucaagcagaaauuucugggaguucccccauauugagcaucacaauuucugaggacggaagcauguccaucaaaaacgaagaggaggaacagacccucacuauucugauccgcacaggccuacuggugauaucagguguauuuccagugaguauccccauuaccgccgcugcaugguaccuuugggaggucaagaagcagcgggccgggguucucugggaugugccuagcccacccccugugggaaaagcggaacuggaggacggcgcuuauagaaucaagcagaggggcauuuugggguacucucaaaucggagccggugucuauaaagaaggcacuuuccacacaauguggcaugugacccguggggcaguuuuaaugcaccgcggaaagcggauagagccguccugggccgaugucaaaaaggaccugauuucauacggcgguggguggaagcucgagggagaauggaaagagggcgaagaggugcagguccuggcucuugaaccaggcaagaaucccagagccgugcagacgaaaccugggcuguuuaagacuaacaccggaacaaucggugcaguuaguuuggauuucagcccaggcaccuccgggucucccaucguggacaggaaaggaaaggucgugggccuauacgguaaugggguagucacacgaucgggagcuuaugugagcgccauugcgcagacugagaagucaaucgaggauaacccugaaauagaggacgauauuuuccggaaaaagcgccugaccaucauggaccuccauccgggcgccggcaaaacgaagagauaccugcccgcaauuguuagggaagcuaucaaacgggggcuucgaacauuaauacuggccccaacuagaguggucgcugcagagauggaagaggcccuccgcggauugccuauuagguaucaaacccccgccauccgugcugagcacacaggucgggaaaucguggaccugaugugucaugcgaccuuuacuaugagacuccuguccccaguuagggugccuaacuacaaucuuauuaucauggaugaggcacacuucaccgaccccgccaguauugcugcccgcggcuauauaucuacacgagucgaaaugggggaggcagccggaaucuuuaugacggcuacuccaccgggcagcagagauccuuucccccaguccaacgcgccaauuauggacgaggaacgggagauccccgaaaggucauggaacucuggucacgagugggugaccgauuuuaaggggaagacaguaugguucgugccuagcaucaaagccggaaacgacauugcagcuugccugcgcaagaauggcaaaaagguuauacaguugagucguaaaaccuuugauuccgaauacgucaagacuagagccaacgacugggauuucguggugacaaccgacaucagcgagaugggcgcaaauuuuaaggccgagcgggucauugauccaaggcgcuguaugaaacccguaauccuaacggacggggaagaacgagugauucuggcuggaccuaugccgguuacucauucuucagccgcgcaaagacgggguaggaucggccgcaacccaaagaaugaaaacgaccaguauauauacaugggggagccccucgaaaaugaugaggacugcgcacacuggaaagaggccaagauguuacuggauaacaucaauacaccugaaggaauuauccccuccauguucgagccagaaagagagaaaguggacgcuauugauggcgaauacaggcuucggggugaggcccguaagaccuuugucgaccugaugcgccgaggggaucucccugugugguuggcuuauagaguugcagccgagggcaucaacuacgcugacaggcggugguguuucgauggaaucaaaaauaaccagauucuggaagagaacguggaagucgagaucuggaccaaggagggcgaacgcaagaaacucaagcccagauggcuggacgccaggauuuauagugauccacuugcacuaaaagaguucaaggaauuugcggccgggcggaaaagccugacuuugaauuuaaucacagagaugggacgacugccuaccuucaugacacagaaggcuagagacgcccucgauaaccuggcagugcuucauacugcugaagccgguggcaaggcauacaaucacgcccugucggagcucccggagacguuggaaacccugcuacugcucacacuucuggcuacuguaaccgggggaauauuuuuauucuugaugucuggcaaagguaucgggaagaugacacugggcaugugcugcauuaucaccgcguccauucuccugugguaugcccaaauccagccccacuggauagcagcuagcauuauccuugaguuuuuccugaucgugcucuugauuccagaaccugagaaacagcgcacuccccaggacaaccaacugacguacguugucaucgccauauuaaccgugguggccgcaacaauggcuaaugaaaugggauuucuagagaagacuaaaaaggaccugggccucgggucaauuaccacacaggagagugaaucuaacauccuugauauugaccugaggccagccuccgcguggaccuuguaugcugucgccacuacauucguuacgccuaugcugcggcauagcaucgaaaauucaagugugaacguaagccucaccgcaauagccaaucaggcuacugugcugaugggacuugguaagggcuggccccucuccaaaauggauaucggggucccgcuguuggcaauuggauguuacucucaggugaacccaaucacacugaccgccgcguuacuacugcucguugcucacuacgccauuaucggcccuggucuucaagcaaaggccacccgugaagcucagaaaagagccgcagcugggauuaugaagaaucccacaguggacggcaucacugucauagaucuggagccaauucccuaugacccuaaauuugaaaagcaguugggacagguaaugcugcucauccugugcgugacgcaaguucuuaugaugaggaccacaugggccuuaugugaggcgcugacucucgccaccggcccgaucagcacauugugggaggggaaccccggacgcuucuggaauaccacuauugcaguguccauggcuaacauauuucggggcucauaccuggccggugcagggcuacuguucucuaucaugaagaauacgacaaacacccgaagaggaacuggcaauauuggugaaacccucggcgagaaauggaagaguaggcuuaacgcucuggggaaaucggaauuucagaucuauaagaaaagcggcauucaggaggucgaucgcacauuggccaaggagggcaucaaaagaggggaaacugaccaucacgccguguccagaggaucugcgaagcugcguugguucgucgagaggaacauggugaccccagaaggcaagguuguggaucucgguugcgggcggggaggcuggucauacuauugugguggccugaaaaauguacgcgaggugaagggguuaacaaaaggaggcccugggcaugaagaaccaauaccuaugagcacguacggauggaaccuuguccgacugcaauccggcguugacguguucuuuaccccacccgagaagugcgauacucuccuaugugacaucggugaaaguucuccuaauccaacaauugaggcugggagaacccugagggucuugaaccugguggaaaauuggcucaacaauaacacucaguucugcaucaaaguacuuaaucccuauaugccgagcgugauugagaagauggaaacacugcagcggaaguacggaggcgcauugguucgcaacccucugucaagaaauuccacccacgagauguacugggugaguaacgccacgggcaauaucgucagcucugugaacaugauauccaggaugcucauuaaucgauuuaccaugaaacacaagaaagcuacauaugagccagaugucgacuuagggucaggaacucggaacaucgguaucgaaagcgagauucccaaccuggacauaaucggcaagcguauugagaaaauaaagcaggagcaugaaaccucguggcacuacgaucaagaccauccuuauaagacaugggccuaccacgggucuuaugagacuaaacagaccggaagugcauccagcauggugaauggcguuguaagacuucugacaaagccaugggaugugguccccauggugacccagauggccaugacugacacgacaccguucggucagcaacgcguuuuuaaagagaagguggauaccaggacucaggaaccuaaagaggggaccaagaagcuaaugaaaauuacagcugaauggcucuggaaggagcugggcaaaaagaaaacgccccggauguguaccagagaggaguucacucgcaaggucaggucaaacgcggccuugggcgcaaucuuuacagacgagaauaaauggaaguccgcucgagaagccguggaggauucucgguucugggaacugguagacagagagaggaaccuccaccuugagggcaagugcgaaaccuguguguacaauaugauggggaaacgcgagaagaaacugggagaauuugguaaggcaaaaggcagccgugccauaugguauaugugguuaggggcucgguuccuggaguuugaagccuugggauuccucaacgaggaucauugguuuaguagaggcaauucccugagcgguguugagggggaaggacuacacaggcuuggcuacauccugcgcgacgucucuaagaaggagggcggggcgauguacgcagaugacacugccggaugggacacacgaauuacccucgaagaucugaaaaacgaggaaauggugacaaaucauaugaagggugagcacaaaaaguuggcugaggccaucuucaaacugacuuaucagaacaaggugguccggguucagagaccaaccccuaggggcacggugauggacauuaucucacgcagagaucaacgggggaguggacagguaggcaccuacggucucaauacauucacuaacauggaagcacagcuuauuaggcaaauggagggggaaggaauauuuaaguccauccagcaucugaccgugacagaggagauugcuguccagaauugguuagcccgugugggccgagaacgccugagcagaauggcuaucucuggcgacgauugcguugugaaacccuuggacgaucgguucgccucggcacucacugcgcugaacgacauggggaaggucaggaaagauauccagcaaugggagccaucacgcggauggaaugacuggacccaggugcccuuuugcagccaccacuuccaugagcuaguaaugaaggaugguagaguucuuguggucccuugucggaaccaggacgagcugauuggcagggcccgaauaucccagggggcuggauggagucucaaagaaacggccugccugggcaagucuuaugcacaaauguggacauugauguacuuucaccguagagauuuacgccuggcugccaacgcaaucuguagcgccgugccaucccauugggugccgaccucacggacuacauggaguauucacgcgaagcacgaguggaugaccacugaggacaugcucgcugucuggaauaggguuuggauccaggaaaaccccuggauggaggacaaaaccccuguggaaucuugggaggaaguaccauaucuugguaagagagaggaucaguggugcgggagccugauuggacuaacaucccgcgccacgugggccaaaaauauccagaccgccauaaaccaagugcggucacugaucggcaaugaggaauacacugacuauaugcccagcaugaagagguuccgaagagaggaagaggaagcuggcguccucugguga

SEQ ID NO: 14641 - RNA, 9876 nt, Artificial Sequence
  derived and/or modified CDS sequence (opt3) from DENV-2__EU569704__SS-prME
accgccggcgugauaauuaugcugauacccacagcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuucuuugcaagcauucuaugguggauagaggcugggguaacggguguggacucuucggcaagggcgggaucguaaccugcgccauguuuacaugcaaaaagaauauggaaggaaaaguggugcugccugagaaccuugaauacaccauugucauaacuccacacagcggugaggagcaugcuguuggcaaugacacggggaagcacggaaaagaaaucaagauuacaccgcaguccucaaucaccgaggccgaacugacuggcuaugguaccgugacaauggaguguagucccaggaccggguuggauuucaacgaaaugguacuccugcagauggaggacaaagcaugguuagugcaccggcaaugguuucuggaucucccucuuccauggcugcccggcgcugacacucagggaagcaauuggauacagaaggagacauuggucacguucaagaacccucaugccaaaaagcaggacgugguugugcuaggcucucaagaaggggcgaugcacaccgcccugacuggagcaacagagauucagauguccucagguaaucuccuguuuaccggccaucuuaaaugccgucugcgcauggauaaguugcagcucaaagggaugagcuacaguauguguacaggaaaguucaagaucgucaaagaaaucgcugagacucaacacggcaccauugugaucagaguacaguaugagggugacgggucuccaugcaagauucccuucgaaauaauggaucuggagaaaaggcauguuuuaggccggcugaucacggugaacccgauugucaccgaaaaggacuccccugugaacaucgaggccgaacccccauuuggagauagcuacaucauuauaggcgucgagccugggcagcuaaaacucaauugguucaagaagggaucgucuaucggucagauguuugagacaacuaugcgaggcgcuaaacgcauggccauucugggggacaccgcaugggauuucggaucccuuggcgguguguuuacaucaaucgggaaggccuugcaccaaguuuucggcgcuauuuacggagcggcauuuaguggcgugagcuggacuaugaaaauccugauagggguaaucauuaccuggaucggaaugaacuccagaucuacgagccucucagucagucuggugcuuguuggcguggucacacuguauuugggugccauggugcaggcugacuccggguguguagugagcuggaagaauaaagaacucaagugcggaucuggcauuuucaucaccgauaacguucacacuuggacagagcaguacaaguuucagcccgaaucaccaaguaaacuggccagcgcaauacaaaaggcccaugaggaagguauuuguggcaucagguccgucacccgguuagagaaucugauguggaaacagauuacucccgagcuaaaccacauccucucugaaaaugaggugaagcugaccauaaugacaggggacaucaaaggaauuaugcaggcuggcaagcgcucgcuuagaccucagccaacggaauugaaauauagcuggaagaccugggggaaggccaaaaugcuguccacugagucacauaaccaaacauuccucaucgauggaccggaaaccgcagagugccccaauacaaacagggcguggaauagucuggagguggaagacuacggcuuuggugucuucacuaccaacauuugguuaaagcugcgugagaaacaggacguauuuugugauucuaaacuuaugagcgcugccaucaaagacaaucgggcagugcacgccgauaugggguauuggauagaauccgcuuugaacgacacguggaagauggagaaggccucauucauugaggugaaaagcugccacuggccuaagucucauacacucugguccaauggaguacuggaaagugagaugaucauccccaagaauuucgcaggccccgucagccagcacaacuaccgaccugguuaucauacccagacugcuggcccauggcaccuagggaagcuggaaauggauuuugacuucugugagggaaccacagugguugugacugaagauugcggcaauagagggcccucucucaggaccacaacggccuccggaaaacugauuaccgaguggugcugucgcucaugcacucuuccgccuuugcgguacagaggcgaggacgguuguugguacgggauggaaaucaggccacugaaggagaaggaagagaacuuagucaauagucucgugacagcgggacauggccaaauugauaacuuuagccuggguauacuuggcauggcccuguucuuggaagagaugcuccgcacccgaguugggacuaaacacgcuauccugcuaguggcaguaucguuugucacacugauuaccggaaauauguccuuccgggaccucggccgugugauggugauggucggggccacgaugacugaugacaucggaaugggcguuaccuaucuggcucuuuuggccgcauuuaaggugagacccacauucgcggccggucuguuacucaggaaacugaccucuaaggagcuuaugauggcuacuauugggaucgcccugcuaagccagucaacaauaccugaaaccauccucgagcugacagaugcauuggcucugggaaugaugguauuaaaaauugugcgcaacauggaaaaguaccagcucgccgucacuaucauggcaauuaguugcgugcccaaugccguuauccugcaaaacgcuuggaagguguccuguaccauacuugcggccgucucugugagcccacuguugcucacguccucacagcagaaagcagacuggauuccucuggcucuaacaaucaagggccugaaucccaccgccaucuuucuuacuacccucagccggacaaguaaaaagagaucuuggccacugaacgaggccauuauggcuguuggcaugguguccauauuggcaagcucgcugcuaaagaaugacaucccgaugacugggccucucgucgccggaggucugcuuaccguaugcuaugugcugacgggcaggucagcggauuuggaacucgagcgagcugccgacguuaagugggaggaucaggcagaaauuucugggaguucccccauccugagcauuacaaucucugaggacggaagcauguccaucaaaaacgaagaggaggaacaaacccuaacuauccugauucgcacaggccuucucgugaucucaggugucuucccagugaguauucccaucaccgccgcugcaugguaccugugggagguaaagaagcagcgggccgggguguugugggaugucccuagcccacccccuguuggaaaagcggaauuagaggacggcgcuuauagaauaaagcagaggggcauucugggguacucucagaucggagccgguguguauaaagaaggcacuuuucacacaauguggcaugugacccguggggcaguccucaugcaccgcggaaagcggaucgagccguccugggccgaugugaaaaaggaccugauuucauacggcgguggguggaaacuugagggagaauggaaagagggcgaagagguucaaguacuggcuuuggaaccaggcaagaaucccagagccgugcagacgaaaccugggcuauucaagacuaacaccggaacaaucggugcagucagucuggauuuuagcccaggcaccuccgggucucccauaguggacaggaaaggaaagguugugggccucuacgguaauggggucgugacacgaucgggagcuuauguaagcgccauugcgcagacugagaagucaaucgaggauaacccugaaauugaggacgauaucuuccggaaaaagcgccugaccauaauggaccuucauccgggcgccggcaaaacgaagagauacuuacccgcaauugucagggaagcuaucaaacgggggcugcgaacacucaucuuggccccaacuagagugguugcugcagagauggaagaggcccugcgcggacucccuauuagguaucagacccccgccauccgugcugagcacacaggucgggaaauuguggaccugaugugucaugcgaccuucacuaugagacuucuguccccagucagggugccuaacuacaauuugauaaucauggaugaggcacacuuuaccgaccccgccaguauugcugcccgcggcuauaucucuacacgaguugaaaugggggaggcagccggaaucuucaugacggcuacuccaccgggcagcagagauccuuuuccccaauccaacgcgccaauuauggacgaggaacgggagauacccgaaaggucauggaacucuggucacgagugggugaccgauuucaaggggaagacagucugguuugugccuagcaucaaagccggaaacgacauugcagcuugccuacgcaagaauggcaaaaagguaauccagcugagucguaaaaccuucgauuccgaauacgugaagacuagagccaacgacugggauuuuguugucacaaccgacauuagcgagaugggcgcaaauuucaaggccgagcgggugaucgauccaaggcgcuguaugaaacccgugauacucacggacggggaagaacgagucaucuuagcuggaccuaugccgguaacucauucuucagccgcgcagagacgggguaggauuggccgcaacccaaagaaugaaaacgaccaauauaucuacaugggggagccccuggaaaaugaugaggacugcgcacacuggaaagaggccaagaugcuucuggauaacauuaauacaccugaaggaaucauacccuccauguuugagccagaaagagagaaaguggacgcuauugauggcgaauacaggcuccggggugaggcccguaagaccuucguugacuugaugcgccgaggggaucugccuguguggcucgcuuauagagucgcagccgagggcaucaacuacgcugacaggcggugguguuuugauggaauuaaaaauaaccagauccuggaagagaacguggaaguugagauauggaccaaggagggcgaacgcaagaaacuuaagcccagauggcuagacgccaggaucuauagugauccacuggcauugaaagaguucaaggaguucgcggccgggcgaaagagcuuaacucugaaucucauuacagagaugggacggcugccuaccuuuaugacacagaaggcuagagacgcccuugauaaccuggcagugcuccauacugcugaagccgguggccgcgcauacaaucacgccuugucggagcugccggagacgcuagaaacccugcuccuucugacauuauuggcuacugucaccgggggaaucuuccuguuucucaugucuggcaaggguauugggaaaaugacacugggcaugugcugcaucauaaccgcguccauucuucugugguaugcccagauccaaccccacuggaucgcagcuagcauuauccucgaguucuuuuugauagugcuguuaauuccagaaccugagaagcagaggacuccccaggacaaccagcuaacguacguagugaucgccauucugaccguugucgccgcaacaauggcuaaugaaaugggauuccucgagaaaacuaagaaagaccuuggccuggggucaaucaccacacaagagagugaaucuaacauauuggauaucgaccugcggccagccuccgcguggacccucuaugcuguggccacuacauuugugacgccuaugcugcgucauagcauugaaaauucaagugucaacguuagccuuaccgcaaucgccaaucaggcuacugugcucaugggacuggguaagggcuggcccuuguccaagauggauauugggguaccgcuguuagcaaucggauguuacucucaggugaacccaauuacacuaaccgccgcgcugcuccuucuggucgcucacuacgccaucauaggcccugguuugcaggcaaaagccaccagagaagcucaaaagagggccgcagcugggauuaugaaaaaucccacaguggacggcaucacuguuaucgaucuggagccaauucccuaugacccuaaguucgaaaaacagcucggacaggugaugcugcuuauauuaugcgucacgcagguacugaugaugcgcaccacaugggcccucugugaggcguugacucuggccaccggcccgaucagcacacuaugggaggggaaccccggacgguuuuggaauaccacuauugcaguguccauggcuaacaucuuccgaggcucauaccuggccggugcagggcuccuauuuucuauuaugaagaauacgacaaacaccagaaggggaacuggcaauaucggugaaacccugggcgagaaguggaaaagucgcuugaacgcucuggggaagucggaguuccaaauauauaaaaagagcggaauccaggagguugaucggacacucgccaaagagggcauuaagagaggggaaacugaccaucacgccgugucccguggaucugcgaaacugaggugguuugucgagcggaacauggugaccccagaaggcaaggucguggauuuagguugcgggcgcggaggcuggucauacuauugugguggccuuaagaauguucgagaggugaaagggcugacaaagggaggcccugggcaugaagaaccaaucccuaugagcacguacggauggaaccucguaagacuacaguccggcguggacgucuucuucaccccacccgagaaaugcgauacucuguugugugacauuggugaaaguucuccuaauccaacaaucgaggcugggaggacccugcggguucucaaccuuguggaaaauuggcugaacaauaacacucaauuuugcauaaaggucuugaaucccuauaugccgagcgugauugagaaaauggaaacacugcagcgcaaguacggaggcgcacucguaagaaacccuuuaucaagaaauuccacccacgagauguacugggugaguaacgccacgggcaauaucguuagcucugugaacaugaucucccgaaugcugauuaaucgguucaccaugaagcacaaaaaggcuacauaugagccagaugucgaccuugggucaggaacucguaacauagguaucgaaagcgagauucccaaccuggacaucauuggcaaaagaaucgaaaagauaaaacaggagcaugaaaccucguggcacuacgaucaggaccauccuuauaagacaugggccuaccacgggucuuaugagacuaagcaaaccggaagugcauccagcauggugaauggcgucgugcgccuacucacaaaaccaugggauguuguacccauggugacccagauggccaugacugacacgacaccguuuggucagcagagggucuucaaggagaaaguggauacccggacucaagaaccuaaggaggggaccaaaaagcugaugaagaucacagcugaaugguuguggaaagagcugggaaagaaaaagacgcccagaauguguacccgcgaggaauuuacuaggaaaguucgaucaaacgcggcccucggcgcaauuuucacagacgagaauaaguggaaauccgcucgggaagccguggaggauucuagauuuugggaacuuaucgacagggagcgcaaccugcacuuagagggcaagugcgaaaccugugucuacaauaugauggggaagcgugagaaaaagcugggagaguucgguaaagcaaagggcagccgggccauuugguauaugugguugggggcuagauuucucgaguucgaagcccugggauuucuaaacgaggaucauugguucaguaggggcaauucccuuagcgguguggagggggaaggacugcaccgccucggcuacauccugcgagacguaucuaaaaaggagggcggggcgauguacgcagaugacacugccggaugggacacacggauuaccuuggaagaucugaagaacgaggaaauggugacaaaucauaugaaaggugagcacaagaaacucgcugaggccauauuuaaacuuacuuaucagaacaaaguugucagagugcagaggccaaccccucgcggcacggugauggacaucauuucaagacgggaucagagggggaguggacaagucggcaccuacggucugaauacauucacuaacauggaagcacaguuaauccgucagauggagggggaaggaaucuucaaguccauucaacaucugaccguuacagaggagauagcugugcagaauugguuggcccgaguaggccgcgaaagacucagccggauggcuaucucuggcgacgauugcguggucaagccccuggacgauagguuugccucggcacuaacugcgcuuaacgacauggggaaagugcgcaaggauauucagcagugggagccaucaagaggauggaaugacuggacccaaguucccuucugcagccaccacuuucaugaacuggugaugaaagauggucggguccucgugguaccuuguaggaaccaggacgagcugaucggccgagcccguauuucccagggggcuggauggaguuugaaggaaacggccugcuuaggcaaaucuuaugcacagauguggacacugauguacuuccacagacgcgaucuccggcuugcugccaacgcaaucuguagcgccguuccaucccauugggugccgaccucaaggacuacauggaguauacacgcgaagcacgaguggaugaccacugaggacaugcuggcugucuggaauagaguguggauccaagaaaaccccuggauggaggacaagaccccuguggaaucuugggaggaagucccauaucuagguaaacgcgaggaucaguggugcgggagccugauuggacucacaucccgggccacgugggcaaagaauauccagaccgccauuaaccagguuaggucauugaucggcaaugaggaauacacugacuauaugcccagcaugaaacgauuuagacgggaggaagaggaagcuggcgugcugugguga

SEQ ID NO: 14642 - RNA, 9876 nt, Artificial Sequence
  derived and/or modified CDS sequence (opt3) from DENV-2__EU482568__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuucuaugcaagcauucuaugguggauagaggcugggguaacggguguggacucuucggcaagggcgggaucgucaccugcgccauguuuacaugcaaaaagaauauggaaggaaaaguggugcugccugagaaccuugaauacaccauugucauaacuccacacagcggugaggagcaugcuguuggcaaugacacggggaagcacggaaaagaaaucaagauuacaccgcaguccucaaucaccgaggccgaacugacuggcuaugguaccgugacaauggaguguagucccaggaccggguuggauuucaacgaaaugguacuccugcagauggaggacaaagcaugguuagugcaccggcaaugguuucuggaucucccucuuccauggcugcccggcgcugacacucagggaagcaauuggauacagaaggagacauuggucacguucaagaacccucaugccaaaaagcaggacgugguugugcuaggcucucaagaaggggcgaugcacaccgcccugacuggagcaacagagauucagauguccucagguaaucuccuguuuaccggccaucuuaaaugccgucugcgcauggauaaguugcagcucaaagggaugagcuacaguauguguacaggaaaguucaagaucgucaaagaaaucgcugagacucaacacggcaccauugugaucagaguacaguaugagggugacgggucuccaugcaagauucccuucgaaauaauggaucuggagaaaaggcauguuuuaggccggcugaucacggugaacccgauugucaccgaaaaggacuccccugugaacaucgaggccgaacccccauuuggagauagcuacaucauuauaggcgucgagccugggcagcuaaaacucaauugguucaagaagggaucgucuaucggucagauguuugagacaacuaugcgaggcgcuaaacgcauggccauucugggggacaccgcaugggauuucggaucccuuggcgguguguuuacaucaaucgggaaggccuugcaccaaguuuucggcgcuauuuacggagcggcauuuaguggcgugagcuggacuaugaaaauccugauagggguaaucauuaccuggaucggaaugaacuccagaucuacgagccucucagucagucuggugcuuguuggcguggucacacuguauuugggugccauggugcaggcugacuccggguguguagugagcuggaagaauaaagaacucaagugcggaucuggcauuuucaucaccgauaacguucacacuuggacagagcaguacaaguuucagcccgaaucaccaaguaaacuggccagcgcaauacaaaaggcccaugaggaagguauuuguggcaucagguccgucacccgguuagagaaucugauguggaaacagauuacucccgagcuaaaccacauccucucugaaaaugaggugaagcugaccauaaugacaggggacauccgcggaauuaugcaggcuggcaaaagaucgcuuaggccucagccaacggaauugaaguauagcuggaaaaccugggggaaggccaagaugcuguccacugagucacauaaccaaacauuccucaucgauggaccggaaaccgcagagugccccaauacaaaccgugcguggaauagucuggagguggaagacuacggcuuuggugucuucacuaccaacauuugguuaaaacugcgggagaagcaggacguuuuuugugauucuaaacuuaugagcgcugccaucaaggacaaucgagcagugcacgccgauaugggguauuggauagaauccgcuuugaacgacacguggaaaauggagaaggccucauucauugaggugaagagcugccacuggccuaaaucucauacacucugguccaauggaguacuggaaagugagaugaucaucccaaagaacuucgcaggccccgucagccagcacaacuacagaccugguuaucauacccagacugcuggcccauggcaccuagggaaacuggaaauggauuuugacuucugugagggaaccacagugguugugacugaagauugcggcaauagggggcccucucuccgcaccacaacggccuccggaaagcugauuaccgaguggugcugucggucaugcacucuuccgccuuugagauacaggggcgaggacgguuguugguacgggauggaaauccgcccacugaaagagaaggaagagaacuuagucaauagucucgugacagcgggacauggccaaauugauaacuuuagccuggguauacuuggcauggcccuguucuuggaagagaugcuccgaacccggguugggacuaagcacgcuauccugcuaguggcaguaucguuugucacacugauuaccggaaauauguccuuccgugaccucggcagagugauggugauggucggggccacgaugacugaugacaucggaaugggcguuaccuaucuggcucuuuuggccgcauuuaaagugaggcccacauucgcggccggucuguuacuccgcaagcugaccucuaaagagcuuaugauggcuacuauugggaucgcccugcuaagccagucaacaauaccugaaaccauccucgagcugacagaugcauuggcucugggaaugaugguauuaaagauugugcggaacauggaaaaauaccagcucgccgucacuaucauggcaauuaguugcgugcccaaugccguuauccugcaaaacgcuuggaagguguccuguaccauacuugcggccgucucugugagcccacuguugcucacguccucacagcagaaggcagacuggauuccucuggcucuaacaaucaaaggccugaaucccaccgccaucuuucuuacuacccucagcagaacaaguaagaaaaggucuuggccacugaacgaggccauuauggcuguuggcaugguguccauauuggcaagcucgcuguuaaagaaugacaucccgaugacugggccucucgucgccggaggucugcuuaccguaugcuaugugcugacgggccgaucagcggauuuggaacucgagcgcgcugccgacguuaaaugggaggaucaggcagaaauuucugggaguucccccauccugagcauuacaaucucugaggacggaagcauguccauaaagaacgaagaggaggaacaaacccuaacuauccugauucggacaggccuucucgugaucucaggugucuucccagugaguauucccaucaccgccgcugcaugguaccugugggagguaaaaaagcagagagccgggguguugugggaugucccuagcccacccccuguugaaaaggcggaguuagaagacggagcuuauaggauaaaacagcguggcauucugggcuacucucagaucggggccggaguguauaaggaggguacuuuucacacaauguggcaugugacccgcggcgcaguccucaugcaccgggggaaaagaguggagccguccugggccgauguuaagaaagaccugaucucauacggaggcgguuggaagcuugaaggggaguggaaggaaggagaggaaguacaagugcuggcuuuggagccaggcaaaaaucccagggccguccagacgaagccuggccuauucaaaacuaacaccgggacaauuggagcagugagucuggauuuuagcccagguaccuccggcucucccaucguugaccgaaaggggaaaguggucggacucuacggcaauggugugguaacacggucgggggcuuaugucagcgccauagcgcagacugagaagucaauugaagauaacccugagaucgaagacgauauuuuccgcaagaaaagacugaccaucauggaccuucauccgggagccggcaagacgaaaagguacuuacccgcaauagugcgggaggcuauuaagcgaggccugagaacacucaucuuggccccaacucgcguuguggcugcagaaauggaggaggcccugagggggcucccuauccguuaucagacccccgccauucgggcugaacacacaggaagagagaucgucgaccugaugugucaugcgaccuucacuaugaggcuucuguccccagugcgcguuccuaacuacaauuugauuauaauggaugaagcacacuuuaccgaccccgccaguaucgcugcccgagguuauauuucuacaagaguggagaugggcgaggcagccgggaucuucaugacggcuacuccaccgggaagccgggauccuuuuccccaauccaacgcgccaaucauggacgaagagagggaaauucccgagcgcucauggaauucuggccacgaaugggucaccgauuucaaagguaagacagugugguuuguaccuagcauaaaggccgggaacgacaucgcagcuugccuacguaaaaauggaaagaaagugauucagcugaguagaaagaccuucgauuccgaguacguuaaaacucgggccaacgacugggauuuugucgugacaaccgacaucagcgagaugggcgcaaauuucaaggccgaaagggugauugauccacgccgauguaugaagcccgucauccucacggacggcgaggaaagaguaauauuagcugggccuaugccggugacucauucuucagccgcgcagcggaggggacgcaucgguagaaacccaaaaaaugagaacgaccaauauauuuacaugggcgaaccccuggagaaugaugaggacugcgcacacuggaaggaagccaaaaugcuucuggauaacaucaauacaccugaggggauuauccccuccauguuugaaccagagagggaaaagguugacgcuauagauggagaguaccggcuccguggcgaggcccgcaaaaccuucguggacuugaugcgaagaggugaucugccugucuggcucgcuuauaggguggcagccgaagggauuaacuacgcugaccggcgcugguguuuugauggcaucaagaauaaccagauucuggaggaaaacguugagguggagaucuggaccaaagaaggagagagaaagaagcuuaaacccagguggcuagacgcccggauauauagugauccacuggcauugaaggaauucaaagaguucgcggccggccgaaagagcuuaacucugaaucucaucacagaaauggggagacugccuaccuuuaugacacagaaagcucgcgacgcccuugauaaccuggcaguccuccauacugcugaggccggagguagggcauacaaucacgccuugucggagcugccggaaacgcuagagacccugcuccuucugacauuauuggcuacugugaccggcgggauuuuccuguuucucaugucuggaaagggcaucgguaagaugacacuggggaugugcugcauuaucaccgcguccauacuucugugguaugcccagauucaaccccacuggaucgcagcuagcaucauucucgaauucuuuuugaucguacuguuaauaccagagccugaaaaacagcggacuccccaggacaaccagcuaacguacgugguuauugccauccugaccgucguggccgcaacaauggcuaaugagaugggcuuccucgagaagacuaaaaaggaccuuggacugggcucaauuaccacacaagaaagugagucuaacaucuuggauauagaccugcguccagccuccgcguggacccucuaugcuguggccacuacauuugucacgccuaugcugagacauagcaucgaaaauucaaguguuaacgugagccuuaccgcaauugccaaucaggcuacuguacucauggggcugggaaaagguuggcccuuguccaagauggauaucggcgugccgcuguuagcaauuggguguuacucucaggucaacccaaucacacuaaccgccgcgcugcuccuucugguggcucacuacgccauuaucggaccuggcuugcaggcaaaggccaccagggaggcucaaaaacgcgccgcagcugguauaaugaagaaucccacaguugacgggauuacugugaucgaucuggaaccaauccccuaugacccuaaauucgagaagcagcucggccaggucaugcugcuuauuuuaugcguaacgcaggugcugaugaugcggaccacaugggcccucugugaggcguugacucuggccaccggaccgauaagcacacuaugggaaggcaaccccgggcgauuuuggaauaccacuaucgcaguuuccauggcuaacauuuucagaggaucauaccuggccggcgcaggucuccuuuuuucuaucaugaaaaauacgacaaacaccaggcgcgggacuggaaauauuggcgagacccugggugaaaaguggaagagucgguugaacgcucugggcaaaucggaguuccaaaucuauaagaaaagcgggauacaggagguggauagaacacucgccaaggaaggaaucaaacguggcgagacugaccaucacgccgucuccagggggucugcgaagcugcggugguuuguggaacgcaacauggucaccccagagggaaaagugguugauuuaggcugcggucgagggggauggucauacuauuguggcggucuuaagaaugugagagaaguaaagggccugacaaaagggggaccuggccaugaggagcccauuccuaugagcacguacggguggaaccucgugaggcuacaguccggagucgacguuuucuucaccccacccgaaaagugcgauacucuguugugugacaucggcgagaguucuccuaauccaacaauugaagcuggucggacccugcgcgugcucaaccuugucgagaauuggcugaacaauaacacucaauuuugcaucaaaguguugaaucccuauaugccgagcguaauagaaaagauggagacacugcagagaaaauacgggggagcacucgugaggaacccuuuaucacgaaauuccacccacgagauguacuggguuaguaacgccacgggcaauauugugagcucugucaacaugaucucccggaugcugaucaaucguuucaccaugaagcacaagaaagcuacauaugaaccagauguggaccuuggcucagggacuagaaacauuggaauagagagcgaaauccccaaccuggacauuaucgguaagcgcauugagaaaaucaagcaggaacaugagaccucguggcacuacgaucaggaccauccuuauaaaacaugggccuaccacggcucuuaugagacuaagcaaaccgggagugcauccagcauggucaauggagugguuaggcuacucacaaagccaugggauguagugcccauggucacccagauggccaugacugacacgacaccguuuggccagcagcggguguucaaagaaaagguugauaccagaacucaagagccuaaagaagguaccaagaaacugaugaagauaacagcugagugguuguggaaggagcuggggaaaaagaaaacgccccgcauguguaccagggaagaguuuacucgaaaggugcggucaaacgcggcccucggagcaaucuucacagacgaaaauaaauggaaguccgcuagagaggccgucgaagauucuagguuuugggagcuuauugaccgcgagcguaaccugcacuuagaaggcaaaugcgagaccuguguguacaauaugaugggcaagcgggaaaagaaacugggggaguucggaaaggcaaaagguagcagagccaucugguauaugugguugggcgcuagguuucucgaauucgaggcccugggguuucuaaacgaggaucauugguucagucgcggaaauucccuuagcggcguagaaggugaggggcugcaccgacucggauacauucugcgggacgugucuaagaaagaaggcggcgcgauguacgcagaugacacugccgggugggacacaagaaucaccuuggaggaucugaagaacgaagagaugguuacaaaucauaugaagggagagcacaaaaagcucgcugaagccauuuuuaaacuuacuuaucagaacaaggucgugagggugcagcgcccaaccccuagagguacggucauggacauaaucucacggagggaucagcguggcagugggcaaguuggaaccuacggccugaauacauucacuaacauggaggcacaguuaauucgacagauggaaggugaggggaucuucaaauccauccaacaucugaccgugacagaggaaauugcuguacagaauugguuggcccgcgugggaagagagcggcucagcaggauggcuauaucuggcgacgauugcgucgugaagccccuggacgaucgcuuugccucggcacuaacugcgcuuaacgacaugggcaagguuagaaaagauauccagcagugggaaccaucacggggguggaaugacuggacccaagugcccuucugcagccaccacuuucaugagcuggucaugaaggauggaagggugcucguaguuccuugucgaaaccaggacgaacugauuggucgugccagaaucucccagggcgcuggguggaguuugaaagagacggccugcuuaggaaagucuuaugcacagaugugggcucugauguacuuccaccgccgggaucucaggcuugccgcaaacgccauuuguagcgcggugccaucccauugggucccgacaucaagaaccacuuggaguauccacgcuaaacacgaguggaugacaaccgaagacaugcuggccguguggaaucgcguguggauacaagagaaccccuggauggaagacaagacuccugucgagucuugggaagagguuccauaucuaggcaagcgggaggaucaguggugcgguagccugaucgggcucaccuccagggcaacaugggccaaaaauauucagacggcuaucaaccaggugcgaucauugauuggaaaugaagaguacaccgacuauaugcccagcaugaagagauuucggagggaagaggaagaggccggcguacugugguga

SEQ ID NO: 14643 - RNA, 9876 nt, Artificial Sequence
  derived and/or modified CDS sequence (opt3) from DENV-2__EU482569__SS-prME
accgccggcgugaucauuaugcugauacccacagcuauggcauuccaccucacuacgagaaacggggagccucauaugaucguaggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccgaaaaggacuccccugucaacaucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaccaaguguucggcgcuauuuacggagcggcauuuaguggcguaagcuggacuaugaaaaucuugauaggggucaucauuaccuggaucggaaugaacuccagaucuacgagccugucagugagucucguucuggugggcgucgugacacuuuaucugggugccaugguacaggcugacuccgggugugugguuagcuggaagaauaaagaauugaagugcggaucuggcauuuucaucaccgauaacguccacacuuggacagagcaguacaaguuucagcccgaaucaccaaguaaacucgccagcgcaauacaaaaggcccaugaggaagguauuuguggcaucagguccgugacccggcuggagaauuuaauguggaaacagauuacucccgagcugaaccacauccuaucugaaaaugaggugaagcucaccauaaugacaggggacaucaaaggaauuaugcaggcuggcaagcgcucgcugagaccucagccaacggaacuuaaauauagcuggaagaccugggggaaggccaaaauguuguccacugagucacauaaccaaacauuccugaucgauggaccggaaaccgcagagugccccaauacaaacagggcguggaauagucucgaggucgaagacuacggcuuugguguuuucacuaccaacauuuggcugaaguuacgugagaaacaggacguguuuugugauucuaagcugaugagcgcugccaucaaagacaaucgggcagugcacgccgauaugggguauuggauagaauccgcucuuaacgacacguggaagauggagaaggccucauucauugagguaaaaagcugccacuggccuaagucucauacauugugguccaauggaguccucgaaagugagaugaucauccccaaaaauuucgcaggccccgugagccagcacaacuaccgaccugguuaucauacccagacugcuggcccauggcaccuggggaagcuagaaauggauuuugacuucugugagggaaccacaguuguggucacugaagauugcggcaauagagggcccucucugaggaccacaacggccuccggaaaacucauuaccgaguggugcugucgcucaugcacucugccgccucuucgguacagaggcgaggacgguuguugguacgggauggaaaucaggccauugaaggagaaggaagagaaccuggugaauaguuuaguuacagcgggacauggccaaauugauaacuuuagccucggugugcugggcauggcccuuuuccuggaagagauguugcgcacccgaguagggacuaaacacgcuauacuccuggucgcagugucguuugugacacuaaucaccggaaauauguccuuccgggaccugggccgugucaugguuauggugggggccacgaugacugaugacauuggaaugggcguaaccuaucucgcucugcuugccgcauuuaaggugagacccacauucgcggccgguuugcuguuaaggaaacucaccucuaaggagcugaugauggcuacuaucgggauugcccuucugagccagucaacaaucccugaaaccauacuagagcucacagaugcacuggcuuugggaaugaugguccugaaaaucgugcgcaacauggaaaaguaccaguuagccguuacuauuauggcaaucaguugcgugcccaaugccgucauucuccaaaacgcuuggaagguguccuguaccauccuggcggccguuucugugagcccacuucuguugacguccucacagcagaaagcagacuggauaccucucgcucugacaauuaagggccuaaaucccaccgccaucuuucugacuacccuuagccggacaaguaaaaagagaucuuggccacucaacgaggccaucauggcugucggcaugguauccauucuggcaagcucguugcugaaaaaugacauaccgaugacugggccuuuaguggccggaggucuccugaccguuugcuaugugcuuacgggcaggucagcggaucuggaauuggagcgagcugccgacgucaagugggaggaucaggcagaaaucucugggaguucccccauucucagcaucacaauuucugaggacggaagcauguccaucaaaaacgaagaggaggaacaaacccugacuauacuaauccgcacaggccugcuugugauuucagguguauucccagugaguauccccauuaccgccgcugcaugguaccucugggaggucaagaagcagcgggccgggguucugugggaugugccuagcccacccccugugggaaaagcggaauuggaggacggcgcuuauagaaucaagcagaggggcauauuaggguacucucagauuggagccggugucuauaaagaaggcacuuuucacacaauguggcaugugacccguggggcaguucugaugcaccgcggaaagcggaucgagccguccugggccgaugucaagaaagaccucaucucauacggcgguggguggaaacuggagggagaauggaaagagggcgaagaggugcaaguccuugcucuggaaccaggcaagaaucccagagccgugcagacgaaaccuggguuguucaagacuaacaccggaacaauuggugcaguuagucuagauuuuagcccaggcaccuccgggucucccaucguggacaggaaaggaaaggucgugggccuguacgguaaugggguagucacacgaucgggagcuuaugugagcgccauagcgcagacugagaagucaauugaggauaacccugaaaucgaggacgauauuuuccggaaaaagcgccucaccaucauggaccugcauccgggcgccggcaaaacgaagagauaccuucccgcaauaguuagggaagcuauuaaacggggguuacgaacacugauccucgccccaacuagaguggucgcugcagagauggaagaggccuugcgcggacugccuaucagguaucagacccccgccauucgugcugagcacacaggucgggaaaucguggaccucaugugucaugcgaccuucacuaugagacugcuuuccccaguuagggugccuaacuacaaucugauuauaauggaugaggcacacuuuaccgaccccgccaguaucgcugcccgcggcuauauuucuacacgagucgaaaugggggaggcagccggaaucuucaugacggcuacuccaccgggcagcagagauccuuuuccccaauccaacgcgccaaucauggacgaggaacgggagauucccgaaaggucauggaacucuggucacgagugggugaccgauuucaaggggaagacaguaugguuugugccuagcauaaaagccggaaacgacaucgcagcuugcuugcgcaagaauggcaaaaagguuauucagcuaagucguaaaaccuucgauuccgaauacgucaagacuagagccaacgacugggauuuuguggugacaaccgacaucagcgagaugggcgcaaauuucaaggccgagcgggucauugauccaaggcgcuguaugaaacccguaauccugacggacggggaagaacgagugauacucgcuggaccuaugccgguuacucauucuucagccgcgcagagacgggguaggaucggccgcaacccaaagaaugaaaacgaccaauauauuuacaugggggagcccuuagaaaaugaugaggacugcgcacacuggaaagaggccaagaugcugcuugauaacaucaauacaccugaaggaauuauccccuccauguuugagccagaaagagagaaaguggacgcuauagauggcgaauacaggcugcggggugaggcccguaagaccuucgucgaccucaugcgccgaggggauuugccuguguggcuggcuuauagaguugcagccgagggcauuaacuacgcugacaggcggugguguuuugauggaaucaaaaauaaccagauucucgaagagaacguggaagucgagaucuggaccaaggagggcgaacgcaagaaacugaagcccagauggcuugacgccaggauauauagugauccacuagcacugaaagaguucaaggaguucgcggccgggcgaaagagcuugacuuuaaaucugaucacagagaugggacggcucccuaccuuuaugacacagaaggcuagagacgcccuggauaaccuugcagugcugcauacugcugaagccgguggccgcgcauacaaucacgcccucucggaguugccggagacgcuggaaacccuacugcuccuuacacuguuagcuacuguaaccgggggaauuuucuuguuucugaugucuggcaaggguaucgggaaaaugacacucggcaugugcugcauuaucaccgcguccauacugcuuugguaugcccagauucaaccccacuggaucgcagcuagcaucauucuggaguucuuucucaucguguugcugauaccagaaccugagaagcagaggacuccccaggacaaccaguuaacguacguugucauugccauccuaaccgugguggccgcaacaauggcuaaugaaaugggauuccuggagaaaacuaagaaagaccucggccuugggucaauuaccacacaagagagugaaucuaacauccuggauauagacuugcggccagccuccgcguggacccuguaugcugucgccacuacauuuguuacgccuaugcuccgucauagcaucgaaaauucaagugugaacguaagccugaccgcaauugccaaucaggcuacugugcuuaugggacucgguaagggcuggccccuguccaagauggauaucggggucccguugcuggcaauuggauguuacucucaggugaacccaaucacauuaaccgccgcgcuacugcuccuuguugcucacuacgccauuaucggcccuggucugcaggcaaaagccaccagagaagcucaaaagagggccgcagcugggauaaugaaaaaucccacaguggacggcauuacugucaucgauuuggagccaauccccuaugacccuaaguucgaaaaacagcugggacagguaaugcuccugauucuuugcgugacgcagguuuuaaugaugcgcaccacaugggcccugugugaggcgcucacuuuggccaccggcccgauaagcacacugugggaggggaaccccggacgguuuuggaauaccacuaucgcaguguccauggcuaacauuuuccgaggcucauaccuagccggugcagggcugcucuuuucuaucaugaagaauacgacaaacaccagaaggggaacuggcaauauuggugaaacccuuggcgagaaguggaaaagucgccugaacgcuuuggggaagaacgaguuccaaaucuauaaaaagucgggaauacaggaggucgaucggacacuggccaaagagggcaucaagagaggggaaacugaccaucacgccgugagccguggauccgcgaaacucaggugguuugucgagcggaauauggugauuccagaaggcaagguuguggaucuggguugcgggcgcggaggcuggucuuacuauugugguggcuuaaagaacguacgagaggugaaagggcuuaccaagggaggcccugggcaugaagaaccaaucccuaugucaacauacggauggaaucuggucagacuccagagcggcguugacguguucuucacgccacccgagaaaugcgauacccuacugugugacauuggugaauccaguccuaacccaacuaucgaggcugggaggacauugcggguccugaaucucguggaaaacuggcuuaauaacaauacccaauuuugcauaaagguacugaaccccuauaugccgucugugauugagaaaauggaaacuuugcagcgcaaguacggaggcgcacugguuagaaauccucucagcaggaacucaacacacgagauguacuggguguccaaugccaccggcaacaucgucaguagcgugaauaugaucucucgaauguuaauuaaccgguucacgaugaagcacaaaaaggcuaccuaugagccagaugucgaccugggguccggaacacguaacauagguaucgaaucagagauucccaaucuugacaucauuggcaaaagaaucgaaaagauaaaacaggagcaugaaacuagcuggcacuacgaucaggaccauccuuauaagaccugggccuaccacgggucguaugagacaaagcaaacuggaucugcaaguuccauggugaacggcguuguacgccugcuaaccaaaccaugggaugugguccccauggugacacagauggccaugaccgacacuacgccguuuggucagcagaggguuuucaaggagaaaguggauacacggacccaagaaccuaaggaggggacuaaaaagcucaugaagaucaccgcugaauggcuguggaaagaguugggaaagaaaaagacacccagaauguguacgcgcgaggaauuuaccaggaaaguccgaagcaaugcggcccugggcgcaauuuucacugacgagaacaaguggaaaucagcucgggaagccguggaggauuccagauuuugggaacucaucgacagggagcgcaaucuucaccuggagggcaagugcgaaacauguguauacaacaugauggggaagcgugagaaaaaguuaggagaguucgguaaagcaaagggcucucgggccauuugguauauguggcugggggcuagauuuuuggaguucgaagcccucggauuucugaaugaggaucauugguucagcaggggcaacagucuauccgguguggagggggaaggacuucaccgccugggcuacauccuccgagacguuagcaaaaaggagggcggggcgauguacgcagaugacaccgccggaugggacacucggauuacacuggaagauuugaagaaugaggaaauggucaccaaccauaugaaaggugagcacaagaaacuggcugaggccauauuuaagcucacauaucagaauaaaguggugagaguccagaggccaacuccucgcggcaccguuauggacaucauuucuagacgggaucagagggggucaggacaagugggcacguacggucuuaacaccuucacaaauauggaagcacagcugauccgucagauggagggggaaggaaucuucaagaguauucaacauuuaacuguaaccgaggagauagcugugcagaacuggcuggcccgagucggccgcgaaagauugucccggauggcuaucagcggcgacgauugcgugguuaagccccucgacgauagguuugccucugcacugacagcgcuaaaugacauggggaaagugcgcaaggauauucagcagugggagccaucgagaggauggaacgacuggacucaaguccccuucugcucacaccacuuucaugaacuugugaugaaagauggucggguacugguugugccuuguaggaaccaggacgagcucaucggccgagcccguauuagccagggggcuggauggucccugaaggaaaccgccugcuugggcaaaaguuaugcacagauguggacguuaauguacuuccacagacgcgaucugcggcucgcugccaaugcaaucuguucugccgucccaagccauugggugccgacauccaggaccacuuggucaauacacgcgaagcacgaguggaugacaaccgaggacaugcuugcuguguggaacagagucuggauccaagaaaaucccuggauggaggacaagacuccuguugaaaguugggaggaagugccauaucuggguaaacgcgaggaucaguggugcgggucucuaauuggacugaccagccgggccacaugggcaaagaacauccagacggccauuaaucagguaaggucccucaucggcaacgaggaauacaccgacuauaugcccucaaugaaacgauuuagacgggaggaagaggaagcuggcguguugugguga

SEQ ID NO: 14644 - RNA, 9876 nt, Artificial Sequence
  derived and/or modified CDS sequence (opt3) from DENV-2__EU482570__SS-prME
accgccggcgugaucauuaugcugauacccacagcuauggcauuccaccucacuacgcggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuucuaugcaagcauucuaugguggauagaggcugggguaacggguguggacucuucggcaagggcgggaucguaaccugcgccauguuuacaugcaaaaagaauauggaaggaaaaguggugcagccugagaaccuggaauacaccauugucauaacuccacacagcggugaggagcaugcuguuggcaaugacacggggaagcacggaaaagaaaucaagauuacaccgcaguccucaaucaccgaggccgaacuuacuggcuaugguaccgugacaauggaguguagucccaggaccgggcuggauuucaacgaaaugguauugcuccaaauggaggacaaagcauggcuggugcaccggcagugguuuuuagaucugccucucccauggcuucccggcgcugacacucagggaagcaauuggauacagaaggagacacuggucacguucaagaacccucaugccaaaaagcaagacgugguuguguugggcucucaggaaggggcgaugcacaccgcccuaacuggagcaacagagauucagauguccucagguaaucugcucuuuaccggccaucugaaaugccgucuucgcauggauaagcugcaauugaaagggaugagcuacaguauguguacaggaaaguucaagaucgucaaagaaaucgcugagacucagcacggcaccauugugaucagaguacaguaugagggugacgggucuccaugcaagauucccuucgaaauaauggaucucgagaaaaggcauguucugggccgguuaaucacggugaacccgauugucaccgaaaaggacuccccugugaacaucgaggccgaacccccauuuggagauagcuacaucauuauaggcgucgagccugggcagcugaaacuaaauugguucaagaagggaucgucuaucggucaaauguuugagacaacuaugcgaggcgcuaaacgcauggccauucucggggacaccgcaugggauuucggaucccugggcgguguguuuacaucaaucgggaaggcccuucaccagguuuucggcgcuauuuacggagcggcauuuaguggcgugagcuggacuaugaaaaucuugauagggguaaucauuaccuggaucggaaugaacuccagaucuacgagccugucagucagucucgugcugguuggcguggucacacuuuaucugggugccauggugcaggcugacuccggguguguagugagcuggaagaauaaagaauugaagugcggaucuggcauuuucaucaccgauaacguucacacuuggacagagcaguacaaguuucaacccgaaucaccaaguaaacucgccagcgcaauacagaaggcccaugaggaagguauuuguggcaucagguccgucacccggcuggagaauuuaauguggaaacaggugacucccgagcugaaccacauucuaucugaaaaugaggugaagcucaccaucaugacaggggacauaaaaggaaucaugcaggcuggcaagcgcucgcugagaccucaaccaacggaacuuaaauauagcuggaagaccugggggaaggccaaaauguuguccacugagucacauaaccagacauuccugauugauggaccggaaaccgcagagugccccaauacaaacagggcguggaauagucucgaggucgaagacuacggcuuugguguuuucacuaccaacaucuggcugaaguuacgugagaaacaggacguguuuugugauucuaagcugaugagcgcugccauuaaagacaaucgggcagugcacgccgauaugggguauuggaucgaauccgcucuuaacgacacguggaagauggagaaggccucauucauagagguaaaaagcugccacuggccuaagucucauacauugugguccaauggaguccucgaaagugagaugauuauccccaaaaauuucgcaggccccgugagccagcacaacuaccgaccugguuaucauacccaaacugcuggcccauggcaccuggggaagcuagaaauggauuuugacuucugugagggaaccacaguuguggucacugaagauugcggcaauagagggcccucucugaggaccacaacggccuccggaaaacucaucaccgaguggugcugucgcucaugcacucugccgccucuucgguacagaggcgaggacgguuguugguacgggauggaaauuaggccauugaaggagaaggaagagaaccuggugaauaguuuaguuacagcgggacauggccagaucgauaacuuuagccucggugugcugggcauggcccuuuuccuggaagagauguugcgcacccgaguagggacuaaacacgcuauucuccuggucgcagugucguuugugacacuaauaaccggaaauauguccuuccgggaccugggccgugucaugguuauggugggggccacgaugacugaugacaucggaaugggcguaaccuaucucgcucugcuugccgcauuuaaggugagacccacauucgcggccgguuugcuguuaaggaaacucaccucuaaggagcugaugauggcuacuauugggaucgcccuucugagccagucaacaauuccugaaaccauccuagagcucacagaugcacuggcuuugggaaugaugguccugaaaauagugcgcaacauggaaaaguaccaauuagccguuacuaucauggcaauuaguugcgugcccaaugccgucauccuccagaacgcuuggaaggugggcuguaccauucuggcggccguuuccgugucuccacuucuguugacgagcucccagcagaaagcagacuggaucccucucgcucugacaauaaagggccuaaaucccaccgccauuuuucugacuacccuuucacggacaagcaaaaagagaaguuggccacucaacgaggccaucauggcugucgggaugguaucuauccuggcauccagcuugcugaaaaaugacauuccgaugacuggaccuuuaguggccgguggccuccugaccguuugcuaugugcuuacggggaggucggcggaucuggaauuggagcgagcugccgacgucaagugggaggaucaagcagaaauaucaggaucuagucccauccucuccauuacaaucagcgaggacggcucuaugagcauuaaaaacgaagaggaggaacagacccugacuauccuaauacgcacaggucugcuugugaucuccgggguauucccagugucaauucccaucaccgccgcugcaugguaccucugggaggucaagaagcagcgggccggaguucugugggaugugccuaguccacccccugugggcaaagcggaauuggaggacggcgcuuauagaauuaagcagagggggaucuuaggauacagccaaauaggugccggcgucuauaaagaagggacuuuucacacaauguggcaugugacccguggagcaguucugaugcaccgcggcaagcggauugagccgucuugggccgaugucaaaaaggaccucaucuccuacggugggggauggaagcuggagggcgaauggaaagagggcgaagaggugcagguccuugcucuggaaccagggaagaaucccagagccgugcagacgaaaccuggauuguucaagacuaacaccgguacaaucggcgcaguuucacuagauuuuaguccagggaccagcggaucccccauuguggacaggaaaggcaaggucgugggucuguacgggaauggaguagucacacgaucuggcgcuuaugugucggccaucgcgcagacugaaaagagcauagaggauaacccugaaauugaggacgauaucuuccggaaaaagcgccucaccauuauggaccugcauccgggcgccgggaaaacgaagagauaccuucccgcaaucguuagggaagcuauaaaacggggauuacgaacacugauucucgccccaacuagaguggucgcugcagagauggaagaggccuugcgcggucugccuaucagguaucaaacccccgccauccgugcugagcacacaggccgggaaauuguggaccucaugugucaugcgaccuucacuaugagacugcuuucaccaguuagggugccuaacuacaaucugaucauuauggaugaggcacacuuuaccgaccccgccuccauagcugcccgcggguauaucaguacacgagucgaaaugggagaggcagccggcauuuucaugacggcuacuccaccggguucuagagauccuuuuccccagagcaacgcgccaaucauggacgaggaacgggagauccccgaaagguccuggaacucagggcacgagugggugaccgauuucaagggaaagacaguaugguuugugccuucuauuaaagccggcaacgacauagcagcuugcuugcgcaagaauggcaaaaagguuauccagcuaagccguaaaaccuucgauagugaauacgucaagacuagagccaacgacugggauuuuguggugacaaccgacauuuccgagaugggggcaaauuucaaggccgagcgggucaucgauccaaggcgcuguaugaaacccguaauucugacggacggagaagaacgagugauccucgcugguccuaugccgguuacucauagcucugccgcgcaaagacggggcaggauagggcgcaacccaaagaaugaaaacgaccaguauaucuacaugggagagcccuuagaaaaugaugaggacugcgcacacuggaaagaggccaagaugcugcuugauaacauuaauacaccugaaggcaucauucccucaauguuugagccagaaagagagaaaguggacgcuaucgauggugaauacaggcugagaggggaagcccguaagaccuucgucgaccucaugcgccgaggcgauuugccuguguggcuggcuuauagaguugcagccgagggaauaaacuacgcugacaggcggugguguuuugauggcauuaaaaauaaccagauccucgaagagaacguggaagucgagauuuggaccaaggagggggaacgcaagaaacugaagcccagauggcuugacgccaggaucuauuccgauccacuagcacugaaagaguucaaggaguucgcggccggacggaaaaguuugacuuuaaaucugauaacagagaugggucgacucccuaccuuuaugacacagaaggcuagagacgcccuggauaaccuugcagugcugcauacugcugaagccggcgggaaggcauacaaucacgcccucagcgaguugccggagacgcuggaaacccuacugcuccuuacacuguuagcuacuguaaccggaggcaucuucuuguuucugaugucggguaaagggauuggcaagaugacacucggaaugugcugcaucauuaccgcgucuauccugcuuugguaugcccaaauacagccccacuggauugcagcuuccaucauccuggaguucuuucucauuguguugcugaucccagaaccugagaaacagcgcacuccccaggacaaccaauuaacguacguugucauagccauucuaaccgugguggccgcaacaauggcuaaugaaaugggcuuccuggagaagacuaaaaaggaccucgggcuuggaagcaucaccacacaggagucagaaaguaacauucuggauaucgacuugaggccagccucugcguggacccuguaugcugucgccacuacauuuguuacgccuaugcuccggcauuccauagagaauagcucagugaacguaagucugaccgcaaucgccaaucaggcuacugugcuuaugggucucggcaagggguggccccugagcaaaauggauauuggagucccguugcuggcaaucggcuguuacucccaggugaacccaauuacauuaaccgccgcgcuacugcuccuuguugcucacuacgccaucauugguccugggcugcaagcaaaggccacccgugaagcucagaaaagagccgcagcuggcaucaugaagaaucccacaguggacggaauaacugucauugauuuggagccaauccccuaugacccuaaauucgaaaagcagcugggccagguaaugcuccugauccuuugcgugacgcaaguuuuaaugaugaggaccacaugggcccugugugaggcgcucacuuuggccaccgggccgauuucuacacugugggagggaaaccccggccgcuuuuggaauaccacuauagcagugagcauggcuaacaucuuccgggguuccuaccuagccggggcaggacugcucuuuucaauuaugaagaauacgacaaacacccgaagaggcacugguaauaucggcgaaacccuuggggagaaauggaagucuaggcugaacgcuuugggaaaaagugaguuccagauuuauaagaaaucgggcauccaggaggucgaucgcacacuggccaaggaggggauaaaacggggagaaacugaccaucacgccgugagcagaggcuccgcgaagcuccguugguuugucgagaggaacauggugaccccagaagguaagguuguggaucuggggugcggacggggcgguuggucuuacuauuguggcgggcuuaaaaauguacgcgaggugaagggacuaacaaaaggcgggccuggacaugaggaaccaaucccuaugucaacguacggcuggaaccugguccgacuccaaagcgguguugacguguucuucaccccacccgagaagugcgauacucuacugugugacauuggggaauccaguccuaauccaacaaucgaggcuggaagaaccuugaggguccugaaccucguggaaaauuggcuuaacaauaacacucaguuuugcauuaaaguacugaaucccuauaugccgucugugaucgagaagauggaaacauugcagcggaaguacggcggcgcacugguucgcaacccucucagcagaaauucaacccacgagauguacuggguguccaacgccacggggaauauagucaguagcgugaacaugauuucuaggauguuaaucaaucgauucaccaugaaacacaagaaagcuacauaugagccagaugucgaccugggauccgguacucggaacaucggcauugaaucagagauacccaaccuugacaucauugggaagcguaucgagaaaauuaagcaggagcaugaaaccagcuggcacuacgaucaagaccauccuuauaagacaugggccuaccacggaucguaugagacuaaacagaccggcucugcaaguuccauggugaaugguguuguaagacugcuaacaaagccaugggaugugguccccauggugacccagauggccaugacugacacgacaccguuugggcagcaacgcguuuucaaagagaagguggauaccaggacucaggaaccuaaagagggaaccaagaagcucaugaaaaucacagcugaauggcuguggaaggaguugggcaaaaagaaaacgccccggauguguaccagagaggaauuuacucgcaaggucaggagcaacgcggcccugggcgcaauauucacagacgagaauaaauggaagucagcucgagaagccguggaggauucccgguuuugggaacucguagacagagagaggaaccuucaccuggaggggaagugcgaaaccuguguguacaauaugaugggaaaacgcgagaagaaauuaggugaguucggcaaggcaaaagggucucgugccaucugguauauguggcugggagcucgguuuuuggaguucgaagcccucggcuuucugaacgaggaucauugguucagcagagguaauagucuauccgggguugagggagaaggccuucacaggcugggcuacauucucaaggacgucagcaagaaagaagggggagcgauguacgcagaugacacugccgguugggacacacgcaucacccuggaagauuugaagaacgaggaaauggugacaaaucauaugaaaggcgagcacaagaaacuggcugaggccauuuuuaagcucacuuaucagaacaaggugguccgaguucagcggccaaccccuagagggacggugauggacaucauuucuaggcgcgaucaaagaggaucaggccagguagguaccuacgggcuuaauacauucacuaacauggaagcacagcugauacggcaaauggagggagaaggcaucuucaaaaguauucagcauuuaaccgugacagaggagaucgcuguccagaauuggcuggccagggugggccgugaacgauugucccgcaugguuaucagcggggacgauugcguggucaagccccucgacgauagauuugcuucugcccugacugcacuaaacgacaugggaaaagugcggaaggauauucagcaaugggagccaucgagggguuggaaugacuggacccagguacccuucugcucacaccacuuucaugaacuuguuaugaaagauggccgcgugcuggucgugccuuguagaaaccaggacgagcucauagggcgggcgaggaucagccagggagccggcuggucccugaaggaaacggcuugcuuggguaagaguuaugcccaaauguggacauuaauguacuuccaccgacgugaucugagacucgcagcuaacgccauuuguucugcagugccaagccauugggucccgaccucccgcacuacauggucaauccacgccaaacacgaguggaugaccacugaggacaugcuugcgguuuggaaucggguguggauucaggaaaaccccuggauggaggacaagaccccuguagaaaguugggaggaagugccauaucuggggaaaagggaggaucaguggugcggaucucuaaucggccugacaagcagagcuacgugggccaagaauauacagaccgcaaucaaccaaguccgcucccucauuggcaaugaggaauacacugacuauaugcccucaaugaaacgguuuaggcgagaggaagaggaagccgggguguugugguga

SEQ ID NO: 14645 - RNA, 9876 nt, Artificial Sequence
  derived and/or modified CDS sequence (opt3) from DENV-2__EU482571__SS-prME
accgccggcgugaucauuaugcugauacccacggcuauggcauuccaccucacuacgaggaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuucuuugcaagcauucuaugguggauagaggcugggguaacggguguggacucuucggcaagggcgggaucguaaccugcgccauguuuacaugcaaaaagaauauggaaggaaaaguggugcugccugagaaccuugaauacaccauugucauaacuccacacagcggugaggagcaugcuguuggcaaugacacggggaagcacggaaaagaaaucaagauuacaccgcaguccucaaucaccgaggccgaacugacuggcuaugguaccgugacaauggaguguagucccaggaccggguuggauuucaacgaaaugguacuccugcagauggaggacaaagcaugguuagugcaccggcaaugguuucuggaucucccucuuccauggcugcccggcgcugacacucagggaagcaauuggauacagaaggagacauuggucacguucaagaacccucaugccaaaaagcaggacgugguugugcuaggcucucaagaaggggcgaugcacaccgcccugacuggagcaacagagauucagauguccucagguaaucuccuguuuaccggccaucuuaaaugccgucugcgcauggauaaguugcagcucaaagggaugagcuacaguauguguacaggaaaguucaagaucgucaaagaaaucgcugagacucaacacggcaccauugugaucagaguacaguaugagggugacgggucuccaugcaagauucccuucgaaauaauggaucuggagaaaaggcauguuuuaggccggcugaucacggugaacccgauugucaccgaaaaggacuccccugugaacaucgaggccgaacccccauuuggagauagcuacaucauuauaggcgucgagccugggcagcuaaaacucaauugguucaagaagggaucgucuaucggucagauguuugagacaacuaugcgaggcgcuaaacgcauggccauucugggggacaccgcaugggauuucggaucccuuggcgguguguuuacaucaaucgggaaggccuugcaccaaguuuucggcgcuauuuacggagcggcauuuaguggcgugagcuggacuaugaaaauccugauagggguaaucauuaccuggaucggaaugaacuccagaucuacgagccucucagucagucuggugcuuguuggcguggucacacuguauuugggugccauggugcaggcugacuccggguguguagugagcuggaagaauaaagaacucaagugcggaucuggcauuuucaucaccgauaacguucacacuuggacagagcaguacaaguuucagcccgaaucaccaaguaaacuggccagcgcaauacaaaaggcccaugaggaagguauuuguggcaucagguccgucacccgguuagagaaucugauguggaaacagauuacucccgagcuaaaccacauccucucugaaaaugaggugaagcugaccauaaugacaggggacaucaaaggaauuaugcaggcuggcaagcgcucgcuuagaccucagccaacggaauugaaauauagcuggaagaccugggggaaggccaaaaugcuguccacugagucacauaaccaaacauuccucaucgauggaccggaaaccgcagagugccccaauacaaacagggcguggaauagucuggagguggaagacuacggcuuuggugucuucacuaccaacauuugguuaaagcugcgugagaaacaggacguauuuugugauucuaaacuuaugagcgcugccaucaaagacaaucgggcagugcacgccgauaugggguauuggauagaauccgcuuugaacgacacguggaagauggagaaggccucauucauugaggugaaaagcugccacuggccuaagucucauacacucugguccaauggaguacuggaaagugagaugaucauccccaagaauuucgcaggccccgucagccagcacaacuaccgaccugguuaucauacccagacugcuggcccauggcaccuagggaagcuggaaauggauuuugacuucugugagggaaccacagugguugugacugaagauugcggcaauagagggcccucucucaggaccacaacggccuccggaaaacugauuaccgaguggugcugucgcucaugcacucuuccgccuuugcgguacagaggcgaggacgguuguugguacgggauggaaaucaggccacugaaggagaaggaagagaacuuagucaauagucucgugacagcgggacauggccaaauugauaacuuuagccuggguguucuuggcauggcccuguucuuggaagagaugcuccgcacccgaguggggacuaaacacgcuauacugcuaguagcagucucguuugugacacugaucaccggaaauauguccuuccgggaccucggccgugugauggucaugguuggggccacgaugacugaugacauuggaaugggcgugaccuaucuggcucuuuuggccgcauuuaagguaagacccacauucgcggccggucuguuacucaggaaacugaccucuaaggagcuuaugauggcuacuaucgggauugcccugcuaagccagucaacaaucccugaaaccauacucgagcugacagaugcauuggcucugggaaugaugguguuaaaaaucguccgcaacauggaaaaguaccagcucgccgugacuauuauggcaaucaguugcguucccaaugccgugauucugcaaaacgcuuggaaggucuccuguaccauccuugcggccgugucuguuagcccacuguugcucacguccucacagcagaaagcagacuggauaccucuggcucuaacaauuaagggccugaaucccaccgccaucuuucuuacuacccucagccggacaaguaaaaagagaucuuggccacugaacgaggccaucauggcugugggcauggucuccauuuuggcaagcucgcugcuaaagaaugacauaccgaugacugggccucucguagccggaggucugcuuaccgugugcuauguucugacgggcaggucagcggauuuggaacucgagcgagcugccgacgugaagugggaggaucaggcagaaaucucugggaguucccccauucugagcaucacaauuucugaggacggaagcauguccaucaaaaacgaagaggaggaacaaacccuaacuauacugauccgcacaggccuucucgucauuucagguguguucccaguaaguauccccauuaccgccgcugcaugguaccugugggaggugaagaagcagcgggccggggucuugugggauguuccuagcccacccccugugggaaaagcggaauuagaggacggcgcuuauagaaucaagcagaggggcauacugggguacucucagauuggagccgguguguauaaagaaggcacuuuucacacaauguggcaugucacccguggggcagugcucaugcaccgcggaaagcggaucgagccguccugggccgauguuaaaaaggaccugaucucauacggcgguggguggaaacuugagggagaauggaaagagggcgaagagguacaagugcuggcuuuggaaccaggcaagaaucccagagccguccagacgaaaccugggcuauucaagacuaacaccggaacaauuggugcagugagucuggauuuuagcccaggcaccuccgggucucccaucguugacaggaaaggaaagguggucggccucuacgguaauggggugguaacacgaucgggagcuuaugucagcgccauagcgcagacugagaagucaauugaggauaacccugaaaucgaggacgauauuuuccggaaaaagcgccugaccaucauggaccuucauccgggcgccggcaaaacgaagagauacuuacccgcaauagugagggaagcuauuaaacgggggcugcgaacacucaucuuggccccaacuagaguuguggcugcagagauggaagaggcccugcgcggacucccuaucagguaucagacccccgccauucgugcugagcacacaggucgggaaaucgucgaccugaugugucaugcgaccuucacuaugagacuucuguccccagugaggguuccuaacuacaauuugauuauaauggaugaggcacacuuuaccgaccccgccaguaucgcugcccgcggcuauauuucuacacgaguggaaaugggggaggcagccggaaucuucaugacggcuacuccaccgggcagcagagauccuuuuccccaauccaacgcgccaaucauggacgaggaacgggagauucccgaaaggucauggaacucuggucacgagugggucaccgauuucaaggggaagacagugugguuuguaccuagcauaaaagccggaaacgacaucgcagcuugccuacgcaagaauggcaaaaaggugauucagcugagucguaaaaccuucgauuccgaauacguuaagacuagagccaacgacugggauuuugucgugacaaccgacaucagcgagaugggcgcaaauuucaaggccgagcgggugauugauccaaggcgcuguaugaaacccgucauccucacggacggggaagaacgaguaauauuagcuggaccuaugccggugacucauucuucagccgcgcagagacgggguaggaucggccgcaacccaaagaaugaaaacgaccaauauauuuacaugggggagccccuggaaaaugaugaggacugcgcacacuggaaagaggccaagaugcuucuggauaacaucaauacaccugaaggaauuauccccuccauguuugagccagaaagagagaaaguugacgcuauagauggcgaauacaggcuccggggugaggcccguaagaccuucguggacuugaugcgccgaggggaucugccugucuggcucgcuuauagaguggcagccgagggcauuaacuacgcugacaggcggugguguuuugauggaaucaaaaauaaccagauucuggaagagaacguugaaguggagaucuggaccaaggagggcgaacgcaagaaacuuaagcccagauggcuagacgccaggauauauagugauccacuggcauugaaagaguucaaggaguucgcggccgggcgaaagagcuuaacucugaaucucaucacagagaugggacggcugccuaccuuuaugacacagaaggcuagagacgcccuugauaaccuggcaguccuccauacugcugaagccgguggccgcgcauacaaucacgccuugucggagcugccggagacgcuagaaacccugcuccuucugacauuauuggcuacugugaccgggggaauuuuccuguuucucaugucuggcaaggguaucgggaaaaugacacugggcaugugcugcauuaucaccgcguccauacuucugugguaugcccagauucaaccccacuggaucgcagcuagcaucauucucgaguucuuuuugaucguacuguuaauaccagaaccugagaagcagaggacuccccaggacaaccagcuaacguacgugguuauugccauccugaccgucguggccgcaacaauggcuaaugaaaugggauuccucgagaaaacuaagaaagaccuuggccuggggucaauuaccacacaagagagugaaucuaacaucuuggauauagaccugcggccagccuccgcguggacccucuaugcuguggccacuacauuugucacgccuaugcugcgucauagcaucgaaaauucaaguguuaacgugagccuuaccgcaauugccaaucaggcuacuguacucaugggacuggguaagggcuggcccuuguccaagauggauaucggggugccgcuguuagcaauuggauguuacucucaggucaacccaaucacacuaaccgccgcgcugcuccuucugguggcucacuacgccauuaucggcccugguuugcaggcaaaagccaccagagaagcucaaaagagggccgcagcugggauaaugaaaaaucccacaguugacggcauuacugugaucgaucuggagccaauccccuaugacccuaaguucgaaaaacagcucggacaggucaugcugcuuauuuuaugcguaacacaggugcugaugaugcgcaccacaugggcccucugugaggcguugacucuggccaccggcccgauaagcacacuaugggaggggaaccccggacgguuuuggaauaccacuaucgcaguuuccauggcuaacauuuuccgaggcucauaccuggccggugcagggcuccuauuuucuaucaugaagaauacgacaaacaccagaaggggaacuggcaauauuggugaaacccugggcgagaaguggaaaagucgcuugaacgcucuggggaagucggaguuccaaaucuauaaaaagagcggaauacaggagguggaucggacacucgccaaagagggcaucaagagaggggaaacugaccaucacgccgucucccguggaucugcgaaacugaggugguuuguggagcggaacauggucaccccagaaggcaaggugguugauuuagguugcgggcgcggaggcuggucauacuauugugguggccuuaagaaugugcgagagguaaaagggcugacaaagggaggcccugggcaugaagaaccaauuccuaugagcacguacggauggaaccucgugagacuacaguccggcgucgacguuuucuucaccccacccgagaaaugcgauacucuguugugugacaucggugaaaguucuccuaauccaacaauugaggcugggaggacccugcgggugcucaaccuugucgaaaauuggcugaacaauaacacucaauuuugcaucaagguguugaaucccuauaugccgagcguaauagagaaaauggaaacacugcagcgcaaguacggaggcgcacucgugagaaacccuuuaucaagaaauuccacccacgagauguacuggguuaguaacgccacgggcaauauugugagcucugucaacaugaucucccgaaugcugaucaaucgguucaccaugaagcacaaaaaggcuacauaugagccagauguggaccuugggucaggaacucguaacauugguauagaaagcgagauccccaaccuggacauuaucggcaaaagaauugaaaagaucaaacaggagcaugaaaccucguggcacuacgaucaggaccauccuuauaagacaugggccuaccacgggucuuaugagacuaagcaaaccggaagugcauccagcauggucaauggcgugguucgccuacucacaaaaccaugggauguagugcccauggucacccagauggccaugacugacacgacaccguuuggucagcagaggguguucaaggagaaaguugauacccggacucaagaaccuaaggaggggaccaaaaagcugaugaagauaacagcugcgugguuguggaaagaacugggaaagaaaaagacgcccagaauguguacccgcgaggaguuuacuaggaaagugcgaucaaacgccgcacucggcgcuaucuucacagacgaaaauaaguggaaauccgcccgggaggcagucgaagauucuagauuuugggagcuuauugacagggaacgcaaccugcacuuagagggcaagugcgagaccuguguguacaauaugauggggaagcgugagaagaaacugggagaguucgguaaagccaagggcagccgggcuaucugguauaugugguugggggccagauuucucgaguucgaggcgcugggauuucuaaacgaagaucauugguucaguaggggcaauucccuuagcgguguagagggggagggacugcaccgccucggcuacauucugcgagacgugucuaaaaaggaaggcggggcaauguacgccgaugacacugcuggaugggacacacggaucaccuuggaggaucugaagaacgaagagaugguuacaaaucauaugaaaggugaacacaagaaacucgccgaggcaauuuuuaaacuuacuuaucagaacaaagucgugagagugcagaggccaaccccucgcggcacggucauggacauaaucucaagacgggaucagagggggaguggacaaguuggcaccuacggucugaauacauucacuaacauggaggcucaguuaauucgucagauggaaggggagggaaucuucaaguccauccaacaucugaccgugacagaagagauugccguacagaauugguuggcucgagugggccgcgagagacucagccggauggccauaucuggcgacgauugcgucgugaagccccuggacgauagguuugcaucggcgcuaacugcccuuaacgacauggggaaaguucgcaaggauauccagcagugggaaccaucaagaggauggaaugacuggacccaagugcccuucugcagccaccacuuucaugagcuggucaugaaagauggucgggugcucguaguuccuuguaggaaccaggacgaacugauuggccgagcucguaucucccagggggccggauggaguuugaaggagacggcaugcuuaggcaaaucuuaugcucagauguggacacugauguacuuccacagacgcgaucuccggcuugccgcaaacgccauuuguagcgcggugccaucccauugggucccgaccucaaggacuacauggaguauccacgcuaagcacgaauggaugaccacugaggacaugcuggccguguggaauagaguguggauacaagagaaccccuggauggaagacaagaccccugucgagucuugggaagagguuccauaucuagguaaacgcgaagaucaguggugcgggagccugaucggacucacaucccgggcaacgugggccaagaauauucagaccgcuaucaaccaggugaggucauugauuggcaaugaggaguacacugacuauaugcccagcaugaaacgauuuagacgggaagaggaagaggccggcguacugugguga

SEQ ID NO: 14646 - RNA, 9876 nt, Artificial Sequence
  derived and/or modified CDS sequence (opt3) from DENV-2__EU482572__SS-prME
accgcaggcgugaucauuaugcugauaccaacagcuauggcauuccaccucacuacgcggaacggggaaccucauaugaucgucggaaggcaggaaaaagguaaaagccuucuguuuaagaccgaagacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuucuaugcaagcauucuaugguggauagaggcugggguaacggguguggacucuucggcaagggcgggaucguaaccugcgccauguuuacaugcaaaaagaauauggaaggaaaaguggugcagccugagaaccuggaauacaccauugucauaacuccacacagcggugaggagcaugcuguuggcaaugacacggggaagcacggaaaagaaaucaagauuacaccgcaguccucaaucaccgaggccgaacuuacuggcuaugguaccgugacaauggaguguagucccaggaccgggcuggauuucaacgaaaugguauugcuccaaauggaggacaaagcauggcuggugcaccggcagugguuuuuagaucugccucucccauggcuucccggcgcugacacucagggaagcaauuggauacagaaggagacacuggucacguucaagaacccucaugccaaaaagcaagacgugguuguguugggcucucaggaaggggcgaugcacaccgcccuaacuggagcaacagagauucagauguccucagguaaucugcucuuuaccggccaucugaaaugccgucuucgcauggauaagcugcaauugaaagggaugagcuacaguauguguacaggaaaguucaagaucgucaaagaaaucgcugagacucagcacggcaccauugugaucagaguacaguaugagggugacgggucuccaugcaagauucccuucgaaauaauggaucucgagaaaaggcauguucugggccgguuaaucacggugaacccgauugucaccgaaaaggacuccccugugaacaucgaggccgaacccccauuuggagauagcuacaucauuauaggcgucgagccugggcagcugaaacuaaauugguucaagaagggaucgucuaucggucaaauguuugagacaacuaugcgaggcgcuaaacgcauggccauucucggggacaccgcaugggauuucggaucccugggcgguguguuuacaucaaucgggaaggcccuucaccagguuuucggcgcuauuuacggagcggcauuuaguggcgugagcuggacuaugaaaaucuugauagggguaaucauuaccuggaucggaaugaacuccagaucuacgagccugucagucagucucgugcugguuggcguggucacacuuuaucugggugccauggugcaggcugacuccggguguguagugagcuggaagaauaaagaauugaagugcggaucuggcauuuucaucaccgauaacguucacacuuggacagagcaguacaaguuucaacccgaaucaccaaguaaacucgccagcgcaauacagaaggcccaugaggaagguauuuguggcaucagguccgucacccggcuggagaauuuaauguggaaacaggugacucccgagcugaaccacauucuaucugaaaaugaggugaagcucaccaucaugacaggggacauaaaaggaaucaugcaggcuggcaagcgcucgcugagaccucaaccaacggaacuuaaauauagcuggaagaccugggggaaggccaaaauguuguccacugagucacauaaccagacauuccugauugauggaccggaaaccgcagagugccccaauacaaacagggcguggaauagucucgaggucgaagacuacggcuuugguguuuucacuaccaacaucuggcugaaguuacgugagaaacaggacguguuuugugauucuaagcugaugagcgcugccauuaaagacaaucgggcagugcacgccgauaugggguauuggaucgaauccgcucuuaacgacacguggaagauggagaaggccucauucauagagguaaaaagcugccacuggccuaagucucauacauugugguccaauggaguccucgaaagugagaugauuauccccaaaaauuucgcaggccccgugagccagcacaacuaccgaccugguuaucauacccaaacugcuggcccauggcaccuggggaagcuagaaauggauuuugacuucugugagggaaccacaguuguggucacuggcgauugcgggaauagaggacccucucugaggaccacaacggccuccggcaaacucaucaccgaauggugcugucgcucaugcacucugccgccucuucgguacagaggugaggacggguguugguacggaauggagauuaggccauugaaggaaaaggaggaaaaccuggugaauaguuuaguuacagcgggccauggucagaucgauaacuuuagccucggcgugcuggggauggcccuuuuccuggaggaaauguugcgcacccgaguaggaacuaaacacgcuauucuccuggucgcagugucguuugugacacuaauaaccggcaauauguccuuccgggaccuggggcgugucaugguuauggugggagccacgaugacugaugacaucggcauggguguaaccuaucucgcucugcuugccgcauuuaaggugagacccacauucgcggccggguugcuguuaaggaaacucaccucuaaggagcugaugauggcuacuauuggaaucgcccuucugagccagucaacaauuccugagaccauccuagaacucacagaugcacuggcuuugggcaugaugguccugaaaauagugcgcaacauggagaaguaccaauuagccguuacuaucauggcaauuaguugcgugcccaaugccgucauccuccagaacgcuuggaagguguccuguaccauucuggcgguugugucugucagcccacuucuguugacguccucacagcagaaagccgacuggaucccucucgcacugacaauaaagggccuaaaucccaccgcuauuuuucugacuacccuuagccggacaaguaaaaagagaucuuggccacucaacgaagccaucauggccguagggaugguguccauccuggcuagcucguugcugaaaaaugacauuccgaugacuggaccuuuaguugccgguggccuccugaccgugugcuauguccuuacggggaggucagccgaucuggaguuggaacgagcggcugacgugaagugggaggaucaagccgagauaucuggaaguucccccauccucagcauuacaaucucugaagacggcagcauguccauuaaaaacgaggaagaggagcagacccugacuauccuaauacgcacaggucugcuuguaaucucagggguguucccagucaguauucccaucaccgcagccgcuugguaccucugggaaguuaagaagcagcgggcaggagugcugugggaugugccuagcccacccccugucggcaaagccgaguuggaagacggcgcguauagaauuaagcagagggggaucuuaggauacucucaaauaggugcuggcguguauaaagaggggacuuuucacacaauguggcauguuacccguggagccguacugaugcaccgcggcaagcggauugaaccguccugggcagaugugaaaaaggaccucaucucauacggugggggauggaagcuggagggcgaguggaaagaaggcgaggaaguccaggugcuugcccuggagccagggaagaaucccagagcuguucagacgaaaccuggauuguucaagacuaacaccgguacaaucggcgccgugagucuagauuuuagcccagggaccuccggaucucccauugucgacaggaaaggcaaggugguaggucuguacgggaauggagucgugacacgaucgggcgcauauguuagcgcuaucgcccagacugaaaagucaauagaggauaacccugagauugaagacgauaucuuccggaaaaagcgccucaccauuauggaccugcauccgggcgcggggaaaacgaagagauaccuucccgccaucgugagggaggcaauaaaacggggauuacgaacacugauucucgcuccaacuagagucguggccgcugaaauggaggaagcauugcgcggucugccuaucagguaucaaacccccgccauccgugccgagcacacaggccgggagauuguugaccucaugugucaugcuaccuucacuaugagacugcuuuccccagugagggucccuaacuacaaucugaucauuauggaugaagcgcacuuuaccgaccccgcaaguauagccgcucgcggguauaucucuacacgaguggagaugggagaagccgcaggcauuuucaugacggccacuccaccggguagcagagauccuuuuccccaguccaacgcuccaaucauggacgaggagcgggaaauccccgagaggucauggaacucugggcacgaauggguaaccgauuucaagggaaagacagugugguuuguuccuagcauuaaagcgggcaacgacauagccgcaugcuugcgcaagaauggcaaaaaggucauccagcuaagucguaaaaccuucgauuccgaguacgugaagacuagagcuaacgacugggauuuuguggucacaaccgacauuagcgaaaugggggccaauuucaaggcagagcggguaaucgauccaaggcgcuguaugaaacccgugauucugacggacggagaggaacgaguuauccucgccgguccuaugccggugacucauucuucagcugcccaaagacggggcaggauagggcgcaacccaaagaaugagaacgaccaguauaucuacaugggagaacccuuagagaaugaugaagacugcgcgcacuggaaagaggcaaagaugcugcuugauaacauuaauacaccugagggcaucauucccuccauguuugaaccagagagagaaaaagucgacgccaucgauggugaguacaggcugagaggggaagcucguaagaccuucguggaccucaugcgccgaggcgauuugccuguuuggcuggccuauagaguggcugcagagggaauaaacuacgccgacaggcggugguguuuugauggcauuaaaaauaaccagauccucgaggaaaacgucgagguggaaauuuggaccaaggagggggagcgcaagaaacugaagcccagauggcuugacgcuaggaucuauagugauccacuagcccugaaagaguucaaggaguucgcagcgggacgaaagagcuugacuuuaaaucugauaacagaaaugggucggcucccuaccuuuaugacacagaaggccagagacgcucuggauaaccuugccguacugcauacugcagaggcuggcgggaaggccuacaaucacgcacucucggaauugccggagacgcuggagacccuacugcuccuuacacuguuagccacugugaccggaggcaucuucuuguuucugaugucugguaaagggauuggcaagaugacacucggaaugugcugcaucauuaccgcuuccauccugcuuugguaugcgcaaauacagccccacuggauugccgcaagcaucauccuggaguucuuucucauuguuuugcugaucccagagccugaaaaacagcgcacuccccaggacaaccaauuaacguacgucgugauagcuauucuaaccguggucgccgccacaauggcaaaugagaugggcuuccuggaaaagacuaaaaaggaccucgggcuuggaucaaucaccacacaggagagugagucuaacauucuggauaucgacuugaggccagcuuccgccuggacccuguaugcgguugcuacuacauuugugacgccuaugcuccggcauagcauagaaaauucaaguguaaacgugagccugaccgccaucgcaaaucaggccacuguccuuaugggucucggcaagggguggccccuguccaaaauggauauuggagugccguugcuggcuaucggcuguuacucucagguuaacccaauuacauuaaccgcagcccuacugcuccuuguggcgcacuacgcuaucauugguccugggcugcaagccaaggcaacccgugaggcccagaaaagagcugccgcaggcaucaugaagaaucccacagucgacggaauaacuguaauugauuuggaaccaauccccuaugacccuaaauucgagaagcagcugggccaggugaugcuccugauccuuugcguuacgcaagugaugaugaugaggaccacaugggcuuuaugugaagcccugacucucgcgaccgggccgauuagcacauugugggagggaaaccccggccgcuuuuggaauaccacuauagccgucuccauggcaaacaucuuccgggguucauaccuggcuggggccggacuacuguuuucuauuaugaagaauacgacaaacacccgaagaggcacugguaauaucggcgagacccucggggaaaaauggaagaguaggcuuaacgcacugggaaaaucggaguuccagauuuauaagaaaagcggcauccaggaaguggaucgcacauuggcuaaggaggggauaaaacggggagagacugaccaucacgccgucuccagaggcucugccaagcugcguugguuuguggaaaggaacaugguuaccccagaggguaaggugguagaucucgggugcggacggggcgguuggucauacuauuguggcgggcugaaaaaugugcgcgaagucaagggauuaacaaaaggcgggccuggacaugaggaacccaucccuaugagcacguacggcuggaaccuuguucgacugcaauccgguguggacgucuucuucaccccacccgagaagugcgauacucuccuaugugacauuggggagaguucuccuaauccaacaaucgaagcgggaagaacccugaggguguugaaccugguagagaauuggcucaacaauaacacucaguuuugcauuaaagugcuuaaucccuauaugccgagcguuaucgaaaagauggagacacugcagcggaaguacggcggcgcuuuggugcgcaacccucugucaagaaauuccacccacgaaauguacugggucaguaacgcaacggggaauauagugagcucugucaacaugauuuccaggaugcucaucaaucgauucaccaugaaacacaagaaagccacauaugagccagauguggacuuaggaucagguacucggaacaucggcauugagagcgaaauacccaaccuggacaucauugggaagcguaucgagaaaauuaagcaggaacaugagaccucguggcacuacgaucaagaccauccuuauaagacaugggcuuaccacggaucuuaugaagccaaacagacuggcagugcauccagcaugguuaaugguguagugagacuucugaccaagccaugggaugucgugcccaugguuacacagauggccaugaccgacacuacgccguuugggcagcaacgcguguucaaagagaaggucgauacaaggacccaggagccuaaagaaggaacuaagaagcuaaugaaaaucaccgcugaguggcucuggaaggaacugggcaaaaagaaaacaccccggauguguacgagagaggaguuuacccgcaaggugaggucaaacgcggccuugggcgcaauauucacugacgaaaauaaauggaaguccgcucgagaggccguagaagauucucgguuuugggagcugguggacagagaaaggaaccuccaccuugaggggaagugcgagacauguguuuacaauaugaugggaaaacgcgaaaagaaacugggugaguucggcaaggcaaaagggagccgugccaucugguauaugugguuaggagcucgguuucuggaguucgaggccuugggcuuucucaacgaagaucauugguucaguagagguaauucccugagcggggucgagggagagggccuacacaggcuuggcuacauucugcgcgacgugucuaagaaggaagggggagcgauguacgcagaugacaccgccgguugggacacucgaaucacacucgaggaucugaaaaacgaagagauggugaccaaucauaugaagggcgaacacaaaaaguuggcugaggccauuuuuaaacugacauaucagaacaaggucguucgggugcagagaccaacuccuagggggaccguaauggacaucauuucacgcagagaucaacggggaaguggccagguggguacguacgggcucaauaccuucacaaacauggaggcacagcuuauaaggcaaauggaaggagagggcaucuucaaguccauucagcaucugacugucaccgaagagaucgcugugcagaauugguuagcccguguuggccgagagcgccugagcagaauggugaucucuggggacgauugcgucgugaaacccuuggacgaucgguuugcuucggcccucacagcacugaacgacaugggaaagguaaggaaagauauucagcaaugggaaccaucacgcgguuggaaugacuggacucagguucccuucugcagccaccacuuucaugagcuagugaugaaggauggcagaguccuuguggugccuugucggaaccaggacgaacugauagggagggcgcgaaucucccagggagccggcuggagucucaaagagaccgcuugccuggguaagucuuaugcccaaauguggacguugauguacuuccaccguagagauuuacgccuggcagcuaacgccauuuguagcgcagucccaucccauuggguuccgacaucacggaccacuuggaguauccacgccaagcacgaauggaugacaaccgaggacaugcucgcgguguggaauaggguauggauucaggagaaccccuggauggaagacaaaacuccuguggagucuugggaagaggucccauaucuugggaagagagaagaucaguggugcggaagccugaucggccuaaccucccgcgcuacaugggccaaaaauauacagacggcaaucaaccaagugcggucacugauuggcaaugaggaguacaccgacuauaugcccagcaugaagagguuucgaagagaagaggaagaggccgggguucucugguga

SEQ ID NO: 14647 - RNA, 9876 nt, Artificial Sequence
  derived and/or modified CDS sequence (opt3) from DENV-2__EU482573__SS-prME
accgccggcgugaucauuaugcugauacccacggcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuucuuugcaagcauucuaugguggauagaggcugggguaacggguguggacucuucggcaagggcgggaucguaaccugcgccauguuuacaugcaaaaagaauauggaaggaaaaguggugcugccugagaaccuugaauacaccauugucauaacuccacacagcggugaggagcaugcuguuggcaaugacacggggaagcacggaaaagaaaucaagauuacaccgcaguccucaaucaccgaggccgaacugacuggcuaugguaccgugacaauggaguguagucccaggaccggguuggauuucaacgaaaugguacuccugcagauggaggacaaagcaugguuagugcaccggcaaugguuucuggaucucccucuuccauggcugcccggcgcugacacucagggaagcaauuggauacagaaggagacauuggucacguucaagaacccucaugccaaaaagcaggacgugguugugcuaggcucucaagaaggggcgaugcacaccgcccugacuggagcaacagagauucagauguccucagguaaucuccuguuuaccggccaucuuaaaugccgucugcgcauggauaaguugcagcucaaagggaugagcuacaguauguguacaggaaaguucaagaucgucaaagaaaucgcugagacucaacacggcaccauugugaucagaguacaguaugagggugacgggucuccaugcaagauucccuucgaaauaauggaucuggagaaaaggcauguuuuaggccggcugaucacggugaacccgauugucaccgaaaaggacuccccugugaacaucgaggccgaacccccauuuggagauagcuacaucauuauaggcgucgagccugggcagcuaaaacucaauugguucaagaagggaucgucuaucggucagauguuugagacaacuaugcgaggcgcuaaacgcauggccauucugggggacaccgcaugggauuucggaucccuuggcgguguguuuacaucaaucgggaaggccuugcaccaaguuuucggcgcuauuuacggagcggcauuuaguggcgugagcuggacuaugaaaauccugauagggguaaucauuaccuggaucggaaugaacuccagaucuacgagccucucagucagucuggugcuuguuggcguggucacacuguauuugggugccauggugcaggcugacuccggguguguagugagcuggaagaauaaagaacucaagugcggaucuggcauuuucaucaccgauaacguucacacuuggacagagcaguacaaguuucagcccgaaucaccaaguaaacuggccagcgcaauacaaaaggcccaugaggaagguauuuguggcaucagguccgucacccgguuagagaaucugauguggaaacagauuacucccgagcuaaaccacauccucucugaaaaugaggugaagcugaccauaaugacaggggacaucaaaggaauuaugcaggcuggcaagcgcucgcuuagaccucagccaacggaauugaaauauagcuggaagaccugggggaaggccaaaaugcuguccacugagucacauaaccaaacauuccucaucgauggaccggaaaccgcagagugccccaauacaaacagggcguggaauagucuggagguggaagacuacggcuuuggugucuucacuaccaacauuugguuaaagcugcgugagaaacaggacguauuuugugauucuaaacuuaugagcgcugccaucaaagacaaucgggcagugcacgccgauaugggguauuggauagaauccgcuuugaacgacacguggaagauggagaaggccucauucauugaggugaaaagcugccacuggccuaagucucauacacucugguccaauggaguacuggaaagugagaugaucauccccaagaauuucgcaggccccgucagccagcacaacuaccgaccugguuaucauacccagacugcuggcccauggcaccuagggaagcuggaaauggauuuugacuucugugagggaaccacagugguugugacugaagauugcggcaauagagggcccucucucaggaccacaacggccuccggaaaacugauuaccgaguggugcugucgcucaugcacucuuccgccuuugcgguacagaggcgaggacgguuguugguacgggauggaaaucaggccacugaaggagaaggaagagaacuuagucaauagucucgugacagcgggacauggccaaauugauaacuuuagccuggguguucuuggcauggcccuguucuuggaagagaugcuccgcacccgaguggggacuaaacacgcuauacugcuaguagcagucucguuugugacacugaucaccggaaauauguccuuccgggaccucggccgugugauggucaugguuggggccacgaugacugaugacauuggaaugggcgugaccuaucuggcucuuuuggccgcauuuaagguaagacccacauucgcggccggucuguuacucaggaaacugaccucuaaggagcuuaugauggcuacuaucgggauugcccugcuaagccagucaacaaucccugaaaccauacucgagcugacagaugcauuggcucugggaaugaugguguuaaaaaucguccgcaacauggaaaaguaccagcucgccgugacuauuauggcaaucaguugcguucccaaugccgugauucugcaaaacgcuuggaaggucuccuguaccauccuugcggccgugucuguuagcccacuguugcucacguccucacagcagaaagcagacuggauaccucuggcucuaacaauuaagggccugaaucccaccgccaucuuucuuacuacccucagccggacaaguaaaaagagaucuuggccacugaacgaggccaucauggcugugggcauggucuccauuuuggcaagcucgcugcuaaagaaugacauaccgaugacugggccucucguagccggaggucugcuuaccgugugcuauguucugacgggcaggucagcggauuuggaacucgagcgagcugccgacgugaagugggaggaucaggcagaaaucucugggaguucccccauucugagcaucacaauuucugaggacggaagcauguccaucaaaaacgaagaggaggaacaaacccuaacuauacugauccgcacaggccuucucgucauuucagguguguucccaguaaguauccccauuaccgccgcugcaugguaccugugggaggugaagaagcagcgggccggggucuugugggauguuccuagcccacccccugugggaaaagcggaauuagaggacggcgcuuauagaaucaagcagaggggcauacugggguacucucagauuggagccgguguguauaaagaaggcacuuuucacacaauguggcaugucacccguggggcagugcucaugcaccgcggaaagcggaucgagccguccugggccgauguuaaaaaggaccugaucucauacggcgguggguggaaacuugagggagaauggaaagagggcgaagagguacaagugcuggcuuuggaaccaggcaagaaucccagagccguccagacgaaaccugggcuauucaagacuaacaccggaacaauuggugcagugagucuggauuuuagcccaggcaccuccgggucucccaucguugacaggaaaggaaagguggucggccucuacgguaauggggugguaacacgaucgggagcuuaugucagcgccauagcgcagacugagaagucaauugaggauaacccugaaaucgaggacgauauuuuccggaaaaagcgccugaccaucauggaccuucauccgggcgccggcaaaacgaagagauacuuacccgcaauagugagggaagcuauuaaacgggggcugcgaacacucaucuuggccccaacuagaguuguggcugcagagauggaagaggcccugcgcggacucccuaucagguaucagacccccgccauucgugcugagcacacaggucgggaaaucgucgaccugaugugucaugcgaccuucacuaugagacuucuguccccagugaggguuccuaacuacaauuugauuauaauggaugaggcacacuuuaccgaccccgccaguaucgcugcccgcggcuauauuucuacacgaguggaaaugggggaggcagccggaaucuucaugacggcuacuccaccgggcagcagagauccuuuuccccaauccaacgcgccaaucauggacgaggaacgggagauucccgaaaggucauggaacucuggucacgagugggucaccgauuucaaggggaagacagugugguuuguaccuagcauaaaagccggaaacgacaucgcagcuugccuacgcaagaauggcaaaaaggugauucagcugagucguaaaaccuucgauuccgaauacguuaagacuagagccaacgacugggauuuugucgugacaaccgacaucagcgagaugggcgcaaauuucaaggccgagcgggugauugauccaaggcgcuguaugaaacccgucauccucacggacggggaagaacgaguaauauuagcuggaccuaugccggugacucauucuucagccgcgcagagacgggguaggaucggccgcaacccaaagaaugaaaacgaccaauauauuuacaugggggagccccuggaaaaugaugaggacugcgcacacuggaaagaggccaagaugcuucuggauaacaucaauacaccugaaggaauuauccccuccauguuugagccagaaagagagaaaguugacgcuauagauggcgaauacaggcuccggggugaggcccguaagaccuucguggacuugaugcgccgaggggaucugccugucuggcucgcuuauagaguggcagccgagggcauuaacuacgcugacaggcggugguguuuugauggaaucaaaaauaaccagauucuggaagagaacguugaaguggagaucuggaccaaggagggcgaacgcaagaaacuuaagcccagauggcuagacgccaggauauauagugauccacuggcauugaaagaguucaaggaguucgcggccgggcgaaagagcuuaacucugaaucucaucacagagaugggacggcugccuaccuuuaugacacagaaggcuagagacgcccuugauaaccuggcaguccuccauacugcugaagccgguggccgcgcauacaaucacgccuugucggagcugccggagacgcuagaaacccugcuccuucugacauuauuggcuacugugaccgggggaauuuuccuguuucucaugucuggcaaggguaucgggaaaaugacacugggcaugugcugcauuaucaccgcguccauacuucugugguaugcccagauucaaccccacuggaucgcagcuagcaucauucucgaguucuuuuugaucguacuguuaauaccagaaccugagaagcagaggacuccccaggacaaccagcuaacguacgugguuauugccauccugaccgucguggccgcaacaauggcuaaugaaaugggauuccucgagaaaacuaagaaagaccuuggccuggggucaauuaccacacaagagagugaaucuaacaucuuggauauagaccugcggccagccuccgcguggacccucuaugcuguggccacuacauuugucacgccuaugcugcgucauagcaucgaaaauucaaguguuaacgugagccuuaccgcaauugccaaucaggcuacuguacucaugggacuggguaagggcuggcccuuguccaagauggauaucggggugccgcuguuagcaauuggauguuacucucaggucaacccaaucacacuaaccgccgcgcugcuccuucugguggcucacuacgccauuaucggcccugguuugcaggcaaaagccaccagagaagcucaaaagagggccgcagcugggauaaugaaaaaucccacaguugacggcauuacugugaucgaucuggagccaauccccuaugacccuaaguucgaaaaacagcucggacaggucaugcugcuuauuuuaugcguaacacaggugcugaugaugcgcaccacaugggcccucugugaggcguugacucuggccaccggcccgauaagcacacuaugggaggggaaccccggacgguuuuggaauaccacuaucgcaguuuccauggcuaacauuuuccgaggcucauaccuggccggugcagggcuccuauuuucuaucaugaagaauacgacaaacaccagaaggggaacuggcaauauuggugaaacccugggcgagaaguggaaaagucgcuugaacgcucuggggaagucggaguuccaaaucuauaaaaagagcggaauacaggagguggaucggacacucgccaaagagggcaucaagagaggggaaacugaccaucacgccgucucccguggaucugcgaaacugaggugguuuguggagcggaacauggucaccccagaaggcaaggugguugauuuagguugcgggcgcggaggcuggucauacuauugugguggccuuaagaaugugcgagagguaaaagggcugacaaagggaggcccugggcaugaagaaccaauuccuaugagcacguacggauggaaccucgugagacuacaguccggcgucgacguuuucuucaccccacccgagaaaugcgauacucuguugugugacaucggugaaaguucuccuaauccaacaauugaggcugggaggacccugcgggugcucaaccuugucgaaaauuggcugaacaauaacacucaauuuugcaucaagguguugaaucccuauaugccgagcguaauagagaaaauggaaacacugcagcgcaaguacggaggcgcacucgugagaaacccuuuaucaagaaauuccacccacgagauguacuggguuaguaacgccacgggcaauauugugagcucugucaacaugaucucccgaaugcugaucaaucgguucaccaugaagcacaaaaaggcuacauaugagccagauguggaccuugggucaggaacucguaacauugguauagaaagcgagauccccaaccuggacauuaucggcaaaagaauugaaaagaucaaacaggagcaugaaaccucguggcacuacgaucaggaccauccuuauaagacaugggccuaccacgggucuuaugagacuaagcaaaccggaagugcauccagcauggucaauggcgugguucgccuacucacaaaaccaugggauguagugcccauggucacccagauggccaugacugacacgacaccguuuggucagcagaggguguucaaggagaaaguugauacccggacucaagaaccuaaggaggggaccaaaaagcugaugaagauaacagcugaaugguuguggaaagagcugggaaagaaaaagacgcccagaauguguacccgcgaggaauuuacuaggaaagugcgaucaaacgcggcccucggcgcaaucuucacagacgagaauaaguggaaauccgcucgggaagccgucgaggauucuagauuuugggaacuuauugacagggagcgcaaccugcacuuagagggcaagugcgaaaccuguguguacaauaugauggggaagcgugagaaaaagcugggagaguucgguaaagcaaagggcagccgggccaucugguauaugugguugggggcuagauuucucgaguucgaagcccugggauuucuaaacgaggaucauugguucaguaggggcaauucccuuagcgguguagagggggaaggacugcaccgccucggcuacauucugcgagacgugucuaaaaaggagggcggggcgauguacgcagaugacacugccggaugggacacacggaucaccuuggaagaucugaagaacgaggaaaugguuacaaaucauaugaaaggugagcacaagaaacucgcugaggccauuuuuaaacuuacuuaucagaacaaagucgugagagugcagaggccaaccccucgcggcacggucauggacauaaucucaagacgggaucagagggggaguggacaaguuggcaccuacggucugaauacauucacuaacauggaagcacaguuaauucgucagauggagggggaaggaaucuucaaguccauccaacaucugaccgugacagaggagauugcuguacagaauugguuggcccgagugggccgcgaaagacucagccggauggcuauaucuggcgacgauugcgucgugaagccccuggacgauagguuugccucggcacuaacugcgcuuaacgacauggggaaaguucgcaaggauauccagcagugggagccaucaagaggauggaaugacuggacccaagugcccuucugcagccaccacuuucaugaacuggucaugaaagauggucgggugcucguaguuccuuguaggaaccaggacgagcugauuggccgagcccguaucucccagggggcuggauggaguuugaaggaaacggccugcuuaggcaaaucuuaugcacagauguggacacugauguacuuccacagacgcgaucuccggcuugcugccaacgcaauuuguagcgccgugccaucccauugggucccgaccucaaggacuacauggaguauccacgcgaagcacgaguggaugaccacugaggacaugcuggcuguguggaauagaguguggauacaagaaaaccccuggauggaggacaagaccccugucgaaucuugggaggaaguuccauaucuagguaaacgcgaggaucaguggugcgggagccugaucggacucacaucccgggccacgugggcaaagaauauucagaccgccaucaaccaggugaggucauugauuggcaaugaggaauacacugacuauaugcccagcaugaaacgauuuagacgggaggaagaggaagcuggcguacugugguga

SEQ ID NO: 14648 - RNA, 9876 nt, Artificial Sequence
  derived and/or modified CDS sequence (opt3) from DENV-2__EU482574__SS-prME
accgccggcgugaucauuaugcugauacccacggcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuucuuugcaagcauucuaugguggauagaggcugggguaacggguguggacucuucggcaagggcgggaucguaaccugcgccauguuuacaugcaaaaagaauauggaaggaaaaguggugcugccugagaaccuugaauacaccauugucauaacuccacacagcggugaggagcaugcuguuggcaaugacacggggaagcacggaaaagaaaucaagauuacaccgcaguccucaaucaccgaggccgaacugacuggcuaugguaccgugacaauggaguguagucccaggaccggguuggauuucaacgaaaugguacuccugcacauggaggacaaagcaugguuagugcaucggcagugguuucuggaucucccucuuccauggcugcccggcgcugacacucaaggaagcaauuggauacagaaggagacauuggucacguucaagaacccucacgccaaaaagcaggacgugguugugcuaggcucucaggaaggggcgaugcauaccgcccugacuggagcaacagagauucaaauguccucagguaaucuccuguuuaccggccaccuuaaaugccgucugcgcauggauaaguugcagcucaaagggaugagcuacaguauguguacaggaaaguucaagaucgucaaagaaaucgcugagacucagcauggcaccauugugaucagaguacaauaugagggugacgggucuccaugcaagauucccuucgaaauaauggaucuggagaaaaggcacguuuuaggccggcugaucacggugaacccgauugucaccgaaaaggacuccccugugaacaucgaggccgaacccccauuuggagauagcuacaucauuauaggcgucgagccugggcagcuaaaacucaauugguucaagaagggaucgucuaucggucagauguuugagacaacuaugcgaggcgcuaaacgcauggccauucugggggacaccgcaugggauuucggaucccuuggcgguguguuuacaucaaucgggaaggccuugcaccagguuuucggcgcuauuuacggagcggcauuuaguggcgugagcuggacuaugaaaauccugauagggguaaucauuaccuggaucggaaugaacuccagaucuacgagccucucagucagucuggugcuuguuggcguggucacacuguauuugggugccauggugcaagcugacuccggguguguagugagcuggaagaauaaagaacucaagugcggaucuggcauuuucaucaccgauaacguucauacuuggacagagcaguacaaguuucagcccgaaucaccaaguaaacuggccagcgcaauacagaaggcccacgaggaagguauuuguggcaucagguccgucacccgguuagagaaucugauguggaaacaaauuacucccgagcuaaaccauauccucucugaaaaugaggugaagcugaccauaaugacaggggacaucaaaggaauuaugcaggcuggcaagcgcucgcuuagaccucagccaacggaauugaaauauagcuggaagaccugggggaaggccaaaaugcuguccacugagucacacaaccagacauuccucaucgauggaccggaaaccgcagagugccccaauacaaacagggcguggaauagucuggagguggaagacuacggcuuuggugucuucacuaccaacauuugguuaaagcugcgugagaaacaagacguauuuugugauucuaaacuuaugagcgcugccaucaaagacaaucgggcagugcacgccgauaugggguauuggauagaauccgcuuugaacgacacguggaagauggagaaggccucauucauugaggugaaaagcugccauuggccuaagucucacacacucugguccaauggaguacuggaaagugagaugaucauccccaagaauuucgcaggccccgucagccagcauaacuaccgaccugguuaucacacccagacugcuggcccauggcaucuagggaagcuggaaauggauuuugacuucugugagggaaccacagugguugugacugaagauugcggcaauagagggcccucucucaggaccacaacggccuccggaaaacugauuaccgaguggugcugucgcucaugcacucuuccgccuuugcgguacagaggcgaggacgguuguugguacgggauggaaaucaggccacugaaggagaaggaagagaacuuagucaauagucucgugacagcgggacacggccagauugauaacuuuagccuggguguucuuggcauggcccuguucuuggaagagaugcuccgcacccgaguggggacuaaacacgcuauacugcuaguagcagucucguuugugacacugaucaccggaaauauguccuuccgggaccucggccgugugauggucaugguuggggccacgaugacugaugacauuggaaugggcgugaccuaucuggcucuuuuggccgcauuuaagguaagacccacauucgcggccggucuguuacucaggaaacugaccucuaaggagcuuaugauggcuacuaucgggauugcccugcuaagccaaucaacaaucccugaaaccauacucgagcugacagaugcauuggcucugggaaugaugguguuaaaaaucguccgcaacauggaaaaguaccagcucgccgugacuauuauggcaaucaguugcguucccaaugccgugauucugcagaacgcuuggaaggucuccuguaccauccuugcggccgugucuguuagcccacuguugcucacguccucacaacagaaagcagacuggauaccucuggcucuaacaauuaagggccugaaucccaccgccaucuuucuuacuacccucagccggacaaguaaaaagagaucuuggccacugaacgaggccaucauggcugugggcauggucuccauuuuggcaagcucgcugcuaaagaaugacauaccgaugacugggccucucguagccggaggucugcuuaccgugugcuauguucugacgggcaggucagcggauuuggaacucgagcgagcugccgacgugaagugggaggaucaggcagaaaucucugggaguucccccauucugagcaucacaauuucugaggacggaagcauguccaucaaaaacgaagaggaggaacagacccuaacuauacugauccgcacaggccuucucgucauuucagguguguucccaguaaguauccccauuaccgccgcugcaugguaccugugggaggugaagaagcaacgggccggggucuugugggauguuccuagcccacccccugugggaaaagcggaauuagaggacggcgcuuauagaaucaagcagaggggcauacugggguacucucagauuggagccgguguguauaaagaaggcacuuuucauacaauguggcacgucacccguggggcagugcucaugcaucgcggaaagcggaucgagccguccugggccgauguuaaaaaggaccugaucucauacggcgguggguggaaacuugagggagaauggaaagagggcgaagagguacaggugcuggcuuuggaaccaggcaagaaucccagagccguccaaacgaaaccugggcuauucaagacuaacaccggaacaauuggugcagugagucuggauuuuagcccaggcaccuccgggucucccaucguugacaggaaaggaaagguggucggccucuacgguaauggggugguaacacgaucgggagcuuaugucagcgccauagcgcagacugagaagucaauugaggauaacccugaaaucgaggacgauauuuuccggaaaaagcgccugaccaucauggaccuucacccgggcgccggcaaaacgaagagauacuuacccgcaauagugagggaagcuauuaaacgggggcugcgaacacucaucuuggccccaacuagaguuguggcugcagagauggaagaggcccugcgcggacucccuaucagguaucagacccccgccauucgugcugagcauacaggucgggaaaucgucgaccugaugugucacgcgaccuucacuaugagacuucuguccccagugaggguuccuaacuacaauuugauuauaauggaugaggcacacuuuaccgaccccgccaguaucgcugcccgcggcuauauuucuacacgaguggaaaugggggaggcagccggaaucuucaugacggcuacuccaccgggcagcagagauccuuuuccccaguccaacgcgccaaucauggacgaggaacgggagauucccgaaaggucauggaacucuggucaugagugggucaccgauuucaaggggaagacagugugguuuguaccuagcauaaaagccggaaacgacaucgcagcuugccuacgcaagaauggcaaaaaggugauucaacugagucguaaaaccuucgauuccgaauacguuaagacuagagccaacgacugggauuuugucgugacaaccgacaucagcgagaugggcgcaaauuucaaggccgagcgggugauugauccaaggcgcuguaugaaacccgucauccucacggacggggaagaacgaguaauauuagcuggaccuaugccggugacucacucuucagccgcgcagagacgggguaggaucggccgcaacccaaagaaugaaaacgaccaguauauuuacaugggggagccccuggaaaaugaugaggacugcgcacauuggaaagaggccaagaugcuucuggauaacaucaauacaccugaaggaauuauccccuccauguuugagccagaaagagagaaaguugacgcuauagauggcgaauacaggcuccggggugaggcccguaagaccuucguggacuugaugcgccgaggggaucugccugucuggcucgcuuauagaguggcagccgagggcauuaacuacgcugacaggcggugguguuuugauggaaucaaaaauaaccaaauucuggaagagaacguugaaguggagaucuggaccaaggagggcgaacgcaagaaacuuaagcccagauggcuagacgccaggauauauagugauccacuggcauugaaagaguucaaggaguucgcggccgggcgaaagagcuuaacucugaaucucaucacagagaugggacggcugccuaccuuuaugacacagaaggcuagagacgcccuugauaaccuggcaguccuccacacugcugaagccgguggccgcgcauacaaucacgccuugucggagcugccggagacgcuagaaacccugcuccuucugacauuauuggcuacugugaccgggggaauuuuccuguuucucaugucuggcaaggguaucgggaaaaugacacugggcaugugcugcauuaucaccgcguccauacuucugugguaugcccagauucagccccauuggaucgcagcuagcaucauucucgaguucuuuuugaucguacuguuaauaccagaaccugagaagcaaaggacuccccaggacaaccagcuaacguacgugguuauugccauccugaccgucguggccgcaacaauggcuaaugaaaugggauuccucgagaaaacuaagaaagaccuuggccuggggucaauuaccacacaggagagugaaucuaacaucuuggauauagaccugcggccagccuccgcguggacccucuaugcuguggccacuacauuugucacgccuaugcugcgucacagcaucgaaaauucaaguguuaacgugagccuuaccgcaauugccaaucaagcuacuguacucaugggacuggguaagggcuggcccuuguccaagauggauaucggggugccgcuguuagcaauuggauguuacucucaggucaacccaaucacacuaaccgccgcgcugcuccuucugguggcucauuacgccauuaucggcccugguuugcaggcaaaagccaccagagaagcucagaagagggccgcagcugggauaaugaaaaaucccacaguugacggcauuacugugaucgaucuggagccaauccccuaugacccuaaguucgaaaaacaacucggacaggucaugcugcuuauuuuaugcguaacacaggugcugaugaugcgcaccacaugggcccucugugaggcguugacucuggccaccggcccgauaagcacacuaugggaggggaaccccggacgguuuuggaauaccacuaucgcaguuuccauggcuaacauuuuccgaggcucauaccuggccggugcagggcuccuauuuucuaucaugaagaauacgacaaacaccagaaggggaacuggcaauauuggugaaacccugggcgagaaguggaaaagucgcuugaacgcucuggggaagucggaguuccagaucuauaaaaagagcggaauacaagagguggaucggacacucgccaaagagggcaucaagagaggggaaacugaccaccaugccgucucccguggaucugcgaaacugaggugguuuguggagcggaacauggucaccccagaaggcaaggugguugauuuagguugcgggcgcggaggcuggucauacuauugugguggccuuaagaaugugcgagagguaaaagggcugacaaagggaggcccugggcacgaagaaccaauuccuaugagcacguacggauggaaccucgugagacuacaguccggcgucgacguuuucuucaccccacccgagaaaugcgauacucuguugugugacaucggugaaaguucuccuaauccaacaauugaggcugggaggacccugcgggugcucaaccuugucgaaaauuggcugaacaauaacacucaguuuugcaucaagguguugaaucccuauaugccgagcguaauagagaaaauggaaacacugcaacgcaaguacggaggcgcacucgugagaaacccuuuaucaagaaauuccacccacgagauguacuggguuaguaacgccacgggcaauauugugagcucugucaacaugaucucccgaaugcugaucaaucgguucaccaugaagcauaaaaaggcuacauaugagccagauguggaccuugggucaggaacucguaacauugguauagaaagcgagauccccaaccuggacauuaucggcaaaagaauugaaaagaucaaacaggagcacgaaaccucguggcauuacgaucaggaccacccuuauaagacaugggccuaccacgggucuuaugagacuaagcagaccggaagugcauccagcauggucaauggcgugguucgccuacucacaaaaccaugggauguagugcccauggucacccaaauggccaugacugacacgacaccguuuggucagcagaggguguucaaggagaaaguugauacccggacucaggaaccuaaggaggggaccaaaaagcugaugaagauaacagcugaaugguuguggaaagagcugggaaagaaaaagacgcccagaauguguacccgcgaggaauuuacuaggaaagugcgaucaaacgcggcccucggcgcaaucuucacagacgagaauaaguggaaauccgcucgggaagccgucgaggauucuagauuuugggaacuuauugacagggagcgcaaccugcauuuagagggcaagugcgaaaccuguguguacaauaugauggggaagcgugagaaaaagcugggagaguucgguaaagcaaagggcagccgggccaucugguauaugugguugggggcuagauuucucgaguucgaagcccugggauuucuaaacgaggaucacugguucaguaggggcaauucccuuagcgguguagagggggaaggacugcaucgccucggcuacauucugcgagacgugucuaaaaaggagggcggggcgauguacgcagaugacacugccggaugggacacacggaucaccuuggaagaucugaagaacgaggaaaugguuacaaaucacaugaaaggugagcauaagaaacucgcugaggccauuuuuaaacuuacuuaucaaaacaaagucgugagagugcagaggccaaccccucgcggcacggucauggacauaaucucaagacgggaucagagggggaguggacagguuggcaccuacggucugaauacauucacuaacauggaagcacaauuaauucgucagauggagggggaaggaaucuucaaguccauccagcaccugaccgugacagaggagauugcuguacaaaauugguuggcccgagugggccgcgaaagacucagccggauggcuauaucuggcgacgauugcgucgugaagccccuggacgauagguuugccucggcacuaacugcgcuuaacgacauggggaaaguucgcaaggauauccagcagugggagccaucaagaggauggaaugacuggacccaggugcccuucugcagccaccauuuucacgaacuggucaugaaagauggucgggugcucguaguuccuuguaggaaccaagacgagcugauuggccgagcccguaucucccagggggcuggauggaguuugaaggaaacggccugcuuaggcaaaucuuaugcacagauguggacacugauguacuuccauagacgcgaucuccggcuugcugccaacgcaauuuguagcgccgugccaucccacugggucccgaccucaaggacuacauggaguauccacgcgaagcaugaguggaugaccacugaggacaugcuggcuguguggaauagaguguggauacaggaaaaccccuggauggaggacaagaccccugucgaaucuugggaggaaguuccauaucuagguaaacgcgaggaucaauggugcgggagccugaucggacucacaucccgggccacgugggcaaagaauauucagaccgccaucaaccaggugaggucauugauuggcaaugaggaauacacugacuauaugcccagcaugaaacgauuuagacgggaggaagaggaagcuggcguacugugguga

SEQ ID NO: 14649 - RNA, 9876 nt, Artificial Sequence
  derived and/or modified CDS sequence (opt3) from DENV-2__EU482575__SS-prME
accgccggcgugaucauuaugcugauacccacagcuauggcauuccaccucacuacgcgaaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcgccgacgugaaaagagaucaguugcgcuggugccccacgucgguauggggcuugagaccaggacagaaacuuggaugaguagcgagggagcuuggaaacaugugcagcggaucgagaccuggauacugcgccacccuggcuucacaaucauggccgcaauuuuggccuacaccaucggcacgacucauuuucagagagcucucauuuucauccugcugacagcaguugccccauccaugaccaugaggugcauagggauuucuaaccgggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucgcaaauauugcaucgaagcaaaguugacaaacacuaccacagagagucgauguccaacucaaggagagcccucccugaaugaagaacaggacaaaagauuucuaugcaagcacucuaugguggauaggggcugggguaacggguguggacucuucggcaagggcgggaucguaaccugcgccauguuuacaugcaaaaagaauauggaaggaaaaguggugcugccugagaaccuugaauacaccauugucauaacuccacauagcggugaggagcacgcuguuggcaaugacacggggaagcauggaaaagaaaucaagauuacaccgcaguccucaaucaccgaggccgaacugacuggcuaugguaccgugacaauggaguguaguccccggaccggguuggauuucaacgaaaugguacuccugcagauggaggacaaagcaugguuagugcaccgucaaugguuucuggaucucccucuuccauggcugcccggcgcugacacucagggaagcaauuggauacagaaggagacauuggucacguucaagaacccucacgccaaaaagcaggacgugguugugcuaggcucucaagaaggggcgaugcauaccgcccugacuggagcaacagagauucagauguccucagguaaucuccuguuuaccggccaccuuaaaugccgccugagaauggauaaguugcagcucaaagggaugagcuacaguauguguacaggaaaguucaagaucgucaaagaaaucgcugagacucaacauggcaccauugugaucaggguacaguaugagggugacgggucuccaugcaagauucccuucgaaauaauggaucuggagaaacggcacguuuuaggccgacugaucacggugaacccgauugucaccgaaaaggacuccccugugaacaucgaggccgaacccccauuuggagauagcuacaucauuauaggcgucgagccugggcagcuaaaacucaauugguucaagaagggaucgucuaucggucagauguuugagacaacuaugcgcggcgcuaaaagaauggccauucugggggacaccgcaugggauuucggaucccuuggcgguguguuuacaucaaucgggaaggccuugcaucaaguuuucggcgcuauuuacggagcggcauuuaguggcgugagcuggacuaugaaaauccugauagggguaaucauuaccuggaucggaaugaacuccaggucuacgagccucucagucagucuggugcuuguuggcguggucacacuguauuugggugccauggugcaggcugacuccggguguguagugagcuggaagaauaaagaacucaagugcggaucuggcauuuucaucaccgauaacguucacacuuggacagagcaguacaaguuucagcccgaaucaccaaguaaacuggccagcgcaauacaaaaggcccacgaggaagguauuuguggcauccgguccgucacccgcuuagagaaucugauguggaaacagauuacucccgagcuaaaccauauccucucugaaaaugaggugaagcugaccauaaugacaggggacaucaaaggaauuaugcaggcuggcaagagaucgcuuaggccucagccaacggaauugaaauauagcuggaagaccugggggaaggccaaaaugcuguccacugagucacacaaccaaacauuccucaucgauggaccggaaaccgcagagugccccaauacaaaccgugcguggaauagucuggagguggaagacuacggcuuuggugucuucucuacuaacauuugguuaaagcugcgggagaaacaggacguauuuugugauagcaaacuuauguccgcugccaucaaagacaaucgagcagugcaugccgauaugggguauuggauagaaucagcuuugaacgacaccuggaagauggagaaggccagcuucauugaggugaaaucuugccacuggccuaagucccacacgcucuggaguaauggaguacuggaaagcgagaugaucauccccaagaacuucgcaggccccgucucucagcauaacuacagaccugguuaucacacacagaccgcuggcccauggcaucuagggaagcuggaaauggauuuugacuucugugagggaacuaccgugguugugacagaagauugcggcaauagggggcccucccuccgcacuaccacagccucaggaaaacugauuacggaguggugcugucggaguugcacccuuccgccuuugagauacaggggcgaggacgguuguugguacgggauggaaauccgcccacugaaggagaaggaagagaacuuagucaauagccucgugacugcgggacacggccaaauugauaacuuuucgcuggguguucuuggcauggcccuguucuuggaagagaugcuccgaacacggguggggaccaaacaugcuauacugcuaguagcagucuccuuugugacucugaucacaggaaauaugucuuuccgugaccucggcagagugauggucaugguuggggccaccaugacggaugacauuggaaugggcgugacuuaucuggcucuuuuggccgcauuuaagguaaggcccaccuucgcggccggucuguuacuccgcaaacugacaagcaaggagcuuaugauggcuaccaucgggauugcccugcuaucacagaguacuaucccugaaacaauacucgagcugaccgaugcauuggcucugggaaugaugguguuaaaaaucguccggaacauggaaaaguaccagcucgccgugacaauuauggcaaucuccugcguucccaaugccgugauucugcaaaacgcuuggaaggucucuuguacuauccuugcggccgugagcguuuccccacuguugcucaccucaagccagcagaaagcagacuggauaccucuggcucuaacgauuaagggccugaaucccacagccaucuuucuuaccacucucaguagaaccucuaaaaagagguccuggccacugaacgaggccaucauggcugugggcauggucagcauuuuggcaucgucacugcuaaagaaugacauaccgaugacagggccucucguagccggaggucugcuuacugugugcuauguucugaccggccgaucugcggauuuggaacucgagcgcgcugccgacgugaagugggaggaucaggcagaaaucaguggguccagccccauucugucuaucacgauuagcgaggacggauccaugucaaucaaaaacgaagaggaggaacaaacacuaaccauacugauccggacuggccuucucgucauuagugguguguucccaguaagcauccccauuacagccgcugcaugguaccugugggaggugaagaagcagagagccggggucuugugggauguuccuucuccacccccugugggaaaagcggaauuagaggacggcgcuuauaggaucaagcagcguggcauacugggguacucccagauuggagccgguguguauaaagaaggcaccuuucacacuauguggcacgucacacgcggggcagugcucaugcaucggggaaagagaaucgagccgucaugggccgauguuaaaaaggaccugaucaguuacggcgguggguggaaacuugagggagaauggaaagagggcgaagagguacaagugcuggcuuuggaaccaggcaagaaucccagggccguccagaccaaaccugggcuauucaagacgaacacuggaaccauuggugcagugagccuggauuuuuccccaggcacaucugggucgcccaucguugaccgaaaaggaaagguggucggccucuacgguaauggggugguaacccggagcggagcuuaugucucagccauagcgcagacagagaaguccauugaggauaacccugaaaucgaggacgauauuuuccgcaaaaagagacugacuaucauggaccuucacccgggcgccggcaaaaccaagagguacuuacccgcaauagugcgggaagcuauuaaacgagggcugagaacgcucaucuuggccccaacacgcguuguggcugcagagauggaagaggcccugaggggacucccuauccguuaucagacucccgccauucgggcugagcauaccgguagagaaaucgucgaccugaugugucacgcgacauucaccaugaggcuucugaguccagugcgcguuccuaacuacaauuugauuauaauggaugaggcacauuuuacugaccccgccucuaucgcugcccgaggcuauauuagcaccagaguggaaaugggggaggcagccggaaucuucaugacagcuacgccaccgggcucccgggauccuuuuccccaaucaaacgcgccaaucauggacgaggaaagggagauucccgaacgcucuuggaauagcggucacgagugggucacugauuucaaggggaagaccgugugguuuguaccuaguauaaaagccggaaacgacaucgcagcuugccuacguaagaauggcaaaaaggugauucagcuguccagaaaaacauucgauagcgaauacguuaagacccgggccaacgacugggauuuugucgugacuacagacaucucugagaugggcgcaaauuucaaggccgagagggugauugauccacgccgauguaugaaacccgucauccucaccgacggggaagagagaguaauauuagcuggaccuaugccggugacgcacucauccgccgcgcagcggaggggucgcaucggcagaaacccaaagaaugaaaacgaccaauauauuuacaugggggagccccuggaaaaugaugaggacugcgcacauuggaaagaggccaagaugcuucuggauaacaucaauacuccugaaggaauuauccccaguauguuugagccagaaagggagaaaguugacgcuauagauggcgaauaccggcuccguggugaggcccgcaagacauucguggacuugaugcgaagaggggaucugccugucuggcucgcuuauaggguggcagccgagggcauuaacuacgcugaccggcgcugguguuuugauggaaucaaaaauaaccagauucuggaagagaacguugaaguggagaucuggaccaaggagggcgaaagaaagaaacuuaagcccagguggcuagacgcccggauauauagcgauccacuggcauugaaagaguucaaggaguucgcggccgggcgaaaaucguuaacccugaaucucaucacugagaugggaagacugccuacauuuaugacccagaaggcucgcgacgcccuugauaaccuggcaguccuccacacagcugaagccgguggcagggcauacaaucaugccuugucugagcugccggagacucuagaaacgcugcuccuucugaccuuauuggcuacagugacugggggaauuuuccuguuucucauguccggcaaggguaucgggaaaaugacccugggcaugugcugcauuaucacagcgagcauacuucugugguaugcccagauucaaccccacuggaucgcagcuucaaucauucucgaguucuuuuugaucguacuguuaauaccagaaccugagaagcagcggaccccacaggacaaccagcuaacuuacgugguuauugccauccugacggucguggccgcaaccauggcuaaugaaaugggauuccucgagaaaacaaagaaagaccuuggccuggggaguauuacuacccaagagucugaauccaacaucuuggauauagaccugcguccagccagcgcguggacacucuaugcuguggccaccacuuuugucacaccuaugcugagacacucaaucgagaauaguagcguuaacgugucccuuacggcaauugccaaucaggcuaccguacucaugggacuggguaagggcuggcccuugucuaagauggauaucggggugccgcuguuagcaauuggauguuacagccaggucaacccaaucacucuaacagccgcgcugcuccuucugguggcucauuacgccauuaucggcccugguuugcaggcaaaagccaccagggaagcucaaaagcgcgccgcagcugggauaaugaaaaaucccaccguugacggcauuacagugaucgaucuggagccaauccccuaugacccuaaguucgaaaaacagcucggacaggucaugcugcuuauuuuaugcguaacucaggugcugaugaugcggacgaccugggcccucugugaggcguugacacuggccacuggcccgauauccacccuaugggaggggaaccccggacgauuuuggaauacaaccaucgcaguuucaauggcuaacauuuucagaggcucuuaccuggccggugcagggcuccuuuuuaguaucaugaagaauacuacgaacacaaggcgcggaaccggcaauauuggugaaacucugggcgagaaguggaaaucgcgguugaacgcucuggggaagucagaguuccaaaucuauaaaaaguccggaauacaggagguggauagaacccucgccaaagagggcaucaagcguggggaaacagaccaccaugccgucucuaggggaucagcgaaacugcggugguuuguggagcgcaacauggucacuccagaaggcaaggugguugauuuagguugcgggcgaggaggcuggagcuacuauugugguggccuuaagaaugugagagagguaaaagggcugaccaagggaggcccugggcacgaagaacccauuccuauguccacauacggauggaaccucgugaggcuacagaguggcgucgacguuuucuucacgccacccgagaaaugcgauacccuguugugugacaucggugaaucuagcccuaauccaacuauugaggcugggcggacacugcgcgugcucaaccuugucgaaaauuggcugaacaauaacacccaauuuugcaucaagguguugaaucccuauaugccgucaguaauagagaaaauggaaacucugcagagaaaguacggaggcgcacucgugaggaacccuuuaucccgaaauaguacacaugagauguacuggguuagcaacgccaccggcaauauugugucuuccgucaacaugaucucacggaugcugaucaaucguuucacgaugaagcacaaaaaggcuaccuaugagccagauguggaccuugggagcggaacaagaaacauugguauagaaucggagauccccaaccuggacauuaucggcaaacgcauugaaaagaucaaacaggagcacgaaacuucuuggcauuacgaucaggaccacccuuauaagaccugggccuaccaugggaguuaugagacaaagcaaacuggauccgcaagcucaauggucaauggcgugguuaggcuacucaccaaaccaugggauguagugcccauggucacacagauggccaugaccgacacuacgccguuuggucagcagcggguguucaaggagaaaguugauacaagaacccaagaaccuaaggaggggacuaaaaagcugaugaagauaaccgcugaaugguuguggaaagagcugggaaagaaaaagacaccccgcauguguacgagggaggaauuuacccgaaaagugcgguccaacgcggcccucggcgcaaucuucacugacgagaauaaguggaaaucugcuagagaagccgucgaggauagcagguuuugggaacuuauugaccgcgagcguaaccugcacuuagagggcaagugcgaaacauguguguacaauaugauggggaagcgggagaaaaagcugggagaguucgguaaagcaaagggcaguagagccaucugguauaugugguugggggcuagguuucucgaguucgaagcccugggauuucuaaacgaggaucacugguucucccgcggcaauagccuuucugguguagagggggaaggacugcaucgacucggcuacauucugcgggacgugagcaagaaggagggcggggcgauguacgcagaugacaccgccggaugggacacuagaaucacauuggaagaucugaagaacgaggaaaugguuaccaaucacaugaaaggugagcauaagaaacucgcugaggccauuuuuaaacuuacauaucagaacaaagucgugagggugcagcgcccaacuccuagaggcaccgucauggacauaaucagucggagggaucagcguggguccggacaaguuggcacguacggucugaauaccuucacaaacauggaagcacaguuaauucgacagauggagggggaaggaaucuucaagagcauccaacaccugacugugaccgaggagauugcuguacagaauugguuggcccgcgugggcagagaacggcucucuaggauggcuauaucgggcgacgauugcgucgugaagccccuggacgaucgcuuugccucagcacuaacagcgcuuaacgacauggggaaaguuagaaaggauauccagcagugggagccaagccggggauggaaugacuggacucaagugcccuucugcucccaucacuuucacgaacuggucaugaaagaugguagggugcucguaguuccuugucgaaaccaggacgagcugauuggccgugccagaaucagucagggggcuggauggucuuugaaggaaaccgccugcuuaggcaaaagcuaugcacagauguggacgcugauguacuuccaucgccgggaucucaggcuugcugccaacgcaauuuguuccgccgugccaucacacugggucccgacaaguagaaccacuuggucuauccaugcgaagcacgaguggaugacaaccgaggacaugcuggcuguguggaaucgcguguggauacaagaaaaccccuggauggaggacaagacuccugucgaaagcugggaggaaguuccauaucuagguaaacgggaggaucaguggugcgggucccugaucggacucaccucaagggccacaugggcaaagaauauucagacggccaucaaccaggugcggagcuugauuggcaaugaggaauacaccgacuauaugcccucuaugaaaagauuuagaagggaggaagaggaagcuggcguacugugguga

SEQ ID NO: 14650 - RNA, 9876 nt, Artificial Sequence
  derived and/or modified CDS sequence (opt3) from DENV-2__EU482578__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccgaaaaggacuccccugucaacaucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaccaaguguucggcgcuauuuacggagcggcauuuaguggcguaagcuggacuaugaaaaucuugauaggggucaucauuaccuggaucggaaugaacuccagaucuacgagccugucagugagucucguucuggugggcgucgugacacuuuaucugggugccaugguacaggcugacuccgggugugugguuagcuggaagucuaaagaauugaagugcggaucaggcauuuucaucaccgauaauguccacacuuggacagagcaguacaaguuucagcccgaaaguccaagcaaacucgccuccgcaauacaaaaggcccaugaggaagguauuuguggcaucaggucugugacccggcuggagaacuuaauguggaaacagauuacucccgagcugaaucacauccuaucggaaaacgaggugaagcucaccauaaugacaggggacaucaaaggaauuaugcaggcuggcaagcgcagccugagaccucagccaacggaacuuaaauauuccuggaagaccugggggaaggccaaaauguugucaacugagagucauaaucaaacauuccugaucgauggaccggaaaccgcagagugccccaacacaaauagggcguggaacucucucgaggucgaagacuacggcuuugguguuuucacuaccaauauuuggcugaaguuacgugagaaacaggacguguuuugugauagcaagcugauguccgcugccaucaaagacaaccgggcagugcacgccgauaugggguauuggauagaaucagcucuuaaugacacguggaagauggagaaggccagcuucauugagguaaaaucuugccacuggccuaagucccauacauuguggaguaacggaguccucgaaagcgagaugaucaucccaaaaaauuucgcaggccccgugucucagcacaacuaccgaccugguuaucauacccagacugcuggcccauggcaccuggggaagcuagaaauggauuuugacuucugugagggaaccacaguuguggucacugaagauugcggcaacagagggcccucccugaggaccacaacggccucaggaaaacucauuaccgaguggugcugucgcaguugcacucugccgccucuucgguacagaggcgaggacgguuguugguacgggauggaaaucaggccauugaaggagaaggaagagaaucuggugaacagcuuaguuacagcgggacauggccaaauugauaauuuuucgcucggugugcugggcauggcccuuuuccuggaagagauguugcgcacccgaguagggacuaaacacgcuauacuccuggucgcaguguccuuugugacacuaaucaccggaaacaugucuuuccgggaccugggccgugucaugguuauggugggggccacgaugacugaugacauuggaaugggcguaaccuaucucgcucugcuugccgcauuuaaggugagacccacauucgcggccgguuugcuguuaaggaaacucaccagcaaggagcugaugauggcuacuaucgggauugcccuucugucacagaguacaaucccugaaaccauacuagagcucacagaugcacuggcuuugggaaugaugguccugaaaaucgugcgcaauauggaaaaguaccaguuagccguuacuauuauggcaaucuccugcgugcccaacgccgucauucuccaaaaugcuuggaaggugucuuguaccauccuggcggccguuagcguguccccacuucuguugacgucaagccagcagaaagcagacuggauaccucucgcucugacaauuaagggccuaaaccccaccgccaucuuucugacuacccuuagucggacaucuaaaaagagauccuggccacucaaugaggccaucauggcugucggcaugguaagcauucuggcaucgucauugcugaaaaacgacauaccgaugacugggccuuuaguggccggaggucuccugaccguuugcuaugugcuuacgggcaggucugcggaucuggaauuggagcgagcugccgacgucaagugggaggaucaggcagaaaucaguggguccagccccauucucucuaucacaauuagcgaggacggauccaugucaaucaaaaaugaagaggaggaacaaacccugacuauacuaauccgcacaggccugcuugugauuagugguguauucccagugagcauccccauuaccgccgcugcaugguaccucugggaggucaagaagcagcgggccgggguucugugggaugugccuucuccacccccugugggaaaagcggaauuggaggacggcgcuuauagaaucaagcagaggggcauauuaggguacucccagauuggagccggugucuauaaagaaggcacuuuucacacaauguggcaugugacccguggggcaguucugaugcaccgcggaaagcggaucgagccgucaugggccgauguaaaaaaggaccucaucaguuacggcgguggguggaagcuggagggagaauggaaagagggcgaagaggugcaaguccuugcucuggaaccaggcaagaaccccagagccgugcagacgaaaccuggguuguucaagacuaauaccggaacaauuggugcaguuagccuagauuuuuccccaggcaccucugggucgcccaucguggacaggaaaggaaaggucgugggccuguacgguaacgggguagucacacgaagcggagcuuaugugucagccauagcgcagacugagaaguccauugaggauaauccugaaaucgaggacgauauuuuccggaaaaagcgccucaccaucauggaccugcauccgggcgccggcaaaacgaagagauaccuucccgcaauaguuagggaagcuauuaaacggggguuacgaacacugauccucgccccaacuagaguggucgcugcagagauggaagaggccuugcgcggacugccuaucagguaucagacccccgccauucgugcugagcacacaggucgggaaaucguggaccucaugugucaugcgaccuucacuaugagacugcuuaguccaguuagggugccuaacuacaaccugauuauaauggaugaggcacacuuuaccgaccccgccucuaucgcugcccgcggcuauauuagcacacgagucgaaaugggggaggcagccggaaucuucaugacggcuacuccaccgggcuccagagauccuuuuccccaaucaaaugcgccaaucauggacgaggaacgggagauucccgaaaggucuuggaacagcggucacgagugggugaccgauuucaaggggaagacaguaugguuugugccuaguauaaaagccggaaaugacaucgcagcuugcuugcgcaagaacggcaaaaagguuauucagcuaucccguaaaaccuucgauagcgaauacgucaagacuagagccaaugacugggauuuuguggugacaaccgacaucucugagaugggcgcaaacuucaaggccgagcgggucauugauccaaggcgcuguaugaaacccguaauccugacggacggggaagagcgagugauacucgcuggaccuaugccgguuacucauucauccgccgcgcagagacgggguaggaucggccgcaauccaaagaacgaaaaugaccaauauauuuacaugggggagcccuuagaaaacgaugaggacugcgcacacuggaaagaggccaagaugcugcuugauaauaucaacacaccugaaggaauuauccccaguauguuugagccagaaagagagaaaguggacgcuauagauggcgaauacaggcugcggggugaggcccguaagaccuucgucgaccucaugcgccgaggggauuugccuguguggcuggcuuauagaguugcagccgagggcauuaauuacgcugacaggcggugguguuuugauggaaucaaaaacaaucagauucucgaagagaacguggaagucgagaucuggaccaaggagggcgaacgcaagaaacugaagcccagauggcuugacgccaggauauauagcgauccacuagcacugaaagaguucaaggaauucgcggccgggcggaaaucguugacuuuaaaccugaucacagagaugggacgacucccuaccuuuaugacacagaaggcuagagacgcccuggauaaucuugcagugcugcauacugcugaagccgguggccgcgcauacaaccacgcccucucugaguugccggagacgcuggaaacccuacugcuccuuacacuguuagcuacuguaaccgggggaauuuucuuguuucugauguccggcaaggguaucgggaaaaugacacucggcaugugcugcauuaucaccgcgagcauacugcuuugguaugcccagauucaaccccacuggaucgcagcuucaaucauucuggaguucuuucucaucguguugcugauaccagaaccugagaagcagaggacuccccaggacaaucaguuaacguacguugucauugccauccuaaccgugguggccgcaacaauggcuaacgaaaugggauuccuggagaaaacuaagaaagaccucggccuugggaguauuaccacacaagagucugaauccaauauccuggauauagacuugcggccagccagcgcguggacccuguaugcugucgccacuacauuuguuacgccuaugcuccgucauucaaucgagaacaguagcgugaauguaucccugaccgcaauugccaaccaggcuacugugcuuaugggacucgguaagggcuggccccugucuaagauggauaucggggucccguugcuggcaauuggauguuacagccaggugaauccaaucacauuaaccgccgcgcuacugcuccuuguugcucacuacgccauuaucggcccuggucugcaggcaaaagccaccagagaagcucaaaagagggccgcagcugggauaaugaaaaaccccacaguggacggcauuacugucaucgauuuggagccaauccccuaugacccuaaguucgaaaaacagcugggacagguaaugcuccugauucuuugcgugacgcagguuuuaaugaugcgcaccacaugggcccugugugaggcgcucacuuuggccaccggcccgauauccacacugugggaggggaaucccggacgguuuuggaacaccacuaucgcagugucaauggcuaauauuuuccgaggcucuuaccuagccggugcagggcugcucuuuaguaucaugaagaacacgacaaauaccagaaggggaacuggcaacauuggugaaacccuuggcgagaaguggaaaucgcgccugaaugcuuuggggaagagcgaauuccaaaucuauaaaaaguccggaauacaggaggucgaucggacacuggccaaagagggcaucaagagaggggaaacugaccaucacgccgugucucguggaucagcgaaacucaggugguuugucgagcggaacauggugaccccagaaggcaagguuguggaucuggguugcgggcgcggaggcuggagcuacuauugugguggcuuaaagaacguacgagaggugaaagggcuuacaaagggaggcccugggcaugaagagcccauuccuauguccacguacggauggaaucuggucagacuccagaguggcguugacguguucuucaccccacccgagaaaugcgauacucuacugugugacaucggugaaucuagcccuaacccaacaauugaggcugggaggaccuugcggguccugaaucucguggaaaacuggcuuaauaacaauacucaauuuugcaucaagguacugaaccccuauaugccgucagugauagagaaaauggaaacauugcagcgcaaguacggaggcgcacugguuagaaauccucucuccaggaacaguacccacgagauguacugggugagcaaugccacgggcaacauugucucuuccgugaauaugaucucacgaauguuaaucaaccgguucaccaugaagcacaaaaaggcuacauaugagccagaugucgaccuggggagcggaacucguaauauugguauagaaucggagauccccaaccuugacauuaucggcaaaagaauugaaaagaucaaacaggagcaugaaaccucuuggcacuacgaucaggaccauccuuauaagacaugggccuaccacgggaguuaugagacuaagcaaaccggauccgcaagcucaauggugaacggcguuguacgccugcuaacaaaaccaugggaugugguccccauggugacccagauggccaugacugacacgacaccguuuggucagcagaggguuuucaaggagaaaguggauacccggacucaagaaccuaaggaggggaccaaaaagcucaugaagauaacagcugaauggcuguggaaagaguugggaaagaaaaagacgcccagaauguguacccgcgaggaauuuacuaggaaaguccgauccaaugcggcccugggcgcaaucuucacagacgagaacaaguggaaaucugcucgggaagccguggaggauagcagauuuugggaacucauugacagggagcgcaaucuucaccuggagggcaagugcgaaaccuguguauacaacaugauggggaagcgugagaaaaaguuaggagaauucgguaaagcaaagggcagucgggccaucugguauauguggcugggggcuagauuuuuggaguucgaagcccucggauuucugaaugaggaucauugguucuccaggggcaacagccuaucugguguggagggggaaggacuucaccgccugggcuacauucuccgagacguuucaaaaaaggagggcggggcgauguacgcagaugacacugccggaugggacacacggaucacccuggaagauuugaagaaugaggaaauggucacaaaccauaugaaaggugagcacaagaaacuggcugaggccauuuuuaagcucacuuaucagaauaaaguggugagaguccagaggccaaccccucgcggcacgguuauggacauaaucaguagacgggaucagaggggguccggacaagugggcaccuacggucuuaacacauucacuaauauggaagcacagcugauucgucagauggagggggaaggaaucuucaagagcauccaacauuuaaccguaacagaggagauugcugugcagaacuggcuggcccgagucggccgcgaaagauugucucggauggcuauaucgggcgacgauugcgugguuaagccccucgacgauagguuugccucagcacugacugcgcuaaaugacauggggaaagugcgcaaggauauccagcagugggagccaagcagaggauggaacgacuggacccaaguccccuucugcucccaccacuuucaugaacuugugaugaaagauggucggguacugguugugccuuguaggaaucaggacgagcucauuggccgagcccguaucagucagggggcuggauggucucugaaggaaacggccugcuugggcaaaagcuaugcacagauguggacauuaauguacuuccacagacgcgaucugcggcucgcugccaacgcaauuuguuccgccgucccaucacauugggugccgaccaguaggacuacauggucuauccacgcgaagcacgaguggaugaccacugaggacaugcuugcuguguggaacagagucuggauacaagaaaaucccuggauggaggacaagaccccuguugaaagcugggaggaagugccauaucuggguaaacgcgaggaucaguggugcgggucccuaaucggacugacaucacgggccacgugggcaaagaacauucagaccgccaucaaucagguaaggagccucauuggcaacgaggaauacacugacuauaugcccucuaugaaacgauuuagacgggaggaagaggaagcuggcguguugugguga

SEQ ID NO: 14651 - RNA, 9876 nt, Artificial Sequence
  derived and/or modified CDS sequence (opt3) from DENV-2__EU482580__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauggauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggauugagaccuggauccugcggcauccuggcuucacaauaauggccgcaaucuuggccuacaccauuggcacgacucacuuucagcgcgcucucaucuucauucugcugacagcaguugccccauccaugaccaugagaugcaucgggauaucuaacagggauuuuguggaaggagucucggguggcucauggguggacauuguacucgagcacgggagcuguguuacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuucuaugcaagcauucuaugguggauagaggcugggguaacggguguggacucuucggcaagggcgggaucgucaccugcgccauguuuacaugcaaaaagaauauggaaggaaaaguggugcagccugagaaccuggaauacaccaucgucauuacuccacacagcggugaggagcaugcuguuggcaaugacacggggaagcacggaaaagaaauaaagaucacaccgcaguccucaauuaccgaggccgaacuuacuggcuaugguaccgugacaauggaguguagucccaggaccgggcuggauuucaacgaaaugguauugcuccaaauggaggacaaagcauggcuggugcaccggcagugguuuuuagaucugccucucccauggcuucccggcgcugacacucagggaagcaauuggauccagaaggagacacuggucacguucaagaacccucaugccaaaaagcaagacgugguuguguugggcucucaggaaggggcgaugcacaccgcccuaacuggagcaacagagauacagauguccucagguaaucugcucuuuaccggccaucugaaaugccgucuucgcauggauaagcugcaauugaaagggaugagcuacaguauguguacaggaaaguucaagauugucaaagaaaucgcugagacucagcacggcaccaucgugauuagaguacaguaugagggugacgggucuccaugcaagauccccuucgaaauuauggaucucgagaaaaggcauguucugggccgguuaauaacggugaacccgaucgucaccgaaaaggacuccccugugaacauugaggccgaacccccauuuggagauagcuacaucaucauuggcgucgagccugggcagcugaaacuaaauugguucaagaagggaucgucuauaggucaaauguuugagacaacuaugcgaggcgcuaaacgcauggccauccucggggacaccgcaugggauuucggaucccugggcgguguguuuacaucaauugggaaggcccuucaccagguuuucggcgcuaucuacggagcggcauuuaguggcgugagcuggacuaugaaaauuuucaucgggguaauaaucaccuggauuggaaugaacuccagaucuacgagcuugucagucagucuggugcucguuggcguggucacacuguaucuuggugccauggugcaggcugacuccggguguguagugagcuggaagaauaaagaacugaagugcggaucuggcaucuuuauuaccgauaacguucacacuuggacagagcaguacaaguuccaacccgaaucaccaaguaaauuggccagcgcaauccagaaggcccaugaggaagguauauguggcauuagguccgucacccggcucgagaaucugauguggaaacagaucacucccgaguuaaaccacauucugucugaaaaugaggugaagcuaaccaucaugacaggggacauaaaaggaaucaugcaggcuggcaagcgcucgcucagaccucaaccaacggaacugaaauauagcuggaagaccugggggaaggccaaaaugcuuuccacugagucacauaaccagacauuuuugauugauggaccggaaaccgcagagugccccaauacaaacagggcguggaauagucuggagguggaagacuacggcuucggugucuuuacuaccaacaucuggcucaagcugcgugagaaacaggacguuuucugugauucuaaguuaaugagcgcugccauuaaagacaaucgggcagugcacgccgauaugggguauuggaucgaauccgcucugaacgacacguggaagauggagaaggccucauucauagaggugaaaagcugccacuggccuaagucucauacacuuugguccaauggaguauuggaaagugagaugauuaucccaaaaaacuuugcaggccccgucagccagcacaacuaccgaccugguuaucauacccaaacugcuggcccauggcaccucgggaagcuggaaauggauuucgacuuuugugagggaaccacagugguugugacugaagauugcggcaauagagggcccucucuaaggaccacaacggccuccggaaaacugaucaccgaguggugcugucgcucaugcacucucccgccucugcgguacagaggcgaggacgguuguugguacgggauggaaauuaggccacuuaaggagaaggaagagaacuuggucaauagucuggugacagcgggacauggccagaucgauaacuucagcuuagguguucucggcauggcccuguuucuugaagagaugcugcgcacccgaguggggacuaaacacgcuauuuugcucguagcagucucguucgugacacugauaaccggaaauauguccuuucgggaccuaggccgugugauggucaugguuggggccacgaugacugaugacaucggaaugggcgugaccuaucuggcucuccuggccgcauucaagguaagacccacauuugcggccggucuuuugcugaggaaauuaaccucuaaggagcucaugauggcuacuauugggaucgcccugcuuagccagucaacaauuccugaaaccauccuggagcuaacagaugcacucgcucugggaaugaugguguugaaaauaguccgcaacauggaaaaguaccaacuggccgugacuaucauggcaauuaguugcguucccaaugccgugaucuuacagaacgcuuggaaggucuccuguaccauucucgcggccgugucuguuagcccacugcuucugacguccucacagcagaaagcagacuggaucccuuuggcucucacaauaaagggccugaaucccaccgccauuuuccuaacuacccugagccggacaaguaaaaagagaucuuggccacuuaacgaggccaucauggcugugggcauggucuccauccucgcaagcucgcuguugaaaaaugacauuccgaugacugggccucugguagccggagguuuacucaccgugugcuauguucugacgggcaggucagcggaucuugaacuggagcgagcugccgacgugaagugggaggaucaagcagaaauaucugggaguucccccaucuugagcauuacaaucucugaggacggaagcauguccauuaaaaacgaagaggaggaacagacccucacuauccugauacgcacaggccuacuggucaucucagguguguuuccaguaaguauucccaucaccgccgcugcaugguaccuuugggaggugaagaagcagcgggccgggguccucugggauguuccuagcccacccccugugggaaaagcggaacuggaggacggcgcuuauagaauuaagcagaggggcaucuugggguacucucaaauaggagccgguguguauaaagaaggcacuuuccacacaauguggcaugucacccguggggcaguguuaaugcaccgcggaaagcggauugagccguccugggccgauguuaaaaaggaccugaucucauacggcgguggguggaagcucgagggagaauggaaagagggcgaagagguacaggugcuggcucuugaaccaggcaagaaucccagagccguccagacgaaaccugggcuguuuaagacuaacaccggaacaaucggugcagugaguuuggauuucagcccaggcaccuccgggucucccauuguugacaggaaaggaaagguggucggccuauacgguaauggggugguaacacgaucgggagcuuaugucagcgccaucgcgcagacugagaagucaauagaggauaacccugaaauugaggacgauaucuuccggaaaaagcgccugaccauuauggaccuccauccgggcgccggcaaaacgaagagauaccugcccgcaaucgugagggaagcuauaaaacgggggcuucgaacauuaauucuggccccaacuagaguuguggcugcagagauggaagaggcccuccgcggauugccuaucagguaucaaacccccgccauccgugcugagcacacaggucgggaaauugucgaccugaugugucaugcgaccuuuacuaugagacuccuguccccagugaggguuccuaacuacaaucuuaucauuauggaugaggcacacuucaccgaccccgccaguauagcugcccgcggcuauaucucuacacgaguggaaaugggggaggcagccggaauuuuuaugacggcuacuccaccgggcagcagagauccuuucccccaguccaacgcgccaaucauggacgaggaacgggagauccccgaaaggucauggaauucuggucacgagugggucaccgauuuuaaggggaagacagugugguucguaccuagcauuaaagccggaaacgacauagcagcuugccugcgcaagaauggcaaaaaggugauccaguugagucguaaaaccuuugauuccgaauacguuaagacuagagccaacgacugggauuucgucgugacaaccgacauuagcgagaugggcgcaaauuuuaaggccgagcgggugaucgauccaaggcgcuguaugaaacccgucauucuaacggacggggaagagcgaguaauccuggcuggaccuaugccggugacucauucuucagccgcgcaaagacgggguaggauaggccgcaacccaaagaaugaaaacgaccaguauaucuacaugggggagccccucgaaaaugaugaggacugcgcacacuggaaagaggccaagauguuacuggauaacauuaauacaccugaaggaaucauucccuccauguucgagccagaaagagagaaaguugacgcuaucgauggcgaauacaggcuucggggugaggcccguaagaccuuuguggaccugaugcgccgaggggaucucccugucugguuggcuuauagaguggcagccgagggcauaaacuacgcugacaggcggugguguuucgauggaauuaaaaauaaccagauccuggaagagaacguugaaguggagauuuggaccaaggagggcgaacgcaagaaacucaagcccagauggcuggacgccaggaucuauagugauccacuugcacuaaaagaguucaaggaauuugcggccgggcggaaaagccugacuuugaauuuaauaacagagaugggacgacugccuaccuucaugacacagaaggcuagagacgcccucgauaaccuggcaguccuucauacugcugaagccgguggcaaggcauacaaucacgcccugucggagcucccggagacguuggaaacccugcuacugcucacacuucuggcuacugugaccgggggaaucuuuuuauucuugaugucuggcaaagguauugggaagaugacacugggcaugugcugcaucauuaccgcguccauccuccugugguaugcccaaauacagccccacuggauugcagcuagcaucauccuugaguuuuuccugauuguacucuugaucccagaaccugagaaacagcgcacuccccaggacaaccaacugacguacgugguuauagccauuuuaaccgucguggccgcaacaauggcuaaugaaaugggauuucuagagaagacuaaaaaggaccugggccucgggucaaucaccacacaggagagugaaucuaacauucuugauaucgaccugaggccagccuccgcguggaccuuguaugcuguggccacuacauucgucacgccuaugcugcggcauagcauagagaauucaaguguuaacgugagccucaccgcaaucgccaaucaggcuacuguacugaugggacuugguaagggcuggccccucuccaaaauggauauuggggugccgcuguuggcaaucggauguuacucucaggucaacccaauuacacugaccgccgcguuacuacugcucguggcucacuacgccaucauuggcccuggucuucaagcaaaggccacccgugaagcucagaaaagagccgcagcugggaucaugaagaaucccacaguugacggcauaacugugauugaucuggagccaauccccuaugacccuaaauuugaaaagcaguugggacaggucaugcugcucauccugugcguaacgcaagugcuuaugaugaggaccacaugggccuuaugugaggcgcugacucucgccaccggcccgauuagcacauugugggaggggaaccccggacgcuucuggaauaccacuauagcaguuuccauggcuaacaucuuucggggcucauaccuggccggugcagggcuacuguucucuauuaugaagaauacgacaaacacccgaagaggaacuggcaauaucggugaaacccucggcgagaaauggaagaguaggcuuaacgcucuggggaaaucggaauuucagauuuauaagaaaagcggaauccaggagguggaucgcacauuggccaaggagggcauaaaacggggggaaacugaccaucacgccgucuccagaggaucugcgaagcugcguugguucguggagaggaacauggucaccccagaaggcaaggugguugaucucgguugcgggcggggaggcuggucauacuauugugguggccugaaaaaugugcgcgagguaaagggguuaacaaaaggaggcccugggcaugaagagcccaucccuaugagcacguacggauggaaccuugugcgacugcaauccggcgucgacguuuucuuuaccccacccgagaagugcgauacucuccuaugugacauuggugaaaguucuccuaauccaacaaucgaggcugggagaacccugaggguguugaaccuggucgaaaauuggcucaacaauaacacucaguucugcauuaaagugcuuaaucccuauaugccgagcguaaucgagaagauggaaacacugcagcggaaguacggaggcgcauuggugcgcaacccucugucaagaaauuccacccacgagauguacuggguuaguaacgccacgggcaauauagugagcucugucaacaugauuuccaggaugcucaucaaucgauuuaccaugaaacacaagaaagcuacauaugagccagauguggacuuagggucaggaacucggaacaucgguauugaaagcgagauacccaaccuggacaucauuggcaagcguaucgaaaaaauuaagcaggagcaugaaaccucguggcacuacgaucaagaccauccuuauaagacaugggccuaccacgggucuuaugagacuaaacagaccggaagugcauccagcauggucaauggcgugguuagacuucugacaaagccaugggauguagugcccauggucacccagauggccaugacugacacgacaccguucggucagcaacgcguguuuaaagagaagguugauaccaggacucaggaaccuaaagaggggaccaagaagcuaaugaaaaucacagcugaauggcucuggaaggagcugggaaaaaagaaaacgccccggauguguaccagagaggaauucacucgcaaggugaggucaaacgcggccuugggcgcaauauuuacagacgagaauaaauggaaguccgcucgagaagccgucgaggauucucgguucugggaacugguggacagagagaggaaccuccaccuugagggcaagugcgaaaccuguguauacaauaugauggggaaacgcgagaagaaacugggagaauuugguaaggcaaaaggcagccgugccaucugguauaugugguuaggggcucgguuccuggaguuugaagccuugggauuccucaacgaggaucauugguuuaguagaggcaauucccugagcgguguggagggggaaggacuacacaggcuuggcuacauucugcgcgacguuucuaagaaggagggcggggcgauguacgcagaugacacugccggaugggacacacgaaucacccucgaagaucugaaaaacgaggaaauggucacaaaucauaugaagggugagcacaaaaaguuggcugaggccauuuucaaacugacuuaucagaacaagguggugcggguccagagaccaaccccuaggggcacgguuauggacaucauuucacgcagagaucaacgggggaguggacaggugggcaccuacggucucaauacauucacuaacauggaagcacagcuuauaaggcaaauggagggggaaggaaucuuuaaguccauucagcaucugaccguaacagaggagaucgcugugcagaauugguuagcccgugucggccgagaacgccugagcagaauggcuaucucuggcgacgauugcgugguuaaacccuuggacgaucgguucgccucggcacucacugcgcugaacgacauggggaaggugaggaaagauauucagcaaugggagccaucacgcggauggaaugacuggacccagguccccuuuugcagccaccacuuccaugaacuagugaugaaggaugguagaguacuuguugugccuugucggaaccaggacgagcugauaggcagggcccgaaucucccagggggcuggauggagucucaaagaaacggccugccugggcaagucuuaugcacaaauguggacauugauguacuuucaccguagagauuuacgccuggcugccaacgcaauuuguagcgccgucccaucccauugggugccgaccucacggacuacauggaguauccacgcgaagcacgaguggaugaccacugaggacaugcucgcuguguggaauagggucuggauucaggaaaaccccuggauggaggacaaaaccccuguugaaucuugggaggaagugccauaucuugguaagagagaggaucaguggugcgggagccugaucggacuaacaucccgcgccacgugggcaaaaaauauacagaccgccaucaaccaaguacggucacugauuggcaaugaggaauacacugacuauaugcccagcaugaagagguuccgaagagaggaagaggaagcuggcgugcucugguga

SEQ ID NO: 14652 - RNA, 9876 nt, Artificial Sequence
  derived and/or modified CDS sequence (opt3) from DENV-2__EU482581__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccggaaaggacuccccugucaacaucgaagccgagcccccauuuggcgauagcuacaucauuauagggguggaaccuggacagcugaaacuaaauugguucaagaaggguucgucuaucggccagauguuugagacaacuaugcgaggggcuaaacgcauggccauucucggagacaccgcaugggauuucggcucccugggugggguuuuuacaucaaucggcaaggcccuucaccaaguguucggagcuauuuacggcgcggcauuuagugggguaagcuggacuaugaaaaucuugauaggagucaucauuaccuggaucggcaugaacuccagaucuacgagccugucagugagucucguucuggugggugucgugacacuuuaucugggggccaugguacaggcugacuccggaugugugguuagcuggaagucuaaagaguugaagugcggcucagguauuuucaucaccgauaauguccacacuuggacagaacaguacaaguuucagcccgagaguccaagcaaacucgccuccgcaauacaaaaggcccaugaagagggcauuugugggaucaggucugugacccggcuggaaaacuuaauguggaaacagauuacucccgagcugaaucacauccuaucggagaacgaagugaagcucaccauaaugacaggagacaucaaaggcauuaugcaggcugggaagcgcagccugagaccucagccaacggagcuuaaauauuccuggaagaccuggggaaaggccaaaauguugucaacugaaagucauaaucaaacauuccugaucgauggcccggagaccgcagaaugccccaacacaaauagggcguggaacucucucgaggucgaggacuacgguuuugggguuuucacuaccaauauuuggcugaaguuacgugaaaaacaggacguguuuugugauagcaagcugauguccgcugccaucaaagacaaccgggcagugcacgccgauaugggauauuggauagagucagcucuuaaugacacguggaagauggaaaaggccagcuucauugagguaaaaucuugccacuggccuaagucccauacauuguggaguaacggcguccucgagagcgaaaugaucaucccaaaaaauuucgcaggucccgugucucagcacaacuaccgaccuggcuaucauacccagacugcugggccauggcaccugggaaagcuagagauggauuuugacuucugugaaggcaccacaguuguggucacugaggauugcgggaacagaggacccucccugaggaccacaacggccucaggcaaacucauuaccgaauggugcugucgcaguugcacucugccgccucuucgguacagaggugaggacggguguugguacggaauggagaucaggccauugaaggaaaaggaggaaaaucuggugaacagcuuaguuacagcgggccauggucaaauugauaauuuuucgcucggcgugcuggggauggcccuuuuccuggaggaaauguugcgcacccgaguaggaacuaaacacgcuauacuccuggucgcaguguccuuugugacacuaaucaccggcaacaugucuuuccgggaccuggggcgugucaugguuauggugggagccacgaugacugaugacauuggcauggguguaaccuaucucgcucugcuugccgcauuuaaggugagacccacauucgcggccggguugcuguuaaggaaacucaccagcaaggagcugaugauggcuacuaucggaauugcccuucugucacagaguacaaucccugagaccauacuagaacucacagaugcacuggcuuugggcaugaugguccugaaaaucgugcgcaauauggagaaguaccaguuagccguuacuauuauggcaaucuccugcgugcccaacgccgucauucuccaaaaugcuuggaaggugucuuguaccauccuggcggccguuagcguguccccacuucuguugacgucaagccagcagaaagcagacuggauaccucucgcucugacaauuaagggccuaaaccccaccgccaucuuucugacuacccuuagucggacaucuaaaaagagauccuggccacucaaugaagccaucauggcugucgggaugguaagcauucuggcaucgucauugcugaaaaacgacauaccgaugacuggaccuuuaguggccgguggccuccugaccguuugcuaugugcuuacggggaggucugcggaucuggaguuggaacgagcugccgacgucaagugggaggaucaggcagagaucaguggauccagccccauucucucuaucacaauuagcgaagacggcuccaugucaaucaaaaaugaggaagaggagcaaacccugacuauacuaauccgcacaggucugcuugugauuagugggguauucccagugagcauccccauuaccgccgcugcaugguaccucugggaagucaagaagcagcgggccggaguucugugggaugugccuucuccacccccugugggcaaagcggaguuggaagacggcgcuuauagaaucaagcagagggggauauuaggauacucccagauuggugccggcgucuauaaagaggggacuuuucacacaauguggcaugugacccguggagcaguucugaugcaccgcggcaagcggaucgaaccgucaugggccgauguaaaaaaggaccucaucaguuacggugggggauggaagcuggagggcgaguggaaagaaggcgaggaagugcaaguccuugcucuggagccagggaagaaccccagagccgugcagacgaaaccuggauuguucaagacuaauaccgguacaauuggcgcaguuagccuagauuuuuccccagggaccucuggaucgcccaucguggacaggaaaggcaaggucgugggucuguacgggaacggaguagucacacgaagcggcgcuuaugugucagccauagcgcagacugaaaaguccauugaggauaauccugagaucgaagacgauauuuuccggaaaaagcgccucaccaucauggaccugcauccgggcgccgggaaaacgaagagauaccuucccgcaauaguuagggaggcuauuaaacggggauuacgaacacugauccucgccccaacuagaguggucgcugcagaaauggaggaagccuugcgcggucugccuaucagguaucagacccccgccauucgugcugagcacacaggccgggagaucguggaccucaugugucaugcgaccuucacuaugagacugcuuaguccaguuagggugccuaacuacaaccugauuauaauggaugaagcacacuuuaccgaccccgccucuaucgcugcccgcggguauauuagcacacgagucgagaugggagaagcagccggcaucuucaugacggcuacuccaccggguuccagagauccuuuuccccaaucaaaugcgccaaucauggacgaggagcgggaaauucccgagaggucuuggaacagcgggcacgaaugggugaccgauuucaagggaaagacaguaugguuugugccuaguauaaaagccggcaaugacaucgcagcuugcuugcgcaagaacggcaaaaagguuauucagcuaucccguaaaaccuucgauagcgaguacgucaagacuagagccaaugacugggauuuuguggugacaaccgacaucucugaaaugggggcaaacuucaaggccgagcgggucauugauccaaggcgcuguaugaaacccguaauccugacggacggagaggaacgagugauacucgcugguccuaugccgguuacucauucauccgccgcgcagagacggggcaggaucgggcgcaauccaaagaacgagaaugaccaauauauuuacaugggagaacccuuagagaacgaugaagacugcgcacacuggaaagaggccaagaugcugcuugauaauaucaacacaccugagggcauuauccccaguauguuugaaccagagagagaaaaaguggacgcuauagauggugaguacaggcugcggggggaagcccguaagaccuucgucgaccucaugcgccgaggcgauuugccuguguggcuggcuuauagaguugcagccgagggaauuaauuacgcugacaggcggugguguuuugauggcaucaaaaacaaucagauucucgaggaaaacguggaggucgaaaucuggaccaaggagggggagcgcaagaaacugaagcccagauggcuugacgccaggauauauagcgauccacuagcacugaaagaauucaaggaguucgcggccggacggaaaucguugacuuuaaaccugaucacagaaaugggucgacucccuaccuuuaugacacagaaggcuagagacgcccuggauaaucuugcagugcugcauacugcugaggccggcgggcgcgcauacaaccacgcccucucugaauugccggagacgcuggagacccuacugcuccuuacacuguuagcuacuguaaccggaggcauuuucuuguuucugauguccgguaaggggaucggcaaaaugacacucggaaugugcugcauuaucaccgcgagcauacugcuuugguaugcccagauucaaccccacuggaucgcagcuucaaucauucuggaauucuuucucaucguguugcugauaccagagccugaaaagcagaggacuccccaggacaaucaguuaacguacguugucauugccauccuaaccgugguggccgcaacaauggcuaacgagaugggcuuccuggaaaaaacuaagaaagaccucgggcuuggaaguauuaccacacaagagucugaguccaauauccuggauauagacuugcggccagccagcgcguggacccuguaugcugucgccacuacauuuguuacgccuaugcuccgucauucaaucgaaaacaguagcgugaauguaucccugaccgcaauugccaaccaggcuacugugcuuaugggucucggcaagggguggccccugucuaagauggauaucggagucccguugcuggcaauuggcuguuacagccaggugaauccaaucacauuaaccgccgcgcuacugcuccuuguugcucacuacgccauuaucgguccugggcugcaggcaaaagccaccagagaggcucaaaagagggccgcagcuggcauaaugaaaaaccccacaguggacggaauuacugucaucgauuuggaaccaauccccuaugacccuaaguucgagaaacagcugggccagguaaugcuccugauucuuugcgugacgcagguuuuaaugaugcgcaccacaugggcccugugugaagcgcucacuuuggccaccgggccgauauccacacugugggagggaaaucccggccgguuuuggaacaccacuaucgcagugucaauggcuaauauuuuccgagguucuuaccuagccggggcaggacugcucuuuaguaucaugaagaacacgacaaauaccagaaggggcacugguaacauuggcgagacccuuggggaaaaguggaaaucgcgccugaaugcuuugggaaagagcgaguuccaaaucuauaaaaaguccggcauacaggaagucgaucggacacuggccaaagaggggaucaagagaggagagacugaccaucacgccgugucucguggcucagcgaaacucaggugguuugucgaacggaacauggugaccccagaggguaagguuguggaucuggggugcggacgcggcgguuggagcuacuauuguggcggguuaaagaacguacgagaagugaaaggacuuacaaagggcgggccuggacaugaggaacccauuccuauguccacguacggcuggaaucuggucagacuccagagugguguugacguguucuucaccccacccgagaaaugcgauacucuacugugugacaucggggagucuagcccuaacccaacaauugaagcuggaaggaccuugcggguccugaaucucguggagaacuggcuuaauaacaauacucaauuuugcaucaagguacugaaccccuauaugccgucagugauagaaaaaauggagacauugcagcgcaaguacggcggcgcacugguuagaaauccucucuccaggaacaguacccacgaaauguacugggugagcaaugccacggggaacauugucucuuccgugaauaugaucucacgaauguuaaucaaccgguucaccaugaagcacaaaaaggcuacauaugagccagaugucgaccugggaagcgguacucguaauauuggcauagagucggaaauccccaaccuugacauuaucgggaaaagaauugagaagaucaaacaggaacaugagaccucuuggcacuacgaucaggaccauccuuauaagacaugggccuaccacggaaguuaugaaacuaagcaaaccggcuccgcaagcucaauggugaacgguguuguacgccugcuaacaaaaccaugggaugugguccccauggugacccagauggccaugacugacacgacaccguuugggcagcagaggguuuucaaggagaaaguggauacccggacucaagagccuaaggaaggaaccaaaaagcucaugaagauaacagcugaguggcuguggaaagaauugggcaagaaaaagacgcccagaauguguacccgcgaggaguuuacuaggaaaguccgauccaaugcggcccugggcgcaaucuucacagacgaaaacaaguggaaaucugcucgggaggccguggaagauagcagauuuugggagcucauugacagggaacgcaaucuucaccuggaggggaagugcgagaccuguguauacaacaugaugggaaagcgugaaaaaaaguuaggugaguucggcaaagcaaaggggagucgggccaucugguauauguggcugggagcuagauuuuuggaauucgaggcccucggcuuucugaaugaagaucauugguucuccagggguaacagccuaucugggguggagggagagggccuucaccgccugggcuacauucuccgagacguuucaaaaaaggaagggggagcgauguacgcagaugacacugccgguugggacacacggaucacccuggaggauuugaagaaugaagagauggucacaaaccauaugaaaggcgaacacaagaaacuggcugaggccauuuuuaagcucacuuaucagaauaaaguggugagaguccagaggccaaccccucgcgggacgguuauggacauaaucaguagacgggaucagaggggauccggccaaguggguaccuacgggcuuaacacauucacuaauauggaggcacagcugauucgucagauggaaggagagggcaucuucaagagcauccaacauuuaaccguaacagaagagauugcugugcagaacuggcuggcccgagucggccgcgagagauugucucggauggcuauaucgggggacgauugcgugguuaagccccucgacgauagguuugccucagcacugacugcgcuaaaugacaugggaaaagugcgcaaggauauccagcagugggaaccaagcagagguuggaacgacuggacccaaguccccuucugcucccaccacuuucaugagcuugugaugaaagauggccggguacugguugugccuuguaggaaucaggacgaacucauugggcgagcccguaucagucagggagcuggcuggucucugaaggagacggccugcuuggguaaaagcuaugcacagauguggacauuaauguacuuccacagacgcgaucugcggcucgcugccaacgcaauuuguuccgccgucccaucacauugggugccgaccaguaggacuacauggucuauccacgcgaagcacgaauggaugaccacugaggacaugcuugcuguguggaacagagucuggauacaagagaaucccuggauggaagacaagaccccuguugagagcugggaagaggugccauaucuggggaaacgcgaagaucaguggugcggaucccuaaucggccugacaucacgggccacgugggcaaagaacauucagaccgccaucaaucagguaaggagccucauuggcaacgaggaguacacugacuauaugcccucuaugaaacgauuuagacgggaagaggaagaggcugggguguugugguga

SEQ ID NO: 14653 - RNA, 9876 nt, Artificial Sequence
  derived and/or modified CDS sequence (opt3) from DENV-2__EU482582__SS-prME
accgccggcgugaucauuaugcugauacccacggcuauggcuuuccaccucacuacgagaaauggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgaaccacuuucagcgcgcucucauuuucauccugcugacugcaguugccccauccaugacaaugagaugcauagggauuucuaauagggauuuuguggaaggagucucggguggcucauggguggacaucguacucgagcacgggagcuguguuaccacuauggcuaagaacaagcccacauuagauuucgaacugauuaaaaccgaggccaagcagccugcgacgcuucggaaauauugcaucgaagcaaaguugaccaauacaacuaccgagagucgcuguccaacacaaggagagcccucccugaacgaagaacaggacaaacgauuugugugcaagcauucuauggucgauagaggcugggguaauggguguggacuauucggcaagggcgggaucgugacuugcgccauguuuaccugcaaaaagaacauggaaggaaaagugguccucccugagaaucuggaauacacaauuguuauaaccccacacagcggugaggagcaugcugugggcaacgacacugggaagcacggaaaagaaaucaagauuacgccgcaguccucaaucacagaggccgaacuuaccggcuaugguacuguaaccauggaguguagucccaggacagggcuggauuucaaugaaaugguguugcuccagauggaggacaaagcauggcugguccaccggcaaugguuuuuagaucugccucucccauggcuucccggcgcugacacccagggaagcaacuggauacagaaggagacucuggugacauucaagaauccucaugccaaaaagcaggacguuguggucuugggcucucaagaaggggcgaugcacacggcccuaaccggagcaacugagauucagauguccucagguaaccugcucuuuacaggccaucugaaaugccgucuucgcauggauaagcugcaguugaaagggaugagcuacaguauguguaccggaaaguucaagaucgugaaagaaaucgcugagacacaacacggcacuauuguaaucagaguucaguaugagggugacgggucuccaugcaagauucccuucgaaauaauggaucucgagaaaaggcaugugcugggccgguuaaucaccgucaacccgauugugacggaaaaggacuccccugucaauaucgaggccgaacccccauuuggagauagcuacaucauuauaggcguggagccugggcagcugaaacuaaacugguucaagaagggaucgucuaucggucagauguuugagaccacaaugcgaggcgcuaaacgcauggccauucucggggacacugcaugggauuucggaucccugggcgguguuuuuaccucaaucgggaaggcccuucaccaaguguucggcgcuauuuacggagcgguauuuaguggcgucagcuggacaaugaaaaucuugauaggggugaucauuacuuggaucggaaugaacuccagaucuaccagccugucaguuagucucgugcuggucggcgugguaacgcuuuaucugggugcaauggugcaggccgacuccggguguguugucagcuggaagucuaaagaauugaagugcggaucaggcauuuucaucacagauaacgugcacaccuggacugagcaguacaaguuucagcccgaaaguccaagcaaacucgcuuccgccauacaaaaggcacaugaggaagguauuuguggcaucaggucugugacacggcuggagaauuuaauguggaaacagauuacccccgagcugaaccacauccuaucggaaaaugaggucaagcucacuauaaugaccggggacaucaaaggaauuaugcaggccggcaagcgcagccugagaccucagccaacagaacuuaaauauuccuggaagacgugggggaaggcuaaaauguugucaaccgagagucauaaccaaacuuuccugaucgauggaccggaaacagccgagugccccaauaccaacagggcauggaacucucucgagguugaagacuacggcuuugguguguucacaacuaacauuuggcugaaguuacgugagaaacaggacguguuuugugauagcaagcugauguccgcggcuaucaaagacaaucgggccguacacgcagauaugggguauuggauagaaucagcccuuaacgacaccuggaagauggagaaggcuagcuucauugaggucaaaucuugccacuggccuaagucccauacguuguggaguaauggagugcucgaaagcgagaugaucauccccaaaaauuucgccggccccguuucucagcacaacuaccgaccugguuaucauacacagaccgcaggcccauggcaccuggggaagcuagaaauggauuuugacuucugugagggaacuaccguggucgugacagaagauugcggcaauagagggcccucccugaggacuaccacagcuucaggaaaacucauuacggaguggugcugucgcaguugcacccugccgccucuucgguacagaggcgaggacgguuguugguacgggauggaaaucaggccauugaaggagaaggaagagaaccugguuaauagcuuagugacugccggacauggccaaauugauaacuuuucgcucgguguacugggcauggcgcuuuuccuggaagagauguugcgcacacgagucgggaccaaacacgccauacuccugguggcuguguccuuugucacucuaaucacaggaaauaugucuuuccgggaccugggccguguuauggugaugguaggggcaaccaugacggaugacauuggaaugggcgugacuuaucucgcccugcuugcugccuuuaaggucagacccaccuucgcagcggguuugcuguuaaggaaacucacaagcaaggagcugaugauggccaccaucgggauugcacuucugucacagaguacuaucccugaaacaauacuagagcucaccgaugcccuggcauugggaaugauggugcugaaaaucguucgcaacauggaaaaguaccaguuagcugugacaauuauggccaucuccugcguccccaaugcagugauucuccaaaacgccuggaagguuucuuguacuauccuggcugcggugagcgucuccccacuucuguugaccucaagccagcagaaagccgacuggauaccucucgcacugacgauuaagggccuaaaucccacagcuaucuuucugaccacucuuagucggaccucuaaaaagagauccuggccacucaacgaggccaucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacaaacacugaccauacuaauccgcacuggccugcuuguaauuagugguguguucccagucagcauccccauuacagcagccgcuugguaccucugggagguuaagaagcagcgggcaggggugcugugggaugugccuucuccacccccugucggaaaagccgaauuggaggacggcgcguauagaaucaagcagaggggcauauuaggguacucccagauuggagcugguguguauaaagaaggcaccuuucacacuauguggcauguuacacguggggccguacugaugcaccgcggaaagcggaucgagccgucaugggcagaugugaaaaaggaccucaucaguuacggcgguggguggaagcuggagggagaauggaaagagggcgaagagguccaagugcuugcccuggaaccaggcaagaaucccagagcuguucagaccaaaccuggguuguucaagacgaacacuggaaccauuggugccgugagccuagauuuuuccccaggcacaucugggucgcccaucgucgacaggaaaggaaaggugguaggccuguacgguaauggggucgugacccgaagcggagcauauguuucagcuauagcccagacagagaaguccauugaggauaacccugaaaucgaggacgauauuuuccggaaaaagcgccucacuaucauggaccugcauccgggcgcgggcaaaaccaagagauaccuucccgccauagugagggaagcaauuaaacggggguuacgaacgcugauccucgcuccaacaagagucguggccgcugagauggaagaggcauugcgcggacugccuaucagguaucagacucccgccauucgugccgagcacaccggucgggaaaucguugaccucaugugucaugcuacauucaccaugagacugcuuaguccagugagggucccuaacuacaaucugauuauaauggaugaggcgcacuuuacugaccccgcaucuaucgccgcucgcggcuauauuagcacccgaguggaaaugggggaggccgcaggaaucuucaugacagccacgccaccgggcuccagagauccuuuuccccaaucaaacgcuccaaucauggacgaggaacgggagauucccgaaaggucuuggaauagcggucacgaguggguaacugauuucaaggggaagaccgugugguuuguuccuaguauaaaagcgggaaacgacaucgccgcaugcuugcgcaagaauggcaaaaaggucauucagcuaucccguaaaacauucgauagcgaauacgugaagaccagagcuaacgacugggauuuuguggucacuacagacaucucugagaugggcgccaauuucaaggcagagcggguaauugauccaaggcgcuguaugaaacccgugauccugaccgacggggaagaacgaguuauacucgccggaccuaugccggugacgcauucauccgcugcccagagacgggguaggaucggccgcaacccaaagaaugaaaacgaccaauauauuuacaugggggagcccuuagaaaaugaugaggacugcgcgcacuggaaagaggcaaagaugcugcuugauaacaucaauacuccugaaggaauuauccccaguauguuugagccagaaagagagaaagucgacgccauagauggcgaauacaggcugcggggugaggcucguaagacauucguggaccucaugcgccgaggggauuugccuguuuggcuggccuauagaguggcugcagagggcauuaacuacgccgacaggcggugguguuuugauggaaucaaaaauaaccagauucucgaagagaacgucgaaguggagaucuggaccaaggagggcgaacgcaagaaacugaagcccagauggcuugacgcuaggauauauagcgauccacuagcccugaaagaguucaaggaguucgcagcggggcggaaaucguugaccuuaaaucugaucacugagaugggacgacucccuacauuuaugacccagaaggccagagacgcucuggauaaccuugccguacugcauacagcagaagcugguggccgcgccuacaaucacgcacucucugaguugccggagacucuggaaacgcuacugcuccuuacccuguuagccacagugacugggggaauuuucuuguuucugauguccggcaaggguaucgggaaaaugacccucggcaugugcugcauuaucacagcuagcauacugcuuugguaugcgcagauucaaccccacuggaucgccgcaucaaucauucuggaguucuuucucaucguuuugcugauaccagaaccugagaagcagaggaccccacaggacaaccaguuaacuuacgucgugauugcuauccuaacgguggucgccgccaccauggcaaaugaaaugggauuccuggagaaaacaaagaaagaccucggccuugggaguacuaccacacaagagucugaauccaacauucuggauaucgacuugcggccagcuagcgccuggacccuguaugcgguugcuacuacauuugugacgccuaugcuccgucauucaauagagaauaguagcguaaacgugucccugaccgccaucgcaaaucaggccacuguccuuaugggacucgguaagggcuggccccugucuaagauggauauuggggugccguugcuggcuaucggauguuacagccagguuaacccaauuacauuaaccgcagcccuacugcuccuuguggcgcacuacgcuaucauuggcccuggucugcaggccaaagcaaccagagaagcccaaaagagggcugccgcagggaucaugaaaaaucccacagucgacggcauaacuguaauugauuuggagccaauccccuaugacccuaaguucgaaaaacagcugggacaggugaugcuccugauccuuugcguuacacagguguuaaugaugcgcaccacaugggcucugugugaggcccucacuuuggcgaccggcccgauuuccacacugugggaggggaaccccggacgguuuuggaauaccacuauagccgucucaauggcaaacaucuuccgaggcucuuaccuagcuggugccgggcugcucuuuaguauuaugaagaauacgacaaacaccagaaggggaacuggcaauaucggugaaacccuuggcgagaaguggaaaucgcgccugaacgcauugggaaagagcgaguuccaaauuuauaaaaaguccggaauccaggagguggaucggacacuggcuaaagagggcauaaagagaggggaaacugaccaucacgccgucucucguggaucagccaaacucaggugguuuguggagcggaacaugguuaccccagaaggcaaggugguagaucuggguugcgggcgcggaggcuggagcuacuauugugguggcuuaaagaaugugcgagaggucaaagggcuuacaaagggaggcccugggcaugaagaacccaucccuauguccacguacggauggaaccugguuagacuccagaguggcguggacgucuucuucaccccacccgagaaaugcgauacucuacugugugacauuggugaaucuagcccuaauccaacaaucgaggcggggaggaccuugcgggugcugaaccucguagaaaauuggcuuaacaauaacacucaauuuugcauuaaggugcugaaucccuauaugccgucaguuaucgagaaaauggaaacauugcagcgcaaguacggaggcgcucuggugagaaacccucucuccaggaauaguacccacgagauguacugggucagcaacgcaacgggcaauauagugucuaccgucaacaugauuucccgaauguuaaucaaucgguucacaaugaagcacaaaaaggccacuuaugagccagauguggaccuggggucaggaacccguaacaucgguauugaaagcgagauacccaaccuugacaucauuggcaaaagaaucgaaaagauuaaacaggagcaugaaacaucguggcacuacgaucaggaccauccuuauaagacuugggcuuaccacgggucuuaugagaccaagcaaacaggaagugccuccagcaugguuaauggcguagugcgccugcuaaccaaaccaugggaugucgugcccaugguuacucagauggcaaugacggacacaaccccguuuggucagcagaggguguucaaggagaaagucgauacucggacccaagaaccuaaggaggggacgaaaaagcucaugaagaucacagccgaauggcuguggaaagaguugggaaagaaaaagacccccagaauguguacucgcgaggaauuuacaaggaaagugcgaucaaacgcugcgcugggcgccauauucaccgacgagaauaaguggaaauccgcacgggaagcuguagaggauucuagauuuugggaacucaucgacagggagcgcaaccuucaccuggagggcaagugcgaaacuuguguguacaauaugauggggaagcgugagaaaaaguuaggagaguucgguaaagccaagggcagccgggcaauuugguauauguggcugggggccagauuuuuggaguucgaagcucucggauuucugaacgaggaucauugguucaguaggggcaauucccuaagcgguguugagggggaaggacuucaccgccugggcuacauccuccgagacgucucuaaaaaggagggcggggccauguacgcggaugacacagcaggaugggacacccggauuacacuggaagauuugaagaacgaggaaauggugacuaaucauaugaaaggugagcacaagaaacuggccgaggcuaucuuuaagcucaccuaucagaacaaaguggucagaguucagaggccaacgccucgcggcaccgugauggacauuauaucaagacgggaucagagggggaguggacaaguaggcacauacggucuuaauacuuucaccaacauggaagcccagcugauccgucagauggagggggaaggaauuuucaaguccauccaacauuuaacagugacugaggagaucgcaguccagaauuggcuggcucgagugggccgcgaaagauugagccggauggccauuucuggcgacgauugcguugugaagccccucgacgauagguuugcuucggcccugaccgcacuaaacgacauggggaaaguccgcaaggauauacagcagugggagccaucaagaggauggaaugacuggacgcaagugcccuucugcagccaccacuuucaugaacuuguaaugaaagauggucggguucugguggucccuuguaggaaccaggacgagcucaucggccgagcgcguauuucccagggggccggauggagucugaaggaaacagcuugcuugggcaaaucuuaugcccagauguggaccuuaauguacuuccacagacgcgaucugcggcucgcagcuaacgccaucuguagcgcagugccaucccauugggugccgacuucaaggacaaccuggaguauucacgccaagcacgaguggaugacuaccgaggacaugcuugcggucuggaauagaguuuggauccaagaaaaccccuggauggaggacaagacaccuguggaaucuugggaggaaguaccauaucuggguaaacgcgaggaucaguggugcgggagccuaauaggacugacgucccgggcuaccugggccaagaauauccagacugcaauuaaccaggugaggucacucaucggcaaugaggaauacacagacuauaugcccagcaugaaacgauuuagacgggaggaagaggaagccggcgucuugugguga

SEQ ID NO: 14654 - RNA, 9876 nt, Artificial Sequence
  derived and/or modified CDS sequence (opt3) from DENV-2__EU482583__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccgaaaaggacuccccugucaacaucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaccaaguguucggcgcuauuuacggagcggcauuuaguggcguaagcuggacuaugaaaaucuugauaggggucaucauuaccuggaucggaaugaacuccagaucuacgagccugucagugagucucguucuggugggcgucgugacacuuuaucugggugccaugguacaggcugacuccgggugugugguuagcuggaagaauaaagaauugaagugcggaucuggcauuuucaucaccgauaacguccacacuuggacagagcaguacaaguuucagcccgaaucaccaaguaaacucgccagcgcaauacaaaaggcccaugaggaagguauuuguggcaucagguccgugacccggcuggagaauuuaauguggaaacagauuacucccgagcugaaccacauccuaucugaaaaugaggugaagcucaccauaaugacaggggacaucaaaggaauuaugcaggcuggcaagcgcucgcugagaccucagccaacggaacuuaaauauagcuggaagaccugggggaaggccaaaauguuguccacugagucacauaaccaaacauuccugaucgauggaccggaaaccgcagagugccccaauacaaacagggcguggaauagucucgaggucgaagacuacggcuuugguguuuucacuaccaacauuuggcugaaguuacgugagaaacaggacguguuuugugauucuaagcugaugagcgcugccaucaaagacaaucgggcagugcacgccgauaugggguauuggauagaauccgcucuuaacgacacguggaagauggagaaggccucauucauugagguaaaaagcugccacuggccuaagucucauacauugugguccaauggaguccucgaaagugagaugaucaucccaaaaaacuucgcaggccccgugagccagcacaacuaccgaccugguuaucauacccagacugcuggcccauggcaccuggggaagcuagaaauggauuuugacuucugugagggaaccacaguuguggucacugaagauugcggcaauagagggcccucucugaggaccacaacggccuccggaaaacucauuaccgaguggugcugucgcucaugcacucugccgccucuucgguacagaggcgaggacgguuguugguacgggauggaaaucaggccauugaaggagaaggaagagaaccuggugaauaguuuaguuacagcgggacauggccaaauugauaacuuuagccucggugugcugggcauggcccuuuuccuggaagagauguugcgcacccgaguagggacuaaacacgcuauacuccuggucgcagugucguuugugacacuaaucaccggaaauauguccuuccgggaccugggccgugucaugguuauggugggggccacgaugacugaugacauuggaaugggcguaaccuaucucgcucugcuugccgcauuuaaggugagacccacauucgcggccgguuugcuguuaaggaaacucaccucuaaggagcugaugauggcuacuaucgggauugcccuucugagccagucaacaaucccugaaaccauacuagagcucacagaugcacuggcuuugggaaugaugguccugaaaaucgugcgcaacauggaaaaguaccaguuagccguuacuauuauggcaaucaguugcgugcccaaugccgucauucuccaaaacgcuuggaagguguccuguaccauccuggcggccguuucugugagcccacuucuguugacguccucacagcagaaagcagacuggauaccucucgcucugacaauuaagggccuaaaucccaccgccaucuuucugacuacccuuagccggacaaguaaaaagagaucuuggccacucaacgaggccaucauggcugucggcaugguauccauucuggcaagcucguugcugaaaaaugacauaccgaugacugggccuuuaguggccggaggucuccugaccguuugcuaugugcuuacgggcaggucagcggaucuggaauuggagcgagcugccgacgucaagugggaggaucaggcagaaaucucugggaguucccccauucucagcaucacaauuucugaggacggaagcauguccaucaaaaacgaagaggaggaacaaacccugacuauacuaauccgcacaggccugcuugugauuucagguguauucccagugaguauccccauuaccgccgcugcaugguaccucugggaggucaagaagcagcgggccgggguucugugggaugugccuagcccacccccugugggaaaagcggaauuggaggacggcgcuuauagaaucaagcagaggggcauauuaggguacucucagauuggagccggugucuauaaagaaggcacuuuucacacaauguggcaugugacccguggggcaguucugaugcaccgcggaaagcggaucgagccguccugggccgauguaaaaaaggaccucaucucauacggcgguggguggaagcuggagggagaauggaaagagggcgaagaggugcaaguccuugcucuggaaccaggcaagaaucccagagccgugcagacgaaaccuggguuguucaagacuaacaccggaacaauuggugcaguuagucuagauuuuagcccaggcaccuccgggucucccaucguggacaggaaaggaaaggucgugggccuguacgguaaugggguagucacacgaucgggagcuuaugugagcgccauagcgcagacugagaagucaauugaggauaacccugaaaucgaggacgauauuuuccggaaaaagcgccucaccaucauggaccugcauccgggcgccggcaaaacgaagagauaccuucccgcaauaguuagggaagcuauuaaacggggguuacgaacacugauccucgccccaacuagaguggucgcugcagagauggaagaggccuugcgcggacugccuaucagguaucagacccccgccauucgugcugagcacacaggucgggaaaucguggaccucaugugucaugcgaccuucacuaugagacugcuuuccccaguuagggugccuaacuacaaucugauuauaauggaugaggcacacuuuaccgaccccgccaguaucgcugcccgcggcuauauuucuacacgagucgaaaugggggaggcagccggaaucuucaugacggcuacuccaccgggcagcagagauccuuuuccccaauccaacgcgccaaucauggacgaggaacgggagauucccgaaaggucauggaauucuggucacgagugggugaccgauuucaaggggaagacaguaugguuugugccuagcauaaaagccggaaacgacaucgcagcuugcuugcgcaagaauggcaaaaagguuauucagcuaagucguaaaaccuucgaugccgaauacgucaagacuagagcaaacgacugggauuuuguggugacaaccgacaucuccgagaugggcgccaauuucaaggcugagcgggucauugauccaaggcgcuguaugaaacccguaauccugacggacggggaagagcgagugauacucgccggaccuaugccgguuacucauagcucugcggcacagagacgggguaggaucggccgcaacccaaagaaugaaaacgaccaauauauuuacaugggggagcccuuagaaaaugaugaggacugcgcccacuggaaagaggcuaagaugcugcuugauaacaucaauacaccugaaggaauuauccccucaauguuugagccagaaagagagaaaguggacgccauagauggcgaauacaggcugcggggugaggcucguaagaccuucgucgaccucaugcgccgaggggauuugccuguguggcuggcauauagaguugccgcugagggcauuaacuacgccgacaggcggugguguuuugauggaaucaaaaauaaccagauucucgaagagaacguggaagucgagaucuggaccaaggagggcgaacgcaagaaacugaagcccagauggcuugacgcaaggauauauuccgauccacuagcgcugaaagaguucaaggaauucgccgcugggcggaaaaguuugacuuuaaaucugaucacagagaugggacgacucccuaccuuuaugacacagaaggccagagacgcacuggauaaccuugcugugcugcauacugccgaagcagguggccgcgccuacaaucacgcucucagcgaguugccggagacgcuggaaacccuacugcuccuuacacuguuagcgacuguaaccgggggaauuuucuuguuucugaugucgggcaaggguaucgggaaaaugacacucggcaugugcugcauuaucaccgccucuauacugcuuugguaugcacagauucaaccccacuggaucgcugccuccaucauucuggaguucuuucucaucguguugcugauaccagaaccugagaagcagaggacuccccaggacaaccaguuaacguacguugucauugccauccuaaccgugguggcagcuacaauggccaaugaaaugggauuccuggagaaaacuaagaaagaccucggccuugggagcauuaccacacaagagucagaaaguaacauccuggauauagacuugcggccagcgucugcuuggacccuguaugccgucgcaacuacauuuguuacgccuaugcuccgucauuccaucgagaauagcucagugaacguaagucugaccgccauugcuaaucaggcaacugugcuuaugggacucgguaagggcuggccccugagcaagauggauaucggggucccguugcuggccauuggauguuacucccaggugaacccaaucacauuaaccgcggcucuacugcuccuuguugcccacuacgcaauuaucggcccuggucugcaggccaaagcuaccagagaagcccaaaagagggcagcugccgggauaaugaaaaaucccacaguggacggcauuacugucaucgauuuggagccaauccccuaugacccuaaguucgaaaaacagcugggacagguaaugcuccugauucuuugcgugacgcagguuuuaaugaugcgcaccacaugggcgcugugugaggcccucacuuuggcaaccggcccgauaucuacacugugggaggggaaccccggacgguuuuggaauaccacuaucgcugugagcauggccaacauuuuccgaggcuccuaccuagcaggugcugggcugcucuuuucaaucaugaagaauacgacaaacaccagaaggggaacuggcaauauuggugaaacccuuggcgagaaguggaaaucucgccugaacgccuuggggaagagugaauuccaaaucuauaaaaagucgggaauacaggaggucgaucggacacuggccaaagagggcaucaagagaggggaaacugaccaucacgcggugagccguggauccgcuaaacucaggugguuugucgagcggaacauggugaccccagaaggcaagguuguggaucuggguugcgggcgcggaggcuggucuuacuauugugguggcuuaaagaauguacgagaggugaaagggcuuacaaagggaggcccugggcaugaagagcccauuccuaugucaacguacggauggaaccuggucagacuccagagcggcguugacguguucuucaccccacccgagaaaugcgauacucuacugugugacaucggugaauccaguccuaauccaacaauugaggcagggaggaccuugcggguccugaaccucguggaaaauuggcuuaacaauaacacucaauuuugcaucaagguacugaaucccuauaugccgucugugauagagaaaauggaaacauugcagcgcaaguacggaggcgcccugguuagaaacccucucagcaggaauucaacccacgagauguacuggguguccaacgcuacgggcaauauugucaguagcgugaacaugaucucucgaauguuaaucaaucgguucaccaugaagcacaaaaaggccacauaugagccagaugucgaccugggguccggaacucguaacauugguauagaaucagagauccccaaccuugacauuaucggcaaaagaauugaaaagaucaaacaggagcaugaaaccagcuggcacuacgaucaggaccauccuuauaagacaugggcauaccacgggucguaugagacuaagcaaaccggaucugccaguuccauggugaauggcguuguacgccugcuaacaaaaccaugggaugugguccccauggugacccagauggcuaugacugacacgacaccguuuggucagcagaggguuuucaaggagaaaguggauacccggacucaagaaccuaaggaggggaccaaaaagcucaugaagauaacagcggaauggcuguggaaagaguugggaaagaaaaagacgcccagaauguguacccgcgaggaauuuacuaggaaaguccgaagcaacgccgcacugggcgcuaucuucacagacgagaauaaguggaaaucagcccgggaagcaguggaggauuccagauuuugggaacucauugacagggagcgcaaccuucaccuggagggcaagugcgaaaccuguguauacaauaugauggggaagcgugagaaaaaguuaggagaauucgguaaagccaagggcucucgggcuaucugguauauguggcugggggccagauuuuuggaguucgaagcgcucggauuucugaacgaggaucauugguucagcaggggcaauagucuauccgguguggagggggaaggacuucaccgccugggcuacauucuccgagacguuagcaaaaaggagggcggggcaauguacgccgaugacacugcuggaugggacacacggaucacccuggaagauuugaagaacgaggaaauggucacaaaucauaugaaaggugagcacaagaaacuggccgaggcaauuuuuaagcucacuuaucagaacaaaguggugagaguccagaggccaaccccucgcggcacgguuauggacauaaucucuagacgggaucagagggggucaggacaagugggcaccuacggucuuaauacauucacuaacauggaagcucagcugauucgucagauggagggggaaggaaucuucaagaguauccaacauuuaaccguaacagaggagauugccgugcagaauuggcuggcucgagucggccgcgaaagauugucccggauggccauaagcggcgacgauugcgugguuaagccccucgacgauagguuugcaucugcgcugacugcccuaaacgacauggggaaagugcgcaaggauauccagcagugggagccaucgagaggauggaaugacuggacccaaguccccuucugcucacaccacuuucaugaacuugugaugaaagauggucggguacugguugugccuuguaggaaccaggacgagcucauuggccgagcucguaucagccagggggccggauggucccugaaggaaacggcaugcuugggcaaaaguuaugcucagauguggacauuaauguacuuccacagacgcgaucugcggcucgccgcaaacgccauuuguucugcggucccaagccauugggugccgaccuccaggacuacauggucaauccacgcuaagcacgaguggaugaccacugaggacaugcuugccguguggaauagagucuggauacaagaaaaccccuggauggaggacaagaccccuguugaaaguugggaggaagugccauaucuggguaaacgcgaggaucaguggugcgggucucuaaucggacugacaagccgggcaacgugggccaagaauauucagaccgcuaucaaccagguaaggucccucauuggcaaugaggaauacacugacuauaugcccucaaugaaacgauuuagacgggaggaagaggaagccggcguguugugguga

SEQ ID NO: 14655 - RNA, 9876 nt, Artificial Sequence
  derived and/or modified CDS sequence (opt3) from DENV-2__EU482585__SS-prME
accgccggcgugaucauuaugcugauacccacggcuaucgcauuccaccucacuacgcggaacggggagccucauaugauugucggaaggcaggaaaaggguaaaagccuucuguuuaagaccgaggacggcguuaauaugugcacauugauggccaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggauagagaccuggauccugcggcauccuggcuucacaauuauggccgcaaucuuggccuacaccauuggcacgacucacuuucagcgcgcucucaucuucauacugcugacagcaguugccccauccaugaccaugagaugcauugggaucucuaacagggauuuuguggaaggagucucggguggcucauggguggacauuguacucgagcacgggagcuguguuacuacaauggcuaagaauaagcccaccuuagauuucgaacugaucaaaacggaggccaagcagccugcgacccuucggaaauauugcaucgaagcaaaguugacaaacacuaccacagagagucgcuguccaacucaaggagagcccucccugaaugaggaacaggacaaacgauuugugugcaagcauucuauggucgauagaggcugggguaacggguguggacuauucggcaagggcgggauugugaccugcgccauguuuacaugcaaaaagaauauggaaggaaaagugguccucccugagaaccuggaauacaccauaguuaucacuccacacagcggugaggagcaugcugugggcaaugacacggggaagcacggaaaagaaauuaagaucacaccgcaguccucaauaaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauucagaaggagacacuggugacguucaagaacccucaugccaaaaagcaggacguuguggucuugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgugaaagaaauugcugagacucaacacggcaccaucguaauuagaguucaguaugagggugacgggucuccaugcaagauacccuucgaaaucauggaucucgagaaaaggcaugugcugggccgguuaauuacggucaacccgaucgugaccgaaaaggacuccccugucaacaucgaggccgaacccccauuuggagauagcuacauuauaaucggcguggagccugggcagcugaaacuaaauugguucaagaagggaucgucuauuggucagauguuugagacaacuaugcgaggcgcuaaacgcauggccauccucggggacaccgcaugggauuucggaucccugggcgguguuuuuacaucaauugggaaggcccuucaccaaguguucggcgcuaucuacggagcggcauuuaguggcguaagcuggacuaugaaaauauugaucggggucauuaucaccuggauuggaaugaacuccagaucuacgagccugucagugagucucguucuggugggcgucgugacacuuuaucugggugccaugguacaggcugacuccgggugugugguuagcuggaagucuaaagaauugaagugcggaucaggcaucuucauaaccgauaauguccacacuuggacagagcaguacaaguuucagcccgaaaguccaagcaaacucgccuccgcaauucaaaaggcccaugaggaagguaucuguggcauuaggucugugacccggcuggagaacuuaauguggaaacagaucacucccgagcugaaucacauacuaucggaaaacgaggugaagcucaccaucaugacagggggaauuaaaggcaucaugcaggcugggaagcgcagccugagaccucagccaacggaacuuaaauauuccuggaagaccuggggaaaggccaaaauguugucaacugagagucauaaucaaacauuccugauugacggcccggaaaccgcagagugccccaacacaaauagggcguggaacucucucgaggucgaagauuacgguuuugggguuuucacuaccaauaucuggcugaaguuacgugagaaacaggacguguuuugugacagcaagcugauguccgcugccauaaaagauaaccgggcagugcacgccgacaugggauauuggauugaaucagcucuuaaugauacguggaagauggagaaggccagcuucaucgagguaaaaucuugccacuggccuaagucccauacauuguggaguaacggcguccucgaaagcgagauggugauccccaaaaauuucgcaggucccguuucucagcacaacuaccgaccuggcuaucauacccagacugcugggccauggcaccugggaaagcuagaaauggacuuugauuucugugagggcaccacaguggucgugacugaagacugcgggaacagaggacccucccugaggaccacaacggccucaggcaaacucauuaccgaguggugcugucgcaguugcacucugccgccucuucgguacagaggugaggauggguguugguacggaauggaaaucaggccauugaaggagaaggaagagaaucugguuaacagcuuagugacagcgggccauggucaaauugacaauuuuucgcucggcguacuggggauggcccuuuuccuggaagagauguugcgcacccgagucggaacuaaacacgcuauacuccugguggcaguguccuuugucacacuaaucaccggcaacaugucuuuccgggaucuggggcguguuauggugaugguaggagccacgaugacugacgauauuggcaugggugugaccuaucucgcucugcuugccgcauuuaaggucagacccacauucgcggccggguugcuguuaaggaaacucaccagcaaggagcugaugauggcuacuaucggaauugcccuucugucacagaguacaaucccugaaaccauacuagagcucacagacgcacuggcuuugggcaugauggugcugaaaaucguucgcaauauggaaaaguaccaguuagccgugacuauuauggcaaucuccugcguccccaacgccgugauucuccaaaaugcuuggaagguuucuuguaccauccuggcggccgugagcgucuccccacuucuguugacgucaagccagcagaaagcagauuggauaccucucgcucugacaauuaagggccuaaaccccaccgccaucuuucugacuacccuuagucggacaucuaaaaagagauccuggccacucaaugaggccaucauggcuguagggauggugagcauucuggcaucgucauugcugaaaaacgacauaccgaugacuggaccuuuaguugccgguggccuccugaccgugugcuauguccuuacggggaggucugcggaccuggaauuggagcgagcugccgaugugaagugggaggaccaggcagaaaucaguggauccagccccauucucucuaucacaauuagcgaggauggcuccaugucaaucaaaaaugaagaggaggaacaaacccugacuauacuaauccgcacaggucugcuuguaauuagugggguguucccagucagcauccccauuaccgccgcugcaugguaccucugggagguuaagaagcagcgggccggagugcugugggacgugccuucuccacccccugucggcaaagcggaauuggaggauggcgcuuauagaaucaagcagagggggauauuaggauacucccagauuggugccggcguguauaaagaagggacuuuucacacaauguggcauguuacccguggagcaguacugaugcaccgcggcaagcggaucgagccgucaugggccgacgugaaaaaggaucucaucaguuacggugggggauggaagcuggagggcgaauggaaagagggcgaagagguccaagugcuugcucuggaaccagggaagaaccccagagccguucagacgaaaccuggauuguucaagacuaauaccgguacaauuggcgcagugagccuagacuuuuccccagggaccucuggaucgcccaucgucgauaggaaaggcaaggugguaggucuguacgggaacggagucgugacacgaagcggcgcuuauguuucagccauagcgcagacugagaaguccauugaggacaauccugaaaucgaggaugacauuuuccggaaaaagcgccucaccaucauggaucugcauccgggcgccgggaaaacgaagagauaccuucccgcaauagugagggaagcuauuaaacggggauuacgaacacugauccucgccccaacuagagucguggcugcagagauggaagaggccuugcgcggucugccuaucagguaucagacccccgccauucgugcugagcacacaggccgggaaaucguugaccucaugugucaugcgaccuucacuaugagacugcuuaguccagugagggucccuaacuacaaccugauuauaauggacgaggcacacuuuaccgaucccgccucuaucgcugcccgcggguauauuagcacacgaguggaaaugggagaggcagccggcaucuucaugacggcuacuccaccggguuccagagacccuuuuccccaaucaaaugcgccaaucauggaugaggaacgggagauucccgaaaggucuuggaacagcgggcacgaguggguaaccgacuucaagggaaagacagugugguuuguuccuaguauaaaagccggcaaugauaucgcagcuugcuugcgcaagaacggcaaaaaggucauucagcuaucccguaaaaccuucgacagcgaauacgugaagacuagagccaaugauugggacuuuguggucacaaccgauaucucugagaugggggcaaacuucaaggccgagcggguaauugacccaaggcgcuguaugaaacccgugauccugacggauggagaagaacgaguuauacucgcugguccuaugccggugacucauucauccgccgcgcagagacggggcaggaucgggcgcaauccaaagaacgaaaaugaccaauauauuuacaugggagagcccuuagaaaacgacgaggauugcgcacacuggaaagaggccaagaugcugcuugacaauaucaacacaccugaaggcauuauccccaguauguuugagccagaaagagagaaagucgaugcuauagacggugaauacaggcugagaggggaagcccguaagaccuucguggaucucaugcgccgaggcgacuugccuguuuggcuggcuuauagaguggcagccgagggaauuaauuacgcugauaggcggugguguuuugacggcaucaaaaacaaucagauucucgaagagaacgucgaaguggagaucuggaccaaggagggggaacgcaagaaacugaagcccagauggcuugaugccaggauauauagcgacccacuagcacugaaagaguucaaggaguucgcggccggacggaaaucguugacuuuaaaccugaucacagagaugggucgacucccuaccuuuaugacacagaaggcuagagaugcccuggacaaucuugcaguacugcauacugcugaagccggcgggcgcgcauacaaccacgcccucucugaguugccggagacgcuggaaacccuacugcuccuuacacuguuagcuacugugaccggaggcauuuucuuguuucugauguccgguaaggggaucggcaaaaugacacucggaaugugcugcauuaucaccgcgagcauacugcuuugguaugcccagauucaaccccacuggaucgcagcuucaaucauucuggaguucuuucucaucguuuugcugauaccagaaccugagaagcagaggacuccccaggauaaucaguuaacguacgucgugauugccauccuaaccguggucgccgcaacaauggcuaacgaaaugggcuuccuggagaaaacuaagaaagaccucgggcuuggaaguauuaccacacaagagucugaauccaauauccuggacauagauuugcggccagccagcgcguggacccuguaugcuguugccacuacauuugugacgccuaugcuccgucauucaaucgagaacaguagcguaaaugugucccugaccgcaauugccaaccaggcuacuguccuuaugggucucggcaagggguggccccugucuaagauggacaucggagugccguugcuggcaauuggcuguuacagccagguuaauccaaucacauuaaccgccgcgcuacugcuccuuguggcucacuacgccauuaucgguccugggcugcaggcaaaagccaccagagaagcucaaaagagggccgcagcuggcauaaugaaaaaccccacagucgauggaauuacuguaaucgacuuggagccaauccccuaugauccuaaguucgaaaaacagcugggccaggugaugcuccugauucuuugcguuacacagguguuaaugaugcgcaccacaugggcccugugugaggcgcucacuuuggccaccgggccgauauccacacugugggagggaaaucccggccgguuuuggaacaccacuaucgcagucucaauggcuaauauuuuccgagguucuuaccuagccggggcaggacugcucuuuaguaucaugaagaacacgacaaauaccagaaggggcacugguaacauuggcgaaacccuuggggagaaguggaaaucgcgccugaaugcuuugggaaagagcgaguuccaaaucuauaaaaaguccggcauacaggagguggaccggacacuggccaaagaggggaucaagagaggagaaacugaucaucacgccgucucucguggcucagcgaaacucaggugguuuguggagcggaacaugguuaccccagaagguaaggugguagaccuggggugcggacgcggcgguuggagcuacuauuguggcggguuaaagaacgugcgagaggucaaaggacuuacaaagggcgggccuggacaugaggaaccaauuccuauguccacguacggcuggaaucugguuagacuccagagugguguggaugucuucuucaccccacccgagaaaugcgacacucuacugugugauaucggggaaucuagcccuaacccaacaauugaggcuggaaggaccuugcgggugcugaaucucguagaaaacuggcuuaauucaaacacucaauuuugcaucaaggugcugaaucccuauaugccguccguuauagagaaaauggaaacauugcagcgcaaguacggcggcgcacuggugagaaacccucucaguaggaauagcacccacgagauguacugggucucuaacgccacggggaauauuguguccucagucaacaugaucagccgaauguuaaucaaucgguucaccaugaagcacaaaaaggcuacauaugagccagacguggaucugggaucggguacucguaacauuggcauagaaucugagauccccaaucuugacauuaucgggaaaagaauugaaaagaucaaacaggagcaugaaaccaguuggcacuacgaccaggaucauccuuauaagacaugggccuaccacggauccuaugagacuaagcaaaccggcagcgcaucauccaugguuaacgguguagugcgccugcuaacaaaaccaugggacgucgugcccaugguuacccagauggccaugacugauacgacaccguuugggcagcagaggguguucaaggagaaagucgacacccggacucaagaaccuaaggagggaaccaaaaagcucaugaagauaacagcugaauggcuguggaaagaguugggcaagaaaaagacgcccagaauguguacccgcgaggaauuuacuaggaaagugcgaucuaacgcggcccugggcgcaaucuucacagaugagaauaaguggaaaagcgcucgggaagccguagaggacaguagauuuugggaacucauugauagggagcgcaaccuucaccuggaggggaagugcgaaaccuguguguacaauaugaugggaaagcgugagaaaaaguuaggugaguucggcaaagcaaaggggucccgggccaucugguauauguggcugggagcuagauuuuuggaguucgaagcccucggcuuucugaacgaggaccauugguucagcagggguaauucucuaucagggguugagggagaaggccuucaccgccugggcuacauucuccgagaugucaguaaaaaggaagggggagcgauguacgcagacgauacugccgguugggacacacggaucacccuggaagacuugaagaacgaggaaauggugacaaaucauaugaaaggcgagcacaagaaacuggcugaggccauuuuuaagcucacuuaucagaacaaaguggucagaguucagaggccaaccccucgcgggacggugauggauauaaucuccagacgggaccagaggggaagcggccaaguagguaccuacgggcuuaauacauucacuaacauggaagcacagcugauucgucagauggagggagaaggcaucuucaagucuauccaacauuuaaccgugacagaggagauugcuguccagaauuggcuggcccgagugggccgcgaaagauugucgcggauggcuauaucaggggaugacugcguugugaagccccucgaugacagguuugccagcgcacugacugcgcuaaacgauaugggaaaaguccgcaaggacauccagcagugggagccauccagagguuggaaugauuggacccaagugcccuucugcagucaccacuuucaugaacuuguaaugaaagacggccggguucugguggucccuuguaggaaccaggaugagcucauugggcgagcccguaucucucagggagcuggcuggagccugaaggaaacggccugcuuggguaaauccuaugcacagauguggacauuaauguacuuccacagacgcgaccugcggcucgcugccaaugcaauuuguucagccgugccaagucauugggugccgaccucuaggacuacauggagcauccacgcgaagcacgaguggaugaccacugaggauaugcuugcugucuggaacagaguuuggauacaagaaaaccccuggauggaggacaagaccccuguggaauccugggaggaaaucccauaucuggggaaacgcgaggaccaguggugcggaucacuaauuggccugacaagccgggccacgugggcaaagaauauccagaccgccauuaaccagguaaggucucucaucggcaaugaggaauacacugauuauaugcccuccaugaaacgauuuagacgggaggaagaggaagcugggguguugugguga

SEQ ID NO: 14656 - RNA, 9876 nt, Artificial Sequence
  derived and/or modified CDS sequence (opt3) from DENV-2__EU482587__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgagguagaacuuacuggcuaugguaccgugacaauggaguguagucccaggaccgggcuggauuucaacgaaauggucuugcuccagauggaggacaaagccuggcuggugcaccggcaaugguuuuuagaucugccucucccauggcuucccggcgcagacacucagggaagcaauuggauacagaaggagacacugguuacguucaagaacccucaugcuaaaaagcaggacguggucguguugggcucucaagaaggggccaugcacaccgcgcuaacuggagccacagagauucagauguccucagguaaucugcucuuuaccggccaucugaaaugccgucuucgcauggauaagcugcaguugaaagggaugagcuacaguauguguacaggaaaguucaagaucguaaaagaaaucgcagagacucaacacggcaccauuguuaucagagugcaguaugagggugacgggucuccaugcaagauucccuucgaaauaauggaucucgagaaaaggcauguccugggccgguuaaucacggugaacccgauugucaccgaaaaggacuccccugugaacaucgaggcugaacccccauuuggagauagcuacaucauuauaggcguugagccugggcagcugaaacuaaauugguucaagaagggaucgucuaucggucagauguuugagacaacuaugcgaggcgccaaacgcauggcuauucucggggacaccgccugggauuucggaucccugggcgguguguuuacaucaaucgggaaggcacuucaccaaguauucggcgccauuuacggagcugcguuuaguggcgucagcuggacuaugaaaaucuugauaggggugaucauuaccuggaucggaaugaacuccagaucuacgagccugucaguuagucucgugcuggucggcgugguaacacuuuaucugggugcaauggugcaggccgacuccggguguguugucagcuggaagucuagggaauugaaaugcggaucaggcauuuucaucaccgauaaugugcacacuuggacagagcaguacaaguuucagcccgaaaguccaagcaagcucgcuuccgccauacaaaaagcacaugaggaagguauuuguggcauccggucugugacccgccuggagaacuuaauguggaagcagauuacucccgagcugaaucacauccuaucggaaaacgaggucaaacucaccauaaugacaggggacaucaagggaauuaugcaggccggcaaaagaagccugaggccucagccaacggaacuuaaguauuccuggaaaaccugggggaaggcuaagauguugucaacugagagucauaaucguacauuccugaucgauggaccggaaaccgccgagugccccaacacaaaucgggcauggaacucucucgagguugaagacuacggcuuugguguguucacuaccaauauuuggcugaaauuacgagagaagcaagacguguuuugugauagcaaacugauguccgcggcuaucaaggacaacagagccguacacgcagauaugggguauuggauagaaucagcccuuaaugacacguggaaaauggagaaggcuagcuucauugaggucaagucuugccacuggccuaaaucccauacauuguggaguaacggagugcucgaaagcgagaugaucaucccaaagaauuucgccggccccguuucucagcacaacuacaggccugguuaucauacccagacugcaggcccauggcaccuggggaaacuagaaauggauuuugacuucugugagggaaccacaguggucgugacugaagauugcggcaaccgcgggcccucccugcggaccacaacggcuucaggaaagcucauuaccgaguggugcuguagaaguugcacucugccgccucuuagguaccgcggcgaggacgguuguugguacgggauggaaauccgaccauugaaagagaaggaagagaaucugguuaacagcuuagugacagccggacauggccagauugauaauuuuucgcucgguguacugggcauggcgcuuuuccuggaagagauguugcggacccgugucgggacuaagcacgccauacuccugguggcuguguccuuugucacacuaaucaccggaaacaugucuuucagagaccugggcaggguuauggugaugguaggggcaacgaugacugaugacauuggaaugggcgugaccuaucucgcccugcuugcugccuuuaaaguccgccccacauucgcagcggguuugcuguuacggaagcucaccagcaaagagcugaugauggccacuaucgggauugcucuucugucacaaaguacaaucccugaaaccauacuagagcucacagaugcccuggcauugggaaugauggugcugaagaucguuagaaauauggaaaaauaccaguuagcugugacuauuauggccaucuccugcguccccaacgcagugauucuccagaaugccuggaagguuucuuguaccauccuggcugcggugagcgucuccccacuucuguugacgucaagccaacagaaggccgacuggauaccucucgcacugacaauuaaaggccuaaaccccaccgcuaucuuucugacuacccuuaguaggacaucuaagaaacgauccuggccacucaaugaggccaucauggccguaggcauggugagcauucuggcuucgucauugcugaagaacgacauaccgaugacugggccuuuaguugcaggaggucuccugaccgugugcuauguccuuacgggccgcucugccgaucuggaauuggagcgggcggcugacgugaaaugggaggaucaggccgaaaucaguggguccagccccauucucucuaucacaauuagcgaggacggauccaugucaaucaagaaugaagaggaggaacagacccugacuauacuaaucagaacaggccugcuuguaauuagugguguguucccagucagcauccccauuaccgcagccgcuugguaccucugggagguuaaaaagcaaagggcaggggugcugugggaugugccuucuccacccccugucggaaaggccgaauuggaggacggcgcguaucguaucaaacagcgcggcauauuaggguacucccagauuggagcugguguguauaaggaaggcacuuuucacacaauguggcauguuacccggggggccguacugaugcacagaggaaaaaggaucgagccgucaugggcagaugugaagaaagaccucaucaguuacggcgguggguggaagcuggagggagaauggaaggagggcgaagagguccaggugcuugcccuggaaccaggcaaaaacccccgagcuguucaaacgaagccuggguuguucaaaacuaauaccggaacaauuggugccgugagccuagauuuuuccccaggcaccucugggucgcccaucgucgaccggaagggaaaagugguaggccuguacgguaacggggucgugacacgcagcggagcauauguuucagcuauagcccagacugagaaguccauugaggauaauccugaaaucgaggacgauauuuucagaaagaaaaggcucaccaucauggaccugcauccgggcgcgggcaagacgaaacgguaccuucccgccauagugcgagaagcaauuaagagaggguuacgcacacugauccucgcuccaacuagggucguggccgcugagauggaagaggcauugcguggacugccuauccgguaucagacccccgccauuagagccgagcacacagguagggaaaucguugaccucaugugucaugcuaccuucacuaugcgccugcuuaguccagugcgagucccuaacuacaaccugauuauaauggaugaggcgcacuuuaccgaccccgcaucuaucgccgcuagaggcuauauuagcacacggguggaaaugggggaggccgcaggaaucuucaugacggccacuccaccgggcuccagggauccuuuuccccagucaaaugcuccaaucauggacgaggaacgcgagauucccgaacguucuuggaacagcggucacgaguggguaaccgauuucaaagggaagacagugugguuuguuccuaguauaaaggcgggaaaugacaucgccgcaugcuugagaaaaaacggcaagaaagucauucaacuaucccggaagaccuucgauagcgaauacgugaaaacuagggcuaaugacugggauuuuguggucacaaccgacaucucugagaugggcgccaacuucaaggcagagcgcguaauugauccacgaagauguaugaagcccgugauccugacggacggggaagagcggguuauacucgccggaccuaugccggugacucauucauccgcugcccagaggcgcgguagaaucggcaggaauccaaaaaacgaaaaugaccaguauauuuacaugggggagcccuuagaaaacgaugaggacugcgcgcacuggaaggaggcaaaaaugcugcuugauaauaucaacacaccugaaggaauuauccccaguauguuugagccagaacgggagaaggucgacgccauagauggcgaauaccgucugcgcggugaggcucgaaaaaccuucguggaccucaugagaaggggggauuugccuguuuggcuggccuaucggguggcugcagagggcauuaauuacgccgaccgcagaugguguuuugauggaaucaagaacaaucaaauucucgaagagaacgucgaaguggagaucuggaccaaagagggcgaaaggaagaagcugaaaccccgguggcuugacgcucgaauauauagcgauccacuagcccugaaggaguucaaagaauucgcagcggggagaaagucguugacuuuaaaccugaucacagagaugggacgccucccuaccuuuaugacacagaaagccagggacgcucuggauaaucuugccguacugcauacugcagaagcugguggccgggccuacaaccacgcacucucugaguugccggagacgcuggaaacccuacugcuccuuacacuguuagccacugugaccgggggaauuuucuuguuucugauguccggcaaggguaucgggaagaugacacucggcaugugcugcauuaucaccgcuagcauacugcuuugguaugcgcagauucagccccacuggaucgccgcaucaaucauucuggaguucuuucucaucguuuugcugauaccagaaccugagaaacaacguacuccccaggacaaucaguuaacguacgucgugauugcuauccuaaccguggucgccgccacaauggcaaacgaaaugggauuccuggagaagacuaaaaaggaccucggccuugggaguauuaccacacaggagucugaauccaauauccuggauauagacuugagaccagcuagcgccuggacccuguaugcgguugcuacuacauuugugacgccuaugcucaggcauucaaucgagaacaguagcguaaaugugucccugaccgccauugcaaaccaagccacuguccuuaugggacucgguaaaggcuggccccugucuaagauggauaucggggugccguugcuggcuauuggauguuacagccagguuaauccaaucacauuaaccgcagcccuacugcuccuuguggcgcacuacgcuauuaucggcccuggucugcaggccaaggcaacccgcgaagcccagaaacgggcugccgcagggauaaugaagaaccccacagucgacggcauuacuguaaucgauuuggagccaauccccuaugacccuaaauucgaaaagcaacugggacaggugaugcuccugauucuuugcguuacgcagguguuaaugaugcgaaccacaugggcucugugugaggcccucacuuuggcgaccggcccgauauccacacugugggaggggaaucccggaagauuuuggaacaccacuaucgccgucucaauggcaaauauuuucaggggcucuuaccuagcuggugccgggcugcucuuuaguaucaugaaaaacacgacaaauacccgccggggaacuggcaacauuggugaaacccuuggcgagaaguggaagucgagacugaaugcauuggggaaaagcgaauuccagaucuauaagaaauccggaauacaagagguggaucguacacuggcuaaggagggcaucaaaaggggggaaacugaccaucacgccgucucucggggaucagccaagcuccgcugguuuguggagcgaaacaugguuaccccagaaggcaaagugguagaucuggguugcgggagaggaggcuggagcuacuauugugguggcuuaaagaacgugagggaggucaaggggcuuacaaaaggaggcccugggcaugaagagcccauuccuauguccacguacggauggaaucugguucggcuccagaguggcguggacgucuucuucaccccacccgagaagugcgauacucuacugugugacaucggugaaucuagcccuaacccaacaauugaggcggggcgcaccuugagagugcugaaucucguagaaaacuggcuuaauaacaauacucaguuuugcaucaaagugcugaaccccuauaugccgucaguuauagagaagauggaaacauugcaaaggaaauacggaggcgcucuggugcgaaauccucucucccggaacaguacccacgagauguacugggucagcaaugcaacgggcaacauugugucuuccgucaauaugaucucacguauguuaaucaacagauucaccaugaagcacaagaaagccacauaugagccagauguggaccuggggagcggaacucgcaauauugguauagaaucggagauccccaaccuugacauuaucggcaagaggauugaaaaaaucaagcaggagcaugaaaccucuuggcacuacgaucaggaccauccuuauaaaacaugggcuuaccacgggaguuaugagacuaagcagaccggauccgccagcucaaugguuaacggcguagugcggcugcuaacaaagccaugggaugucgugcccaugguuacccaaauggcaaugacugacacgacaccguuuggucagcagagaguguucaaagagaaggucgauacccgcacucaggaaccuaaagaggggaccaagaaacucaugaagauaacagccgaauggcuguggaaggaguugggaaaaaagaaaacgcccaggauguguacccgagaggaauuuacucggaaggugagauccaaugcugcgcugggcgccaucuucacagacgagaacaaauggaagucugcaagggaagcuguagaggauagccgcuuuugggaacucauugaccgugagcggaaucuucaccuggagggcaaaugcgaaaccuguguguacaacaugauggggaagagagagaagaaauuaggagaauucgguaaggccaaaggcaguagggcaaucugguauauguggcugggggcccgcuuuuuggaguucgaagcucucggauuucugaaugaggaucauugguucucccgaggcaacagccuaucugguguugagggggaaggacuucaccggcugggcuacauucucagagacgucucaaagaaagagggcggggccauguacgcggaugacacugcaggaugggacacaaggaucacccuggaagauuugaagaaugaggaaauggugacaaaccauaugaagggugagcacaaaaagcuggccgaggcuauuuuuaaacucacuuaucaaaauaaggugguccgcguucagagaccaaccccucggggcacggugauggacauaaucaguaggcgugaucagcgaggguccggacagguaggcaccuacggucuuaacacauucacuaauauggaagcccaacugauucgccagauggagggggaaggaaucuucaaaagcauccagcauuuaaccgugacagaggagauugcaguccaaaacuggcuggcuagagugggccgggaaagguugucucgcauggccauaucgggcgacgauugcguugugaagccccucgacgauagauuugcuucagcccugacugcacuaaaugacauggggaagguccggaaagauauccagcagugggagccaagcaggggauggaacgacuggacccaggugcccuucugcucccaccacuuucaugaaauuguaaugaaggauggucgaguucuuguggucccuugucguaaucaagacgagcugaucggcagagcgcgcauuagucagggggccggauggucucucaaagaaacggcuugccugggcaagagcuaugcccagauguggacauugauguacuuccaccggagggauuuaagacuggcagcuaacgccaucuguuccgcagugccaucacauugggugccgaccagucgcacuacauggucuauacacgccaaacacgaguggaugaccacugaggacaugcucgcggucuggaaccggguuuggauccaggaaaaucccuggauggaggacaagaccccuguggaaagcugggaggaaguaccauaucuugguaagagggaggaucaauggugcgggucccugauuggacuaacaucacgagcuacgugggccaaaaacauccagaccgcaauuaaucaggugagaagccugaucggcaacgaggaauacacugacuauaugcccucuaugaagcgguuuaggcgcgaggaagaggaagccggcguccucugguga

SEQ ID NO: 14657 - RNA, 9876 nt, Artificial Sequence
  derived and/or modified CDS sequence (opt3) from DENV-2__EU482588__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaaggugcccuucgaaauuauggaucucgagaaaaggcauguccugggccgguuaauaacggugaacccgaucgucaccgaaaaggacuccccugugaacauugaggccgaacccccauuuggagauagcuacaucaucauuggcguugagccugggcagcugaaacuaaauugguucaagaagggaucgucuauaggucagauguuugagacaacuaugcgaggcgcuaaacgcauggccauccucggggacaccgcaugggauuucggaucccugggcgguguguuuacaucaauugggaaggcccuucaccaaguauucggcgcuaucuacggagcggcauuuaguggcgucagcuggacuaugaaaauuuugaucggggugauaaucaccuggauuggaaugaacuccagaucuacgagccugucaguuagucucgugcuggucggcgugguaacacuuuaucugggugccauggugcaggcugacuccggguguguugucagcuggaagucuaaagaauugaagugcggaucaggcaucuucgugaccgauaaugugcacacuuggacagagcaguacaaguuucagcccgaaaguccaagcaaacucgccuccgcaauucaaaaggcccaugaggaagguaucuguggcauaaggucugucacccggcuggagaacuuaauguggaaacagauuacucccgagcugaaucacauccuaucggaaaacgagguuaagcucaccauuaugacaggggacaucaaaggaauaaugcaggcuggcaagcgcagccugagaccucagccaacggaacuuaaauauuccuggaagaccugggggaaggccaaaauguugucaacugagagucauaaucaaacauuccugaucgauggaccggaaaccgcagagugccccaacacaaauagggcguggaacucucucgagguggaagacuacggcuuugguguguucacuaccaauauuuggcugaaguuacgugagaaacaggacguauuuugugauagcaagcugauguccgcugccaucaaagacaaccgggcaguccacgccgauaugggguauuggauugaaucagcucuuaaugacacguggaagauggagaaggccagcuucaucgaggugaaaucuugccacuggccuaagucccauacauuguggaguaacggaguucucgaaagcgagaugauaauuccaaaaaauuucgcaggccccgugucucagcacaacuaccgaccugguuaucauacccagacugcuggcccauggcaccuggggaagcuagaaauggauuuugacuucugugagggaaccacagucgugguuacugaagauugcggcaacagagggcccucccugaggaccacaacggccucaggaaaacucaucaccgaguggugcugucgcaguugcacucugccgccucuucgguacagaggcgaggacgguuguugguacgggauggaaaucaggccauugaaggagaaggaagagaaucuggugaacagcuuaguaacagcgggacauggccaaauugauaauuuuucgcucgguguccugggcauggcccuuuuccuggaagagauguugcgcacccgaguggggacuaaacacgcuauccuccugguggcagucuccuuuguuacacuaauuaccggaaacaugucuuuccgggaccugggccgugugaugguaauggugggggccacgaugacugaugacauaggaaugggcgucaccuaucucgcucugcuugccgcauuuaaggugagacccacauucgcggccgguuugcuguuaaggaaacucaccagcaaggagcugaugauggcuacuaucgggauugcccuucugucacagaguacaaucccugaaaccauucuagagcucacagaugcacuggcuuugggaaugaugguucugaaaaucgugcgcaauauggaaaaguaccaguuagccgucacuauaauggcaaucuccugcgugcccaacgccguuauucuccaaaaugcuuggaaggugucuuguaccauccuggcggccgucagcguauccccacuucuguugacgucaagccagcagaaagcagacuggauuccucucgcucugacaaucaagggccuaaaccccaccgccauauuucugacuacccuuagucggacaucuaaaaagagauccuggccacucaaugaggccauuauggcugugggcaugguuagcauccuggcaucgucauugcugaaaaacgacaucccgaugacugggccuuuaguggccggaggucuccugaccgucugcuaugugcuuacgggcaggucugcggaucuggaauuggagcgagcugccgacguaaagugggaggaucaggcagaaauuaguggguccagccccauacucucuaucacaauuagcgaggacggauccaugucaaucaaaaaugaagaggaggaacaaacccugacuauucuaauccgcacaggccugcuugugauaaguggugucuucccaguuagcauccccauuaccgccgcugcaugguaccucugggaggugaagaagcagcgggccggggugcugugggaugucccuucuccacccccugugggaaaagcggaauuggaggacggcgcuuauagaaucaagcagaggggcauuuuaggguacucccagaucggagccgguguuuauaaagaaggcacuuuucacacaauguggcauguaacccguggggcagugcugaugcaccgcggaaagcggauagagccgucaugggccgaugucaaaaaggaccucauuaguuacggcgguggguggaagcuggagggagaauggaaagagggcgaagaggugcaaguucuugcucuggaaccaggcaagaaccccagagccgugcagacgaaaccuggguuguucaagacuaauaccggaacaaucggugcagucagccuagauuuuuccccaggcaccucugggucgcccaucguggacaggaaaggaaagguagucggccuguacgguaacggggugguuacacgaagcggagcuuaugugucagccauugcgcagacugagaaguccaucgaggauaauccugaaauagaggacgauauuuuccggaaaaagcgccucaccaucauggaccugcauccgggcgccggcaaaacgaagagauaccuucccgcaauugucagggaagcuaucaaacggggguuacgaacacugauacucgccccaacuagagugguugcugcagagauggaagaggccuugcgcggacugccuauuagguaucagacccccgccauccgugcugagcacacaggucgggaaaucguggaccucaugugucaugcgaccuucacuaugagacugcuuaguccagucagggugccuaacuacaaccugauuaucauggaugaggcacacuuuaccgaccccgccucuauugcugcccgcggcuauauaagcacacgaguagaaaugggggaggcagccggaaucuucaugacggcuacuccaccgggcuccagagauccuuuuccccaaucaaaugcgccaauuauggacgaggaacgggagauccccgaaaggucuuggaacagcggucacgagugggugaccgauuucaaggggaagacaguuugguuugucccuaguaucaaagccggaaaugacauugcagcuugcuugcgcaagaacggcaaaaaggugauacagcuaucccguaaaaccuucgauagcgaauacgugaagacuagagccaaugacugggauuuugucguaacaaccgacaucucugagaugggcgcaaacuucaaggccgagcgggugauugauccaaggcgcuguaugaaacccguuauccugacggacggggaagagcgagugauucucgcuggaccuaugccggucacucauucauccgccgcgcagagacgggguaggaucggccgcaauccaaagaacgaaaaugaccaauauauauacaugggggagcccuuagaaaacgaugaggacugcgcacacuggaaagaggccaagaugcugcuugauaauaucaacacaccugaaggaauuauccccaguauguuugagccagaaagagagaaaguggacgcuauugauggcgaauacaggcugcggggugaggcccguaagaccuucguugaccucaugcgccgaggggauuugccuguguggcuggcuuauagagucgcagccgagggcaucaauuacgcugacaggcggugguguuuugauggaauaaaaaacaaucagauucucgaagagaacguggaaguagagaucuggaccaaggagggcgaacgcaagaaacugaagcccagauggcuugacgccaggauuuauagcgauccacuagcacugaaagaguucaaggaauucgcggccgggcggaaaucguugacuuuaaaccugaucacagagaugggacgacucccuaccuuuaugacacagaaggcuagagacgcccuggauaaucuugcagugcugcauacugcugaagccgguggccgcgcauacaaccacgcccucucugaguugccggagacgcuggaaacccuacugcuccuuacacuguuagcuacuguuaccgggggaauauucuuguuucugauguccggcaaggguaucgggaaaaugacacucggcaugugcugcauuaucaccgcgagcauucugcuuugguaugcccagauccaaccccacuggauagcagcuucaauuauccuggaguucuuucucaucgucuugcugauuccagaaccugagaagcagaggacuccccaggacaaucaguuaacguacguggugaucgccauacuaaccgucguugccgcaacaauggcuaacgaaaugggauuccuggagaaaacuaagaaagaccucggccuugggaguauuaccacacaagagucugaauccaauauccuggauauugacuugcggccagccagcgcguggacccuguaugcuguggccacuacauuuguaacgccuaugcuccgucauucaaucgagaacaguagcgugaaugucucccugaccgcaauagccaaccaggcuacugugcuuaugggacucgguaagggcuggccccugucuaagauggauaucgggguuccguugcuggcaauuggauguuacagccaggugaauccaaucacauuaaccgccgcgcuacugcuccuugucgcucacuacgccauuaucggcccuggucugcaggcaaaagccaccagagaagcucaaaagagggccgcagcugggauuaugaaaaaccccacaguagacggcaucacugugauagauuuggagccaauucccuaugacccuaaguucgaaaaacagcugggacagguuaugcuccugauccuuugcgugacgcaggucuuaaugaugcgcaccacaugggcccugugugaggcgcucacuuuggccaccggcccgaucuccacacugugggaggggaaucccggacgguuuuggaacaccacuauugcagugucaauggcuaauauauuccgaggcucuuaccuagccggugcagggcugcucuuuaguaucaugaagaacacgacaaauaccagaaggggaacuggcaacauuggugaaacccuuggcgagaaguggaaaucgcgccugaaugcuuuggggaagagcgaauuccaaaucuauaaaaaguccggaauucaggaggucgaucggacacuggccaaagagggcaucaagagaggggaaacugaccaucacgccgugucucguggaucagcgaaacucaggugguuuguugagcggaacauggugaccccagaaggcaagguaguggaucuggguugcgggcgcggaggcuggagcuacuauugugguggcuuaaagaacguccgagagguuaaagggcuuacaaagggaggcccugggcaugaagagcccauaccuauguccacguacggauggaaucuggugagacuccagaguggcgucgacguguucuucaccccacccgagaaaugcgauacucuacugugugacaucggugaaucuagcccuaacccaacaauugaggcugggaggaccuugcggguacugaaucucguggaaaacuggcuuaauaacaauacucaauuuugcaucaagguucugaaccccuauaugccgucagugauugagaaaauggaaacauugcagcgcaaguacggaggcgcacuggucagaaauccucucuccaggaacaguacccacgagauguacugggugagcaaugccacgggcaacaucgucucuuccgugaauaugauaucacgaauguuaauuaaccgguucaccaugaagcacaaaaaggcuacauaugagccagauguugaccuggggagcggaacucguaauaucgguaucgaaucggagauucccaaccuugacauaaucggcaaaagaauugaaaagaucaaacaggagcaugaaaccucuuggcacuacgaucaggaccauccuuauaagacaugggccuaccacgggaguuaugagacuaagcaaaccggauccgcaagcucaaugguaaacggcgugguccgccugcuaacaaaaccaugggaugugguucccauggugacccagauggccaugacugacacgacaccguuuggucagcagagggucuucaaggagaaaguggauacccggacucaagaaccuaaggaggggaccaaaaagcucaugaagauuacagcugaauggcuguggaaagaguugggaaagaaaaagacgcccagaauguguacccgcgaggaauuuacuaggaaaguacgauccaaugcggcccugggcgcaaucuucacagacgagaacaaguggaaaucugcucgggaagccguggaggauagcagauuuugggaacucauagacagggagcgcaaucuucaccuggagggcaagugcgaaaccuguguuuacaacaugauggggaagcgugagaaaaaguuaggagaauucgguaaagcaaagggcagucgggccaucugguauauguggcugggggcuagauuuuuggaguucgaagcccucggauuucugaaugaggaucauugguucuccaggggcaacagccuaucuggugucgagggggaaggacuucaccgccugggcuacauucuccgagacgugucaaaaaaggagggcggggcgauguacgcagaugacacugccggaugggacacacggaucacccuggaagauuugaagaaugaggaaauggugacaaaccauaugaaaggugagcacaagaaacuggcugaggccauuuuuaagcucacuuaucagaauaaagucguuagagugcagaggccaaccccucgcggcacgguaauggacaucauuaguagacgggaucagaggggguccggacaagugggcaccuacggucuuaacacauucacuaauauggaagcacagcugauacgucagauggagggggaaggaaucuucaagagcauucaacauuuaaccgucacagaggagaucgcugugcagaacuggcuggcccgaguuggccgcgaaagauugucucggauggcuaucucgggcgacgauugcguggucaagccccucgacgauagguuugccucagcacugacugcgcuaaaugacauggggaaagugcgcaaggauauucagcagugggagccaagcagaggauggaacgacuggacccaaguacccuucugcucccaccacuuucaugaacuuguuaugaaagauggucgggugcuggucgugccuuguaggaaucaggacgagcucauaggccgagcccguaucagucagggggcuggauggucucugaaggaaacggccugcuugggcaaaagcuaugcacagauguggacauuaauguacuuccacagacgcgaucugcggcucgcugccaacgcaauuuguuccgccgugccaucacauugggucccgaccaguaggacuacauggucuauccacgcgaagcacgaguggaugaccacugaggacaugcuugcuguuuggaacagaguguggauucaagaaaaucccuggauggaggacaagaccccuguagaaagcugggaggaagugccauaucuggguaaacgcgaggaucaguggugcgggucccuaaucggacugacaucacgggccacgugggcaaagaacauacagaccgccaucaaucaggucaggagccucauuggcaacgaggaauacacugacuauaugcccucuaugaaacgauuuagacgggaggaagaggaagcuggcguguugugguga

SEQ ID NO: 14658 - RNA, 9876 nt, Artificial Sequence
  derived and/or modified CDS sequence (opt3) from DENV-2__EU569705__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcucuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucacaacuaauauuuggcugaaguuacgugagaaacaggacguguuuugugauagcaagcugauguccgccgcaaucaaagacaaccgggccgugcacgcugauaugggguauuggauagaaucagcccuuaaugacaccuggaagauggagaaggcaagcuucauugagguaaaaucuugccacuggccuaagucccauacguuguggaguaacggaguccucgaaagcgagaugaucaucccaaaaaauuucgcuggccccgugucucagcacaacuaccgaccugguuaucauacacagaccgccggcccauggcaccuggggaagcuagaaauggauuuugacuucugugagggaacuaccguuguggucacagaagauugcggcaacagagggcccucccugaggacuaccacagcgucaggaaaacucauuacggaguggugcugucgcaguugcacccugccgccucuucgguacagaggcgaggacgguuguugguacgggauggaaaucaggccauugaaggagaaggaagagaaucuggugaacagcuuaguuacugccggacauggccaaauugauaauuuuucgcucggugugcugggcauggcucuuuuccuggaagagauguugcgcacacgaguagggaccaaacacgcaaugcuccuggucgccguguccuuugugacucuaauaacaggaaacaugucuuuccgggaccugggccgugucaugguuauggugggggcuaccaugacggaugacaucggaaugggcauuacuuaucucgcccugcuugcagcguuuaagguaagacccaccuucgccgcugguuugcuguuaaggaaacucacaagcaaggagcugaugauggccaccaucgggauugcacuucugucacagaguacuaucccugaaacaauacuagagcucaccgaugcucuggccuugggaaugauggugcugaaaaucguccgcaauauggaaaaguaccaguuagcagugacaauuauggccaucuccugcguucccaacgcugugauucuccaaaaugcguggaaggucucuuguacuauccuggccgcagugagcguuuccccacuucuguugaccucaagccagcagaaagcugacuggauaccucucgcccugacgauuaagggccuaaaccccacagccaucuuucugaccacucuuagucggaccucuaaaaagagauccuggccacucaaugaggcuaucauggcagugggcauggucagcauucuggccucgucauugcugaaaaacgacauaccgaugacagggccuuuaguagcgggaggucuccugacugugugcuauguucuuaccggcaggucugcugaucuggaauuggagcgagccgcagacgugaagugggaggaucaggccgaaaucaguggguccagccccauucucucuaucacgauuagcgaggacggauccaugucaaucaaaaaugaagaggaggaacaaacacugaccauacuaauccgcacuggccugcuugucauuagugguguguucccaguaagcauccccauuacagcugcagccugguaccucugggaggugaagaagcagcgggcggggguccugugggauguuccuucuccacccccugugggaaaagcugaauuggaggacggcgccuauagaaucaagcagaggggcauauuaggguacucccagauuggagcagguguguauaaagaaggcaccuuucacacuauguggcaugucacacguggggccgugcugaugcaccgcggaaagcggaucgagccgucaugggcugauguuaaaaaggaccucaucaguuacggcgguggguggaagcuggagggagaauggaaagagggcgaagagguacaagugcuugcccuggaaccaggcaagaaccccagagcaguccagaccaaaccuggguuguucaagacgaauacuggaaccauuggugcugugagccuagauuuuuccccaggcacaucugggucgcccaucguugacaggaaaggaaagguggucggccuguacgguaacggggugguaacccgaagcggagccuaugucucagcgauagcccagacagagaaguccauugaggauaauccugaaaucgaggacgauauuuuccggaaaaagcgccucacuaucauggaccugcauccgggcgcaggcaaaaccaagagauaccuucccgcuauagugagggaagccauuaaacggggguuacgaacgcugauccucgcuccaacaagaguuguggcagccgagauggaagaggccuugcgcggacugccuaucagguaucagacucccgcuauucgugcggagcacaccggucgggaaaucgucgaccucaugugucaugcaacauucaccaugagacugcuuaguccagugaggguuccuaacuacaaccugauuauaauggaugaggcccacuuuacugaccccgcuucuaucgccgcacgcggcuauauuagcacccgaguggaaaugggggaggccgcuggaaucuucaugacagcgacgccaccgggcuccagagauccuuuuccccaaucaaaugccccaaucauggacgaggaacgggagauucccgaaaggucuuggaacagcggucacgagugggucacugauuucaaggggaagaccgugugguuuguaccuaguauaaaagcaggaaaugacaucgcugccugcuugcgcaagaacggcaaaaaggugauucagcuaucccguaaaacauucgauagcgaauacguuaagaccagagcaaaugacugggauuuugucgugacuacagacaucucugagaugggcgccaacuucaaggcugagcgggugauugauccaaggcgcuguaugaaacccgucauccugaccgacggggaagagcgaguaauacucgccggaccuaugccggugacgcauucauccgcggcacagagacgggguaggaucggccgcaauccaaagaacgaaaaugaccaauauauuuacaugggggagcccuuagaaaacgaugaggacugcgcccacuggaaagaggcuaagaugcugcuugauaauaucaacacuccugaaggaauuauccccaguauguuugagccagaaagagagaaaguugacgccauagauggcgaauacaggcugcggggugaggcucguaagacauucguggaccucaugcgccgaggggauuugccugucuggcuggcauauagaguggccgcugagggcauuaauuacgccgacaggcggugguguuuugauggaaucaaaaacaaucagauucucgaagagaacguugaaguggagaucuggaccaaggagggcgaacgcaagaaacugaagcccagauggcuugacgcaaggauauauagcgauccacuagcgcugaaagaguucaaggaauucgccgcugggcggaaaucguugaccuuaaaccugaucacugagaugggacgacucccuacauuuaugacccagaaggccagagacgcacuggauaaucuugcuguccugcauacagccgaagcagguggccgcgccuacaaccacgcucucucugaguugccggagacucuggaaacgcuacugcuccuuacccuguuagcgacagugacugggggaauuuucuuguuucugauguccggcaaggguaucgggaaaaugacccucggcaugugcugcauuaucacagccagcauacugcuuugguaugcacagauucaaccccacuggaucgcugccucaaucauucuggaguucuuucucaucguauugcugauaccagaaccugagaagcagaggaccccccaggacaaucaguuaacuuacgugguuauugccauccuaacggucguggcagcuaccauggccaacgaaaugggauuccuggagaaaacaaagaaagaccucggccuugggaguauugcgacucaagagucugaauccaauauccuggauauagacuugcggccagcuagcgccuggacccuguaugcaguggccacaaccuuugucacuccuaugcuccgucauucaaucgagaacaguagcguuaaugugucccugacagcuauugcaaaccaggccacgguacuuaugggacucgguaagggcuggccccugucuaagauggauaucggggugccguugcuggcgauuggauguuacagccaggucaauccaaucaccuuaacugcugcccuacugcuccuuguggcacacuacgccauuaucggcccuggucugcaggcuaaagccacaagagaagcacaaaagagggcugccgcggggauaaugaaaaaccccaccguugacggcauuaccgugaucgauuuggagccaauccccuaugacccuaaguucgaaaaacagcugggacaggucaugcuccugauucuuugcguaacacagguguuaaugaugcgcacuacgugggcccugugugaggcacucaccuuggcuacaggcccgauauccacucugugggaggggaaucccggacgguuuuggaacaccacaaucgccguuucaauggcaaauauuuuccgaggcucuuaccuagcuggugccgggcugcucuuuaguaucaugaagaacaccacuaauacgagaaggggaacaggcaacauuggugaaacccuuggcgagaaguggaaaucgcgccugaaugccuuggggaagagcgaauuccaaaucuauaaaaaguccggaauacaggagguggaucggacucuggcgaaagagggcaucaagagaggggaaaccgaccaucacgcugucucucguggaucagcaaaacucaggugguuuguggagcggaacauggucacaccagaaggcaaggugguugaucuggguugcgggcgcggaggcuggagcuacuauugugguggcuuaaagaacgugcgagagguaaaagggcuuacuaagggaggcccugggcaugaagagcccauuccuauguccaccuacggauggaaucuggugagacuccagaguggcgucgacguuuucuucacaccacccgagaaaugcgauacgcuacugugugacaucggugaaucuagcccuaacccaaccauugaggccgggaggacuuugcgggugcugaaucucgucgaaaacuggcuuaauaacaauacacaauuuugcaucaaggugcugaaccccuauaugccgucaguaauagagaaaauggaaaccuugcagcgcaaguacggaggcgcucuggugagaaauccucucuccaggaacaguacucacgagauguacuggguuagcaaugccacaggcaacauugugucuuccgucaauaugaucucacgaauguuaaucaaccgguucaccaugaagcacaaaaaggcaacguaugagccagauguggaccuggggagcggaacccguaauauugucauagaaucggagauccccaaccuugacauuaucgguaaaagaauugaaaagaucaaacaggagcaugaaacaucuuggcacuacgaucaggaccauccuuauaagacuugggccuaccacggcaguuaugagaccaagcaaacaggguccgcuagcucaauggugaacggaguuguacgccugcuaacuaaaccaugggaugugguccccauggugacccagauggcgaugacagacaccacuccguuuggccagcagaggguuuucaaggagaaaguggauacgcggacacaagaaccuaaggaggguaccaaaaagcucaugaagauaacugccgaauggcuguggaaagaguuggggaagaaaaagacccccagaauguguacacgcgaggaauuuacgaggaaaguccgauccaaugcagcucugggagccaucuucaccgacgagaacaaguggaaaucugcacgggaagccguggaggauagcagauuuugggaacucauugacagggagcgcaaucuucaccuggagggcaagugcgaaacuuguguauacaacaugaugggcaagcgugagaaaaaguuaggggaauucggaaaagcuaaggguagucgggccaucugguauauguggcugggcgcgagauuuuuggaguucgaagcacucggguuucugaaugaggaucauugguucuccaggggaaacagccuaucuggcguggagggugaagggcuucaccgccugggauacauucuccgagacguuucaaaaaaggagggcggcgccauguacgcugaugacacagccgggugggacacccggaucacucuggaagauuugaagaaugaggaaauggucacaaaccauaugaaaggagagcacaagaaacuggcagaggcuauuuuuaagcucaccuaucagaauaaaguggugagaguccagaggccaacaccucgcgguacuguuauggacauaaucaguagacgggaucagaggggcuccgggcaagugggaaccuacggccuuaacacguucaccaauauggaagcccagcugauucgucagauggagggugaagggaucuucaagagcauccaacauuuaacaguaacugaggagauugcugugcagaacuggcuggcccgagucggacgcgaaagauugucucggauggcaauaucgggcgacgauugcgugguuaagccccucgacgauagguuugcgucagcccugaccgcucuaaaugacaugggcaaagugcgcaaggauauccagcagugggagccaagcagaggguggaacgacuggacacaaguccccuucugcucccaccacuuucaugaacuugugaugaaagauggacggguacugguugugccuuguaggaaucaggacgagcucauuggucgagcccguaucagucagggcgcaggguggucucugaaggaaacugcuugcuugggaaaaagcuaugcccagauguggaccuuaauguacuuccacagacgcgaucugcggcucgcagccaacgcgauuuguuccgcugucccaucacauugggugccgacgaguaggacaaccuggucuauccacgccaagcacgaguggaugacuacagaggacaugcuugcaguguggaacagagucuggauacaagaaaaucccuggauggaggacaagaccccuguugaaagcugggaggaagugccauaucugggcaaacgcgaggaucaguggugcgguucccuaaucgggcugacuucacgggccaccugggcuaagaacauucagacagccaucaaucagguaaggagccucauuggaaacgaggaauacacggacuauaugcccucuaugaaacgauuuagacgggaggaagaggaagcaggcguguugugguga

SEQ ID NO: 14659 - RNA, 9876 nt, Artificial Sequence
  derived and/or modified CDS sequence (opt3) from DENV-2__EU482589__SS-prME
accgccggcgugaucauuaugcugauacccacagcuauggcauuccaccucacuacgagaaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggauggggcuggauuucaacgaaaugguguugcuccagauggaggacaaagcauggcugguccaccggcaaugguuuuuagaucugccucucccauggcuucccggcgcugacacccagggaagcaauuggauacagaaggagacucuggugacauucaagaacccucaugccaaaaagcaggacguuguggucuugggcucucaagaaggggcgaugcacacggcccuaaccggagcaacugagauucagauguccucagguaaucugcucuuuacaggccaucugaaaugccgucuucgcauggauaagcugcaguugaaagggaugagcuacaguauguguaccggaaaguucaagaucgugaaagaaaucgcugagacacaacacggcacuauuguaaucagaguucaguaugagggugacgggucuccaugcaagauucccuucgaaauaauggaucucgagaaaaggcaugugcugggccgguuaaucaccgucaacccgauugugacggaaaaggacuccccugucaacaucgaggccgaacccccauuuggagauagcuacaucauuauaggcguggagccugggcagcugaaacuaaauugguucaagaagggaucgucuaucggucagauguuugagaccacaaugcgaggcgcuaaacgcauggccauucucggggacacugcaugggauuucggaucccugggcgguguuuuuaccucaaucgggaaggcccuucaccaaguguucggcgcuauuuacggagcggcauuuaguggcguaagcuggacaaugaaaaucuugauaggggucaucauuacuuggaucggaaugaacuccagaucuaccagccugucagugagucucguucuggugggcgucgugacgcuuuaucugggugccaugguacaggcugacuccgggugugugguuagcuggaagucuaaagaauugaagugcggaucaggcauuuucaucacagauaauguccacaccuggacugagcaguacaaguuucagcccgaaaguccaagcaaacucgccuccgcaauacaaaaggcccaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggcuggcaagcgcagccugagaccucagccaacagaacuuaaauauuccuggaagacgugggggaaggccaaaauguugucaaccgagagucauaaucaaacuuuccugaucgauggaccggaaacagcagagugccccaacaccaauagggcguggaacucucucgaggucgaagacuacggcuuugguguuuucacaacuaauauuuggcugaaguuacgugagaaacaggacguguuuugugauagcaagcugauguccgcugccaucaaagacaaccgggcagugcacgccgauaugggguauuggauagaaucagcucuuaaugacaccuggaagauggagaaggccagcuucauugagguaaaaucuugccacuggccuaagucccauacguuguggaguaacggaguccucgaaagcgagaugaucauccccaagaaucuggcaggccccgugucucagcacaacuaccgaccugguuaucauacacagaccgcuggcccauggcaccuagggaagcuggaaauggauuucgacuuuugugagggaacuaccguuguggucacagaagauugcggcaacagagggcccucccucaggacuaccacagccucaggaaaacuggugacggaguggugcugucgcaguugcacccuuccgccuuugcgguacagaggcgaggacgguuguugguacgggauggaaauuaggccacugaaggagaaggaagagaauuuaguuaacagccucgugacugcgggacauggccaaaucgauaauuucucgcuggguguacuuggcauggcccuguuuuuggaagagaugcuccgcacacgagucgggaccaaacacgcuauucugcuaguggcaguguccuucgucacucugauaacaggaaacaugucuuuucgggaccucggccguguuauggugaugguaggggccaccaugacggaugacaucggaaugggcgugacuuaucuggcucuuuuggccgcauucaaggucagacccaccuuugcggccggucuguuacucaggaaacugacaagcaaggagcuuaugauggcuaccauugggaucgcccugcuaucacagaguacuauuccugaaacaauccucgagcugaccgaugcauuggcucugggaaugaugguguuaaaaauaguucgcaauauggaaaaguaccagcucgccgugacaaucauggcaauuuccugcguccccaacgccgugauccugcaaaaugcuuggaagguuucuuguacuauucuugcggccgugagcgucuccccacuguugcucaccucaagccagcagaaagcagacuggaucccucuggcucuaacgauaaagggccugaaccccacagccauuuuccuuaccacucucagucggaccucuaaaaagagauccuggccacugaaugaggccaucauggcuguaggcauggugagcaucuuggcaucgucacugcucaaaaacgacauuccgaugacagggccucuaguugccggaggucugcuuacugugugcuauguccugaccggcaggucugcggauuuggaacucgagcgagcugccgacgugaagugggaggaucaggcagaaauaaguggguccagccccauccugucuauuacgaucagcgaggacggauccaugucaauuaaaaaugaagaggaggaacaaacacuaaccauccugauacgcacuggccuucucguaaucagugguguguuuccagucagcauucccaucacagccgcugcaugguaccugugggagguuaagaagcagcgggccgggguguugugggaugugccuucuccacccccugucggaaaagcggaauuagaggacggcgcuuauagaauuaagcagaggggcauccugggguacucccagauaggagccgguguguauaaagaaggcaccuuccacacuauguggcauguuacacguggggcaguacucaugcaccgcggaaagcggauugagccgucaugggccgaugugaaaaaggaccugaucaguuacggcgguggguggaaacuugagggagaauggaaagagggcgaagagguccaagugcuggcuuuggaaccaggcaagaaccccagagccguucagaccaaaccugggcuauuuaagacgaauacuggaaccaucggugcagugagccuggauuucuccccaggcacaucugggucgcccauugucgacaggaaaggaaaggugguaggccucuacgguaacggggucgugacccgaagcggagcuuauguuucagccaucgcgcagacagagaaguccauagaggauaauccugaaauugaggacgauaucuuucggaaaaagcgccugacuauuauggaccuucauccgggcgccggcaaaaccaagagauacuuacccgcaaucgugagggaagcuauaaaacgggggcugcgaacgcucauuuuggccccaacaagagucguggcugcagagauggaagaggcccugcgcggacucccuaucagguaucagacucccgccauccgugcugagcacaccggucgggaaauuguugaccugaugugucaugcgacauucaccaugagacuucugaguccagugagggucccuaacuacaacuugaucauuauggaugaggcacacuucacugaccccgccucuauagcugcccgcggcuauaucagcacccgaguggaaaugggggaggcagccggaauuuuuaugacagcuacgccaccgggcuccagagauccuuucccccaaucaaaugcgccaaucauggacgaggaacgggagauccccgaaaggucuuggaacagcggucacgaguggguaacugauuuuaaggggaagaccgugugguucguuccuaguauuaaagccggaaaugacauagcagcuugccuacgcaagaacggcaaaaaggucauccagcugucccguaaaacauuugauagcgaauacgugaagaccagagccaaugacugggauuucguggucacuacagacauuucugagaugggcgcaaacuuuaaggccgagcggguaaucgauccaaggcgcuguaugaaacccgugauucucaccgacggggaggaacgaguuaucuuagcuggaccuaugccggugacgcauucauccgccgcgcagagacgggguaggauaggccgcaauccaaagaacgaaaaugaccaauauaucuacaugggggagccccuggaaaacgaugaggacugcgcacacuggaaagaggccaagaugcuucuggauaauauuaacacuccugaaggaaucauucccaguauguucgagccagaaagagagaaagucgacgcuaucgauggcgaauacaggcuccggggugaggcccguaagacauuuguggacuugaugcgccgaggggaucugccuguuuggcucgcuuauagaguggcagccgagggcauaaauuacgcugacaggcggugguguuucgauggaauuaaaaacaaucagauccuggaagagaacgucgaaguggagauuuggaccaaggagggcgaacgcaagaaacuuaagcccagauggcuagacgccaggaucuauagcgauccacuggcauugaaagaguuuaaggaguucgcggccgggcggaaaucguuaacccugaaccucauaacugagaugggacgacugccuacauucaugacccagaaggcuagaaaugcccuugacaaccuggcaguacuccauacagcugaagccgguggccgcgcauacaaucacgccuugucugagcugccggagacucuagaaacgcugcuccuucugaccuuauuggcuacagugacugggggaaucuuucuguuccucauguccggcaaggguauugggaaaaugacccugggcaugugcugcaucauuacagcgagcauccuucugugguaugcccagauacaaccccacuggauugcagcuucaaucauccucgaguuuuucuugauuguucuguuaaucccagaaccugagaagcagaggaccccacaggauaaccagcuaacuuacgucgugauagccauucugacgguggucgccgcaaccauggcuaaugaaaugggauuucucgagaaaacaaagaaagaccuuggccuggggaguaucacuacccaagagucugaauccaacauuuuggacaucgaucugcggccagccagcgcguggacacucuaugcuguugccaccacuuucgugacaccuaugcugcgucauucaauagagaauaguagcguaaacgugucccuuacggcaaucgccaaucaggcuaccguccucaugggacuggguaagggcuggcccuugucuaagauggacauuggggugccgcuguuagcaaucggauguuacagccagguuaacccaauuacucuaacagccgcgcugcuccuucugguggcucacuacgccaucauuggcccugguuugcaggcaaaagccaccagagaagcucaaaagagggccgcagcugggaucaugaaaaaucccaccgucgauggcauaacaguaauugaccuggagccaauccccuaugauccuaaguuugaaaaacagcucggacaggugaugcugcuuaucuuaugcguuacucaggugcugaugaugcgcacgaccugggcccucugugaggcguugacacuggccacuggcccgauuuccacccuaugggaggggaaccccggacgguucuggaauacaaccauagcagucucaauggcuaacaucuuucgaggcucuuaccuggccggugcagggcuccuuuucaguauuaugaagaauacuacgaacacaagaaggggaaccggcaauaucggugaaacucugggcgagaaguggaaaucgcgcuugaacgcucugggaaagagcgaauuucaaauuuauaaaaaguccggaauccaggagguggaccggacccucgccaaagagggcauaaagagaggggaaacagaucaucacgccgucucucguggaucagcgaaacugaggugguucguggagcggaacaugguuacuccagaaggcaaggugguagacuuagguugcgggcgcggaggcuggagcuacuauugugguggccuuaagaaugugcgagaggucaaagggcugaccaagggaggcccugggcaugaggaacccaucccuauguccacauacggauggaaccucguuagacuacagaguggcguggaugucuuuuucacgccacccgagaaaugcgacacccuguugugugauauuggugaaucuagcccuaauccaacuaucgaggcugggaggacacugcgggugcucaaccuuguagaaaauuggcugaacaauaacacccaauucugcauuaagguguugaaucccuauaugccgucaguuaucgagaaaauggaaacucugcagcgcaaguacggaggcgcacucgugagaaacccuuuauccaggaauaguacacacgagauguacugggucagcaacgccaccggcaauauagugucuuccgucaacaugauuucacgaaugcugaucaaucgguuuacgaugaagcacaaaaaggcuaccuaugagccagacguggaucuugggagcggaacacguaacaucgguauugaaucggagauacccaaccuggacaucauuggcaaaagaaucgaaaagauuaaacaggagcaugaaacuucuuggcacuacgaccaggaucauccuuauaagaccugggccuaccacgggaguuaugagacaaagcaaacuggauccgcaagcucaaugguuaauggcguagugcgccuacucaccaaaccaugggacgucgugcccaugguuacacagauggccaugaccgauacuacgccguucggucagcagaggguguuuaaggagaaagucgacacacggacccaagaaccuaaggaggggacuaaaaagcugaugaagaucaccgcugaaugguuguggaaagagcugggaaaggagaaaacacccagaauguguacgcgcgaagaguucaccaggaaggugcgauccaacgcggcccucggcgcaauauuuacugaugaaaauaaauggaagucugcucgggaggccguagaagacagcagauucugggagcuuaucgauagggagcgcaaccugcacuuagaaggcaaaugcgagacauguguguacaauaugauggggaagcgugaaaagaaacugggagaguuugguaaggcaaaaggcagucgggccauuugguauaugugguugggggcuagauuccucgaauuugaggcccugggauuccuaaacgaggaccauugguuuuccagggaaaauagccuuucuggcguugagggugaagggcugcaccgccucggauacauccugcgagaugucucaaagaaagagggcggcgcgauguacgcagacgauaccgccgggugggacacucggauuacauuggaagaccugaagaacgaggagauggugaccaaucauaugaagggagaacacaaaaagcucgcugaggccaucuucaaacuuacauaucagaacaagguggucagaguucagaggccaacuccucgcgguaccgugauggauauuauaaguagacgggaccagaggggcuccgggcaaguaggaacguacggccugaauaccuuuacaaacauggaagcacaguuaauccgucagauggagggugaggggauuuucaaaagcauccaacaucugacugcuaccgaagagaucgccgugcagaauugguuggcucgagucggacgcgaaagacucucucggauggccauuucgggcgaugacugcgugguuaagccccuggaugacagguucgcaucagcgcuaacagcccuuaacgauaugggcaaggugcgcaaagacauacagcagugggagccaagcagaggguggaaugauuggacucaaguccccuuuugcucccaccacuuccaugaacuggugaugaaggacggacggguacucguugugccuuguaggaaccaggaugagcugaucggucgagcucguauuagucagggcgccggguggucuuugaaagagaccgcaugcuuaggaaagagcuaugcucagauguggacgcugauguacuuucacagacgcgaccuccggcuugccgcaaacgccaucuguuccgcggucccaucacauugggugccgacaaguaggaccacuuggucuauucacgcuaaacacgaauggaugacaaccgaggauaugcuggccguguggaauagagucuggauccaagaaaaccccuggauggaggacaagacuccuguugaaagcugggaggaggugccauaucuaggcaagcgcgaagaccaguggugcgguucccugauagggcucaccucacgggcaacaugggccaaaaauauccagacggcuauuaaccagguaaggagcuugaucggaaaugaggaauacaccgauuauaugcccucuaugaagcgauucagacgggaggaagaggaggccggcgugcugugguga

SEQ ID NO: 14660 - RNA, 9876 nt, Artificial Sequence
  derived and/or modified CDS sequence (opt3) from DENV-2__EU569706__SS-prME
accgccggcgugaucauuaugcugauacccaccgcuauggcuuuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggauuauucggcaagggcgggauuguaaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccugacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucgccgaaaaggacuccccugugaacaucgaggcugaacccccauuuggagauagcuacauuauaaucggcgucgagccugggcagcugaaacuaaauugguucaagaagggaucgucuauuggucagauguuugagaccacaaugcgaggcgccaaacgcauggcaauccucggggacacugccugggauuucggaucccugggcgguguguuuaccucaauugggaaggcacuucaccaaguuuucggcgcgaucuacggagcagccuuuaguggcgugagcuggacaaugaaaauauugaucgggguaauuaucacuuggauuggaaugaacuccagaucuaccagccugucagucagucucgugcugguuggcguggucacgcuuuaucugggugugaugguacaggcugacuccgggugugugguuagcuggaagaauaaagaauugaagugcggaucuggcaucuucauaacagauaacguccacaccuggacugagcaguacaaguuucagcccgaaucaccaaguaaacucgccagcgcaauucaaaaggcccaugaggaagguaucuguggcauuagguccgugacacggcuggagaauuuaauguggaaacagaucacccccgagcugaaccacauacuaucugaaaaugaggugaagcucacuaucaugaccggggacauuaaaggaaucaugcaggcuggcaagcgcucgcugagaccucagccaacagaacuuaaauauagcuggaagacgugggggaaggccaaaauguuguccaccgagucacauaaccaaacuuuccugauugauggaccggaaacagcagagugccccaauaccaacagggcguggaauagucucgaggucgaagacuacggcuuugguguuuucucuacaaacaucuggcugaaguuacgugagaaacaggacguguuuugugauagcaagcugauguccgcugccauaaaagacaaucgggcagugcacgccgauaugggguauuggauugaaucagcucuuaacgacacuuggaagauggagaaggccagcuucaucgagguaaaaucuugccacuggccuaagucccauaccuuguggaguaauggaguccucgaaagcgagaugaucauucccaaaaacuucgcaggccccgugucucagcacaacuaccgaccugguuaucauacgcagacagcuggcccauggcaccuggggaagcuagaaauggauuuugacuucugugagggaaccacuguuguggucaccgaagauugcggcaauagagggcccucccugaggacaacuaccgccucaggaaaacucaucacagaguggugcugucgcaguugcacgcugccgccucuucgguacagaggcgaggacgguuguugguacgggauggaaauuaggccauugaaggagaaggaagagaaccuggugaauagcuuaguuaccgcgggacauggccaaauagauaacuuuucgcucggugugcugggcauggcccuuuuccuggaagagauguugcgcacucgaguagggacaaaacacgcuauccuccuggucgcaguguccuuugugacccuaauuacuggaaauaugucuuuccgggaccugggccgugucaugguuauggugggggccacaaugaccgaugacaucggaaugggcguaacguaucucgcucugcuugccgcauuuaaggugagacccacuuucgcggccgguuugcuguuaaggaaacucaccagcaaggagcugaugauggcuacaauugggaucgcccuucugucacagaguaccauaccugaaacuauccuagagcucacagaugcacuggcuuugggaaugaugguccugaaaauugugcgcaacuuagaaaaguaccagcucgccguuaccaucauggcaauuuccugcgugcccaaugccgucauccugcaaaacgcuuggaaggugucuuguacaauacuugcggccguuagcguguccccacuguugcucacuucaagccagcagaaagcagacuggauuccucuggcucuaaccaucaagggccugaaucccacggccaucuuucuuacaacccucagucggacuucuaaaaagagauccuggccacugaacgaggccgucauggcuguaggcauggugagcauuuuggcaucgucacugcucaaaaaugacauaccgaugaccgggccucuaguugccggaggucugcuuacagugugcuauguccugacuggcaggucugcggauuuggaacucgagcgagcugccgacgugaagugggaggaucaggcagaaaucaguggguccagccccauucugucuaucaccauuagcgaggacggauccaugucaaucaaaaacgaagaggaggaacaaacgcuaacaauacugauccgcaccggccuucucguaauuagugguguguucccagucagcauccccauuacugccgcugcaugguaccugugggagguuaagaagcagcgggccgggguguugugggaugugccuucuccacccccugucggaaaagcggaauuagaggacggcgcuuauagaaucaagcagaggggcauauuuggguacucccagauuggagccgguguguauaaagaaggcacauuccacaccauguggcauguuacucguggggcaguacugaugcaccgcggaaagcggaucgagccgucaugggccgaugugaaaaaggaccucaucaguuacggcgguggguggaagcuggagggagaauggaaagagggcgaagagguccaagugcuugcucuggaaccaggcaagaaucccagagccguucagacaaaaccuggguuguuuaagaccaacacgggaacuauuggugcagugagccuagauuucuccccaggcaccucugggucgcccaucgucgacaggaaaggaaaggugguaggccuguacgguaauggggucgugacacgaagcggagcuuauguuucagccauagcgcagaccgagaaguccauugaggauaacccugaaaucgaggacgauauuuuccggaaaaagcgccucacaaucauggaccugcauccgggcgccggcaaaacuaagagauaccuucccgcaauagugagggaagcuauuaaacggggguuacgaacccugauccucgccccaacgagagucguggcugcagagauggaagaggccuugcgcggacugccuaucagguaucagacacccgccauucgugcugagcacacuggucgggaaaucguugaccucaugugucaugcgaccuuuacaaugagacugcuuaguccagugagggucccuaacuacaaucugauuauaauggaugaggcacacuucaccgaccccgccucuaucgcugcccgcggcuauauuagcacucgaguggaaaugggggaggcagccggaaucuuuaugaccgcuacaccaccgggcuccagagauccuuucccccaaucaaacgcgccaaucauggacgaggaacgggagauucccgaaaggucuuggaauagcggucacgaguggguaacggauuuuaaggggaagacugugugguucguuccuaguauaaaagccggaaacgacaucgcagcuugcuugcgcaagaauggcaaaaaggucauucagcuaucccguaaaaccuuugauagcgaauacgugaagacaagagccaacgacugggauuucguggucaccacugacaucucugagaugggcgcaaauuuucgggccgagaggguaauugauccacgccgauguaugaagcccgugauccugacagacggggaagagagaguuauacucgcuggaccuaugccggugacccauucauccgccgcgcagcggaggggucgcaucggcagaaaccccaaaaaugaaaacgaccaauauauuuacaugggggagccauuagaaaaugaugaggacugcgcacacuggaaggaggccaaaaugcugcuugauaacaucaauacgccugaaggaauuauccccaguauguucgagccagaaagggagaaggucgacgcuauagauggcgaauaccggcugcguggugaggcccgcaaaacuuuuguggaccucaugcgaagaggggauuugccuguuuggcuggcuuauaggguggcagccgagggcauuaacuacgcugaccggcgcugguguuucgauggaaucaagaauaaccagauucucgaagagaacgucgaaguggagaucuggacaaaagagggcgaaagaaagaagcugaaacccagguggcuugacgcccggauauauagcgauccacuagcacugaaggaguucaaagaauuugcggccgggcgaaagucguugaccuuaaaucugaucaccgagaugggaagacucccuacuuucaugacacagaaagcucgcgacgcccuggauaaccuugcaguacugcauaccgcugaaguggguggcagggccuacaaucacgcacucucugaguugccggagacacuggaaacucuacugcuccuuacgcuguuagccaccguuacagggggaauauuuuuguuccugauguccggcaaggguaucgggaagaugacucucggcaugugcugcauuaucaccgcuagcauacugcuuugguaugcgcagauucaaccccacuggaucgccgcaucaaucauucuggaguuuuuccucaucgucuugcugauaccagaaccugagaaacagcggacaccccaggacaaccaguuaaccuacguggugauugcuauccuaacugucguugccgccacgauggcaaaugaaaugggauuucuggagaagaccaaaaaggaccucggccuugggaguauuacaacucaagagucugaauccaacauccuggauauagacuugcguccagcuagcgccuggacccuguaugcgguggcuacaaccuucguaacuccuaugcucagacauucaaucgagaauaguagcgugaacgucucccugacagccauugcaaaucaggccacggugcuuaugggacucgguaggggcuggccccugucuaaaauggauaucgggguuccguugcuggcuauuggauguuacagccaggugaacccaaucaccuuaacugcagcccuacugcuccuugucgcgcacuacgcuauuaucggcccuggucugcaggccaaggcaacacgcgaagcccaaaagcgggcugccgcagggauaaugaaaaaucccaccguagacggcauuaccgugaucgauuuggagccaauccccuaugacccuaaguuugaaaaacagcugggacagguuaugcuccuggugcuuugcgucacacagguguuaaugaugcgaacuacgugggcucugugugaggcccucaccuuggcgacaggcccgauuuccacucugugggaggggaaccccggaagauucuggaauaccacaauagccgucucaauggcaaacaucuuuaggggcucuuaccuagcuggugccgggcuacucuucaguauuaugaagaauaccacuaacacgcgccggggaacaggcaauaucggugaaacccuuggcgagaaauggaagucgagacugaacgcauugggaaagagcgaauuucaaauuuauaaaaaguccggaauccaggagguggaucguacucuggcuaaagagggcauaaagagaggggaaaccgaccaucacgccguuucucggggaucagccaaacuccgcugguucguggagcgaaacaugguaacaccagaaggcaagguggucgaucuggguugcgggagaggaggcuggagcuacuauugugguggccuuaaaaauguuagggaggugaaggggcuaacuaagggaggcccugggcaugaggaaccaaucccuauguccaccuacggauggaaccugguccggcuccagaguggcguggacguauucuuuacaccacccgagaaaugcgauacgcuacugugugacauuggugaaucuagcccuaauccaaccaucgaggcggggcgcacuuugagagugcugaaccucguugaaaauuggcuuaacaauaacacacaauucugcauuaaggugcugaaucccuauaugccgucagucaucgagaaaauggaaaccuugcagaggaaguacggaggcgcucuggugcgaaacccucucucccggaauaguacucacgagauguacugggucagcaacgcaacaggcaauauagugucuuccguuaacaugauuucacguauguuaaucaauagauuuaccaugaaacacaagaaggccacguaugagccagauguagaccuggggagcggaacccgcaacaucgguauugaaaacgagauacccaaucuugacaucauuggcaaaaggaucgaaaagauuaaacaggagcaugaaacaucguggcacuacgaucaggaccauccuuauaagacuugggcuuaccacgggucuuaugagaccaaacaaacaggaagugccuccagcauggugaacggcgucgugcggcugcuaacuaagccaugggauguugugcccauggucacccagauggcaaugacagacaccacuccguucggucagcagagaguguuuaaggagaaaguagauacgcgcacacaagaaccuaaggaggggaccaaaaagcucaugaggaucacugccgaauggcuguggaaagaguugggaaagaagaaaacaccccgaauguguacacgggaggaguucacgagaaaggugaggucaaaugcugcgcugggcgccauauuuaccgacgagaacaaauggaaguccgcacgcgaagcuguugaggauucucguuucugggaacucgucgaccgggagagaaaucuucaccuggagggcaaaugcgaaacuuguguguacaacaugauggggaagagggagaaaaaguuaggagaauuugguaaggccaaaggcagccgcgcaaucugguauauguggcugggggcccgauucuuggaguuugaagcucucggauuccugaaugaggaucauugguuuagucggggcaacucccuaagcgguguggagggggaaggacuucacaagcugggcuacauucucagagacgucucuaaaaaggagggcggggccauguacgcggaugacacagcaggaugggacaccaggaucacucuggaagauuugaaaaaugaggaaaugguuacaaaccauaugaagggugagcacaagaaacuggccgaggcuauuuucaagcucaccuaucagaauaaagugguacgcgugcagagaccaacaccucggggcacugucauggacaucauuucaaggaaggaucagcgugggaguggacaagugggcaccuacggucuuaacacguucaccaauauggaagcccagcugauacgacagauggagggggaaggaaucuuuaaauccauucaacauuuaacaguuacugaggagaucgcagugcagaacuggcuggcucgcgucggcagagaacgguugagcaggauggccaucucuggcgacgauugcgugguaaagccccucgacgaucgcuucgcuucggcccugaccgcacuaaaugacauggggaagguuagaaaagauauucagcagugggagccaucacggggauggaacgacuggacacaagugcccuuuugcagccaccacuuccaugaacuugucaugaaggaugguagggugcugguggucccuugucgaaaccaggacgagcucauaggccgugcgagaaucucccagggggccggauggagucugaaagaaacugcuugcuugggcaagucuuaugcccagauguggaccuuaauguacuuucaccgccgggaucugaggcucgcagcuaaugccauuuguagcgcaguuccaucccauugggugccgacgucaagaacaaccuggaguauccacgccaaacacgaguggaugacuacagaggacaugcuugcgguauggaaccgcguguggauucaagaaaaucccuggauggaggacaagaccccugucgaaucuugggaggaagugccauaucuggguaagcgggaggaucaguggugcgggagccuaaucggacugacuuccagggcuaccugggccaaaaacauacagacagcaaucaaucagguucgaucacucauuggcaacgaggaauacacggacuauaugcccagcaugaagagauuccggaaagaggaagaggaagccggcguguugugguga

SEQ ID NO: 14661 - RNA, 9876 nt, Artificial Sequence
  derived and/or modified CDS sequence (opt3) from DENV-2__EU569707__SS-prME
accgcaggcgugaucauuaugcugauacccaccgcuauggcauuccaccucacuacgagaaacggggaaccucauaugaucgucgggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcguggaagcaaaguugacaaacacuaccacagagagucgcuguccaacucaaggagagcccucccugaaugaagaacaggacaaacgauuugucugcaagcauucuaugguggauagaggcugggguaacggguguggacuauucggcaagggcgggaucgugaccugcgccauguuuacaugcaaaaagaauauggaaggaaaagucguucucccugagaaccuggaauacaccaucgugauuacuccacacagcggugaggagcaugcuguaggcaaugacacggggaagcacggaaaagaaauaaagaucacaccgcaguccucaauuaccgaggccgaacuuacuggcuaugguaccgugacaauggaguguagucccaggaccgggcuggauuucaacgaaauggucuugcuccggauggaggacaaagcauggcuggugcaccgucagugguuuuuagaucugccucucccauggcuucccggcgcugacacucaaggaagcaauuggauccagaaggagacacugguuacguucaagaacccucaugccaaaaagcaggacguggucguguugggcucucaggaaggggcgaugcacaccgcccuaacuggagcaacagagauacaaauguccucagguaaucugcucuuuaccggccaucugaaaugccgccuuagaauggauaagcugcaguugaaagggaugagcuacaguauguguacaggaaaguucaagauuguaaaagaaaucgcugagacucagcacggcaccaucguuauuagggugcaauaugagggugacgggucuccaugcaagauccccuucgaaauuauggaucucgagaaacggcauguccugggccgauuaauaacggugaacccgaucgucgccgaaaaggacuccccugugaacauugaggcugaacccccauuuggagauagcuacaucaucauuggcguugagccugggcagcugaaacuaaauugguucaagaagggaucgucuauaggucagauguuugagaccacaaugcgcggcgccaaaagaauggcaauccucggggacacugccugggauuucggaucccugggcgguguguuuaccucaauugggaaggcacuucaccagguauucggcgcgaucuacggagcagccuuuaguggcgucagcuggacaaugaaaauuuugaucggggugauaaucacuuggauuggaaugaacuccaggucuaccagccugucaguuagucucgugcuggucggcgugguaacgcuuuaucugggugcuauggugcaagccgacuccggguguguugucagcuggaagucuaaagaauugaagugcggaucaggcaucuucauuacagauaaugugcacaccuggacugagcaguacaaguuucagcccgaaaguccaagcaaacucgcauccgccauccagaaggcucaugaggaagguauauguggcauucggucugugacacgccuggagaacuuaauguggaaacaaaucacccccgagcugaaucacauucuaucggaaaacgaggucaagcucacuaucaugaccggggacauaaaaggaaucaugcaggccggcaagagaagccugaggccucagccaacagaacuuaaauauuccuggaagacgugggggaaggcaaaaauguugucaaccgagagucauaaucagacuuuccugauugauggaccggaaacagcggagugccccaacaccaaucgugcuuggaacucucucgagguugaagacuacggcuuugguguguucacaacuaauaucuggcugaaguuacgggagaaacaagacguguuuugugauagcaagcugauguccgccgcaauuaaagacaaccgagccguacacgcugauaugggguauuggaucgaaucagcccuuaaugacaccuggaagauggagaaggcuucauucauagaggucaaaucuugccacuggccuaagucccauacguuguggaguaacggagugcucgaaagcgagaugauuauccccaaaaauuucgcuggccccguuucucagcacaacuacagaccugguuaucauacacagaccgccggcccauggcaccuggggaagcuagaaauggauuuugacuucugugagggaacuaccguggucgugacagaagauugcggcaacagggggcccucccugcgcacuaccacagcgucaggaaaacucaucacggaguggugcugucggaguugcacccugccgccucuuagauacaggggcgaggacgguuguugguacgggauggaaauucgcccauugaaggagaaggaagagaaucugguuaacagcuuagugacugccggacauggccagaucgauaauuuuucgcucgguguacugggcauggcucuuuuccuggaagagauguugcgaacacgggucgggaccaaacacgcaaugcuccugguggccguguccuuugucacucuaauuacaggaaacaugucuuuccgugaccugggcagaguuauggugaugguaggggcuaccaugacggaugacauaggaaugggcaucacuuaucucgcccugcuugcagcguuuaaggugaggcccaccuucgccgcugguuugcuguuacgcaaacucacaagcaaggagcugaugauggccaccauugggaucgcacuucugucacaaaguacuauuccugaaacaauccuagagcucaccgaugcucuggccuugggaaugaugguccugaaaauagugcggaauauggaaaaguaccaguuagcaguuacaaucauggccauuuccugcgugcccaacgcugucauccuccagaaugcguggaaggugucuuguacuauucuggccgcaguuagcguguccccacuucuguugaccucaagccaacagaaagcugacuggaucccucucgcccugacgauaaagggccuaaaccccacagccauuuuucugaccacucuuaguagaaccucuaaaaagagguccuggccacucaaugaggcuaucauggcagucggcaugguaagcauccuggccucgucauugcugaaaaacgacauuccgaugacagggccuuuaguggcgggaggucuccugacuguuugcuaugugcuuaccggccgaucugcugaucuggaauuggagcgcgccgcagacgucaagugggaggaucaggccgaaauaaguggguccagccccauccucucuauuacgaucagcgaggacggauccaugucaauuaaaaaugaagaggaggaacagacacugaccauccuaauacggacuggccugcuugugaucagugguguauucccagugagcauucccaucacagcugcagccugguaccucugggaggucaagaagcaaagagcggggguucugugggaugugccuucuccacccccugugggaaaagcugaauuggaggacggcgccuauaggauuaagcagcguggcaucuuaggguacucccagauaggagccgguguauauaaagaaggcaccuuucacacuauguggcaugugacacgcggggcaguucugaugcaccggggaaagagaauugagccgucaugggcugaugucaaaaaggaccucaucaguuacggcgguggguggaagcuggagggagaauggaaagagggcgaagaggugcagguccuugcccuggaaccaggcaagaaccccagggcagugcaaaccaaaccuggguuguucaagacgaauacuggaaccaucggugcuguuagccuagauuuuuccccaggcacaucugggucgcccauuguggaccgaaaaggaaaggucgugggccuguacgguaacgggguagucacccggagcggagccuaugugucagcgaucgcccagacagagaaguccauagaggauaauccugaaauugaggacgauaucuuccgcaaaaagagacucacuauuauggaccugcauccgggcgcaggcaaaaccaagagguaccuucccgcuaucguucgggaagccauaaaacgaggguuaagaacgcugauucucgcuccaacacgcguggucgcagccgagauggaagaggccuugaggggacugccuauccguuaucagacucccgcuauccgggcggagcacaccgguagagaaauuguggaccucaugugucaugcaacauucaccaugaggcugcuuaguccaguucgcgugccuaacuacaaccugaucauuauggaugaggcccacuuuacugaccccgcuucuauagccgcacgaggcuauaucagcaccagagucgaaaugggggaggccgcuggaauuuucaugacagcgacgccaccgggcucccgggauccuuuuccccagucaaaugccccaaucauggacgaggaaagggagauccccgaacgcucuuggaacagcggucacgagugggugacugauuucaaggggaagaccguaugguuugugccuaguauuaaagcaggaaaugacauagcugccugcuugcguaagaacggcaaaaagguuauccaacuauccagaaaaacauucgauagcgaauacgucaagacccgggcaaaugacugggauuuuguggugacuacagacauuucugagaugggcgccaacuucaaggcugagagggucaucgauccacgccgauguaugaaacccguaauucugaccgacggggaagagagagugauccucgccggaccuaugccgguuacgcauucauccgcggcacagcggaggggucgcauaggcagaaauccaaagaacgaaaaugaccaguauaucuacaugggggagcccuuagaaaacgaugaggacugcgcccacuggaaagaggcuaagaugcugcuugauaauauuaacacuccugaaggaaucauucccaguauguuugagccagaaagggagaaaguggacgccaucgauggcgaauaccggcugcguggugaggcucgcaagacauucgucgaccucaugcgaagaggggauuugccuguguggcuggcauauaggguugccgcugagggcauaaauuacgccgaccggcgcugguguuuugauggaauuaaaaacaaucaaauccucgaagagaacguggaagucgagauuuggaccaaggagggcgaaagaaagaaacugaagcccagguggcuugacgcacggaucuauagcgauccacuagcgcugaaagaguucaaggaguucgccgcugggcgaaaaucguugaccuuaaaccugauaacugagaugggaagacucccuacauuuaugacccagaaggcccgcgacgcacuggauaaucuugcugugcugcauacagccgaagccgguggcagggccuacaaccacgcucucucugaguugccggagacucuggaaacgcuacugcuccuuacccuguuagcgacaguaacugggggaaucuucuuguuucugauguccggcaaggguauugggaaaaugacccucggcaugugcugcaucauuacagccagcauccugcuuugguaugcacagauacagccccacuggauugcugccucaaucauccuggaguucuuucucauuguguugcugaucccagaaccugagaagcaacggaccccacaggacaaucaguuaacuuacguugucauagccauucuaacggugguggcagcuaccauggccaacgaaaugggauuccuggagaaaacaaagaaagaccucggccuugggaguaucgcgacucaggagucugaauccaauauucuggauaucgacuugcguccagcuagcgccuggacccuguaugcagucgccacaaccuuuguuacuccuaugcucagacauucaauagagaacaguagcgugaauguaucccugacagcuaucgcaaaccaagccacggugcuuaugggacucgguaagggcuggccccugucuaagauggauauuggggucccguugcuggcgaucggauguuacagccaggugaauccaauuaccuuaacugcugcccuacugcuccuuguugcacacuacgccaucauuggcccuggucugcaggcuaaagccacaagggaagcacagaagcgcgcugccgcggggaucaugaaaaaccccaccguggacggcauaaccgucauugauuuggagccaauccccuaugacccuaaguucgaaaaacaacugggacagguaaugcuccugauccuuugcgugacacagguuuuaaugaugcggacuacgugggcccugugugaggcacucaccuuggcuacaggcccgauuuccacucugugggaggggaaucccggacgauuuuggaacaccacaauagccgugucaauggcaaauaucuucagaggcucuuaccuagcuggugccgggcugcucuuuaguauuaugaagaacaccacuaauacgaggcgcggaacaggcaacaucggugaaacccuuggcgagaaguggaaaucgcggcugaaugccuugggaaagagcgaguuccagauuuauaaaaaguccggaauccaagaggucgauagaacucuggcgaaagagggcauaaagcguggggaaaccgaccaucacgcugugucuaggggaucagcaaaacuccggugguuugucgagcgcaacauggugacaccagaaggcaagguuguggaucuggguugcgggcgaggaggcuggagcuacuauugugguggcuuaaagaacguaagagaggugaaagggcuuacuaagggaggcccugggcaugaagaacccaucccuauguccaccuacggauggaaucuggucaggcuccagaguggcguugacguguucuucacaccacccgagaaaugcgauacgcuacugugugacauuggugaaucuagcccuaacccaaccaucgaggccgggcggacuuugcgcguccugaaucucguggaaaacuggcuuaauaacaauacacaguuuugcauuaagguacugaaccccuauaugccgucagugaucgagaaaauggaaaccuugcaaagaaaguacggaggcgcucugguuaggaauccucucucccgaaacaguacucacgagauguacugggugagcaaugccacaggcaacauagucucuuccgugaauaugauuucacggauguuaaucaaccguuucaccaugaagcacaaaaaggcaacguaugagccagaugucgaccuggggagcggaaccagaaauaucgguauugaaucggagauacccaaccuugacaucauuggcaaacgcaucgaaaagauuaaacaggagcaugaaacaucuuggcacuacgaucaggaccauccuuauaagacuugggccuaccacgggaguuaugagaccaagcagacaggauccgcuagcucaauggugaacggcguuguaaggcugcuaacuaaaccaugggaugugguccccauggugacccaaauggcgaugacagacaccacuccguuuggucagcagcggguuuucaaggagaaaguggauacgagaacacaggaaccuaaggaggggaccaaaaagcucaugaagaucacugccgaauggcuguggaaagaguugggaaagaaaaagacaccccgcauguguacaagggaggaauuuacgcgaaaaguccgguccaaugcagcucugggcgccauauucaccgacgagaacaaguggaaaucugcaagagaagccguggaggauagcagguuuugggaacucaucgaccgcgagcguaaucuucaccuggagggcaagugcgaaacuuguguauacaacaugauggggaagcgggagaaaaaguuaggagaguucgguaaagcuaagggcaguagagccauuugguauauguggcugggggcgagguuuuuggaguucgaagcacucggauuucugaaugaggaucauugguucucccgcggcaacagccuaucugguguggagggggaaggacuucaccgacugggcuacauccuccgggacguuagcaaaaaggagggcggggccauguacgcugaugacacagccggaugggacaccagaauuacucuggaagauuugaagaaugaggaaauggucacaaaccauaugaaaggugagcacaagaaacuggcagaggcuaucuuuaagcucaccuaucaaaauaaaguggugaggguccagcgcccaacaccuagaggcacuguuauggacauuauaagucggagggaucagcguggguccggacaggugggcaccuacggucuuaacacguucaccaauauggaagcccaacugauccgacagauggagggggaaggaauuuucaagagcauccagcauuuaacaguaacugaggagaucgcugugcaaaacuggcuggcccgcgucggcagagaacgguugucuaggauggcaauuucgggcgacgauugcgugguuaagccccucgacgaucgcuuugcgucagcccugaccgcucuaaaugacauggggaaagugagaaaggauauacagcagugggagccaagccggggauggaacgacuggacacagguccccuucugcucccaccacuuucaugaacuugugaugaaagaugguaggguacugguugugccuugucgaaaucaagacgagcucaucggccgugccagaauuagucagggggcaggauggucucugaaggaaacugcuugcuugggcaaaagcuaugcccagauguggaccuuaauguacuuccaccgccgggaucugaggcucgcagccaacgcgaucuguuccgcugucccaucacauugggugccgacgaguagaacaaccuggucuauucacgccaagcacgaguggaugacuacagaggacaugcuugcaguguggaaccgcgucuggauccaggaaaaucccuggauggaggacaagaccccuguugaaagcugggaggaagugccauaucuggguaaacgggaggaucaauggugcgggucccuaauaggacugacuucaagggccaccugggcuaagaacauccagacagccauuaaucagguacgaagccucaucggcaacgaggaauacacggacuauaugcccucuaugaaaagauuucggagggaggaagaggaagcaggcguguugugguga

SEQ ID NO: 14662 - RNA, 9876 nt, Artificial Sequence
  derived and/or modified CDS sequence (opt3) from DENV-2__EU660399__SS-prME
accgcaggcgugaucauuaugcugauacccaccgcuauggcauuccaccucacuacgcggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcacuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucacaacuaauauuuggcugaaguuacgugagaaacaggacguguuuugugauagcaagcugauguccgccgcaaucaaagacaaccgggccgugcacgcugauaugggguauuggauagaaucagcccuuaaugacaccuggaagauggagaaggcuucauucauugagguaaaaucuugccacuggccuaagucccauacguuguggaguaacggaguccucgaaagcgagaugaucauccccaaaaauuucgcuggccccgugucucagcacaacuaccgaccugguuaucauacacagaccgccggcccauggcaccuggggaagcuagaaauggauuuugacuucugugagggaacuaccguuguggucacagaagauugcggcaacagagggcccucccugaggacuaccacagcgucaggaaaacucauuacggaguggugcugucgcaguugcacccugccgccucuucgguacagaggcgaggacgguuguugguacgggauggaaaucaggccauugaaggagaaggaagagaaucuggugaacagcuuaguuacugccggacauggccaaauugauaauuuuucgcucggugugcugggcauggcucuuuuccuggaagagauguugcgcacacgaguagggaccaaacacgcaaugcuccuggucgccguguccuuugugacucuaauaacaggaaacaugucuuuccgggaccugggccgugucaugguuauggugggggcuaccaugacggaugacaucggaaugggcauuacuuaucucgcccugcuugcagcguuuaagguaagacccaccuucgccgcugguuugcuguuaaggaaacucacaagcaaggagcugaugauggccaccaucgggauugcacuucugucacagaguacuaucccugaaacaauacuagagcucaccgaugcucuggccuugggaaugauggugcugaaaaucguccgcaauauggaaaaguaccaguuagcagugacaauuauggccaucuccugcguucccaacgcugugauucuccaaaaugcguggaaggucucuuguacuauccuggccgcagugagcguuuccccacuucuguugaccucaagccagcagaaagcugacuggauaccucucgcccugacgauuaagggccuaaaccccacagccaucuuucugaccacucuuagucggaccucuaaaaagagauccuggccacucaaugaggcugugauggcagucggcaugguaagcauccuggccucgucauugcugaaaaacgacauuccgaugacagggccuuuaguggcgggaggucuccugacuguuugcuaugugcuuaccggcaggucugcugaucuggaauuggagcgagccgcagacgucaagugggaggaucaggccgaaauaaguggguccagccccauccucucuauuacgaucagcgaggacggauccaugucaauuaaaaaugaagaggaggaacaaacacugaccauccuaauacgcacuggccugcuugugaucagugguguauucccagugagcauucccaucacagcugcagccugguaccucugggaggucaagaagcagcgggcggggguucugugggaugugccuucuccacccccugugggaaaagcugaauuggaggacggcgccuauagaauuaagcagaggggcaucuuaggguacucccagauaggagccgguguauauaaagaaggcaccuuucacacuauguggcaugugacacguggggcaguucugaugcaccgcggaaagcggauugagccgucaugggcugaugucaaaaaggaccucaucaguuacggcgguggguggaagcuggagggagaauggaaagagggcgaagaggugcaaguccuugcccuggaaccaggcaagaaccccagagcagugcagaccaaaccuggguuguucaagacgaauacuggaaccaucggugcuguuagccuagauuuuuccccaggcacaucugggucgcccauuguggacaggcagggaaaagucgugggccuguacgguaacgggguagucacccgaagcggagccuaugugucagcgaucgcccagacagagaaguccauagaggauaauccugaaauugaggacgauaucuuccggaagaaacgccucacuauuauggaccugcauccgggcgcaggcaagaccaaaaaguaccuucccgcuaucguuagagaagccauaaaaaggggguuacggacgcugauucucgcuccaacacgaguggucgcagccgagauggaagaggccuugagaggacugccuauccgcuaucaaacucccgcuaucagggcggagcacaccggucgugaaauuguggaccucaugugucaugcaacauucaccaugcggcugcuuaguccaguuagagugccuaacuacaaccugaucauuauggaugaggcccacuuuacugaccccgcuucuauagccgcaaggggcuauaucagcacccgcgucgaaaugggggaggccgcuggaauuuucaugacagcgacgccaccgggcucccgagauccuuuuccccagucaaaugccccaaucauggacgaggaaagagagauccccgaacggucuuggaacagcggucacgagugggugacugauuucaaggggaagaccguaugguuugugccuaguauuaaagcaggaaaugacauagcugccugcuugaggaagaacggcaaaaagguuauccagcuaucccgcaaaacauucgauagcgaauacgucaagacccgugcaaaugacugggauuuuguggugacuacagacauuucugagaugggcgccaacuucaaggcugagagagucaucgauccacggagguguaugaaacccguaauucugaccgacggggaagaacgcgugauccucgccggaccuaugccgguuacgcauucauccgcggcacaacgaagaggucggauaggcaggaauccaaagaacgaaaaugaccaguauaucuacaugggggagcccuuagaaaacgaugaggacugcgcccacuggaaagaggcuaagaugcugcuugauaauauuaacacuccugaaggaaucauucccaguauguuugagccagaacgcgagaaaguggacgccaucgauggcgaauacagacugaggggugaggcucggaagacauucgucgaccucaugcgucgcggggauuugccuguguggcuggcauaucgaguugccgcugagggcauaaauuacgccgacagaaggugguguuuugauggaauuaaaaacaaucagauccucgaagagaacguggaagucgagauuuggaccaaggagggcgaacggaagaaacugaagccccgcuggcuugacgcaagaaucuauagcgauccacuagcgcugaaagaguucaaggaguucgccgcugggaggaaaucguugaccuuaaaccugauaacugagaugggacggcucccuacauuuaugacccagaaggcccgagacgcacuggauaaucuugcugugcugcauacagccgaagccgguggcagagccuacaaccacgcucucucugaguugccggagacucuggaaacgcuacugcuccuuacccuguuagcgacaguaacugggggaaucuucuuguuucugauguccggcaaggguauugggaaaaugacccucggcaugugcugcaucauuacagccagcauccugcuuugguaugcacaaauacagccccacuggauugcugccucaaucauccuggaguucuuucucauuguguugcugaucccagaaccugagaagcagcgcaccccacaggacaaucaauuaacuuacguugucauagccauucuaacggugguggcagcuaccauggccaacgaaaugggauuccuggagaaaacaaagaaagaccucggccuugggaguaucgcgacucaggagucugaauccaauauucuggauaucgacuugaggccagcuagcgccuggacccuguaugcagucgccacaaccuuuguuacuccuaugcuccggcauucaauagagaacaguagcgugaauguaucccugacagcuaucgcaaaccaggccacggugcuuaugggacucgguaagggcuggccccugucuaagauggauauuggggucccguugcuggcgaucggauguuacagccaggugaauccaauuaccuuaacugcugcccuacugcuccuuguugcacacuacgccaucauuggcccuggucugcaagcuaaagccacacgugaagcacagaagagagcugccgcggggaucaugaaaaaccccaccguggacggcauaaccgucauugauuuggagccaauccccuaugacccuaaguucgaaaaacagcugggacagguaaugcuccugauccuuugcgugacacaaguuuuaaugaugaggacuacgugggcccugugugaggcacucaccuuggcuacaggcccgauuuccacucugugggaggggaaucccggacgcuuuuggaacaccacaauagccgugucaauggcaaauaucuuccggggcucuuaccuagcuggugccgggcugcucuuuaguauuaugaagaacaccacuaauacgcgaagaggaacaggcaacaucggugaaacccuuggcgagaaguggaaaucgaggcugaaugccuugggaaagagcgaguuccagauuuauaaaaaguccggaauccaggaggucgaucgcacucuggcgaaagagggcauaaagagaggggaaaccgaccaucacgcugugucuagaggaucagcaaaacuccguugguuugucgagaggaacauggugacaccagaaggcaagguuguggaucuggguugcgggcggggaggcuggagcuacuauugugguggcuuaaagaacguacgcgaggugaaagggcuuacuaagggaggcccugggcaugaagaacccaucccuauguccaccuacggauggaaucugguccgacuccaaaguggcguugacguguucuucacaccacccgagaaaugcgauacgcuacugugugacauuggugaaucuagcccuaacccaaccaucgaggccgggagaacuuugaggguccugaaucucguggaaaacuggcuuaauaacaauacacaguuuugcauuaagguacugaaccccuauaugccgucagugaucgagaaaauggaaaccuugcagcggaaguacggaggcgcucugguucgcaauccucucuccagaaacaguacucacgagauguacugggugagcaaugccacaggcaacauagucucuuccgugaauaugauuucaaggauguuaaucaaccgauucaccaugaagcacaaaaaggcaacguaugagccagaugucgaccuggggagcggaacccggaauaucgguauugaaucggagauacccaaccuugacaucauuggcaaacguaucgaaaagauuaaacaggagcaugaaacaucuuggcacuacgaucaagaccauccuuauaagacuugggccuaccacgggaguuaugagaccaagcagacaggauccgcuagcucaauggugaacggcguuguaagacugcuaacuaaaccaugggaugugguccccauggugacccagauggcgaugacagacaccacuccguuuggucagcaacgcguuuucaaggagaaaguggauacgaggacacaggaaccuaaggaggggaccaaaaagcucaugaagaucacugccgaauggcuguggaaagaguugggaaagaaaaagacaccccggauguguacaagagaggaauuuacgcgcaaagucagguccaaugcagcucugggcgccauauucaccgacgagaacaaguggaaaucugcacgagaagccguggaggauagccgguuuugggaacucaucgacagagagaggaaucuucaccuggagggcaagugcgaaacuuguguauacaacaugauggggaagcgcgagaaaaaguuaggagaguucgguaaagcuaagggcagucgugccauuugguauauguggcugggggcgcgguuuuuggaguucgaagcacucggauuucugaaugaggaucauugguucuccagaggcaacagccuaucugguguggagggggaaggacuucacaggcugggcuacauccuccgcgacguuagcaaaaaggagggcggggccauguacgcugaugacacagccggaugggacacccgaauuacucuggaagauuugaagaaugaggaaauggucacaaaccauaugaaaggugagcacaagaaacuggcagaggcuaucuuuaagcucaccuaucagaauaaaguggugcggguccagagaccaacaccuaggggcacuguuauggacauuauaagucgcagagaucaacggggguccggacaggugggcaccuacggucuuaacacguucaccaauauggaagcccagcugaucaggcaaauggagggggaaggaauuuucaagagcauccagcauuuaacaguaacugaggagaucgcugugcagaacuggcuggcccgugucggccgagaacgcuugucuagaauggcaauuucgggcgacgauugcgugguuaagccccucgacgaucgguuugcgucagcccugaccgcucuaaaugacauggggaaagugaggaaggauauacagcaaugggagccaagccgcggauggaacgacuggacacagguccccuucugcucccaccacuuucaugaacuugugaugaaagaugguagaguacugguugugccuugucggaaucaggacgagcucaucggcagggcccgaauuagucagggggcaggauggucucugaaggaaacugcuugcuugggcaaaagcuaugcccaaauguggaccuuaauguacuuccaccguagagaucugcgccucgcagccaacgcgaucuguuccgcugucccaucacauugggugccgacgagucggacaaccuggucuauucacgccaagcacgaguggaugacuacagaggacaugcuugcaguguggaacagggucuggauccaggaaaaucccuggauggaggacaagaccccuguugaaagcugggaggaagugccauaucuggguaaaagagaggaucaguggugcgggucccuaauaggacugacuucacgcgccaccugggcuaagaacauccagacagccauuaaucaaguacggagccucaucggcaacgaggaauacacggacuauaugcccucuaugaaaagguuucgaagagaggaagaggaagcaggcguguugugguga

SEQ ID NO: 14663 - RNA, 9876 nt, Artificial Sequence
  derived and/or modified CDS sequence (opt3) from DENV-2__EU569708__SS-prME
accgccggcgugaucauuaugcugauaccaacggcuauggcuuuccaccucacuacgagaaacggggaaccucauaugaucgucggaaggcaggaaaaggguaaaagccuucuguuuaagaccgaagacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuaucugcaagcauucuaugguggauagaggcugggguaacggguguggacuuuucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggaaaagaaauuaagaucacgccgcaguccucaauaacagaggcagaacuuaccggcuaugguacugugaccauggaguguagucccaggacagggcuggauuucaacgaaaugguauugcuccagauggaggagaaggcuuggcuggugcaccggcaaugguuuuuagaccugccucucccauggcuucccggcgccgauacccagggaagcaauuggauucagaaggaaacucuggucacauucaagaacccucaugcgaaaaagcaggacgugguuguguugggcucucaagagggggccaugcacacggcacuaaccggagcuacugaaauccagauguccucagguaaucugcucuuuacaggccaucugaaaugccgucuucgcauggacaagcugcaguugaaagggaugagcuacaguauguguaccggaaaguucaagaucgucaaagagauugccgagacacaacacggcacuaucgugauuagaguacaguaugaaggugaugggucuccaugcaagauacccuucgagaucauggaccucgagaagaggcauguucugggccgguuaauuaccgugaacccgaucgucacggagaaggauuccccugugaacaucgaagcugagcccccauuuggagacagcuacauuauaaucggcgucgagccugggcagcugaaacuaaauugguucaagaagggaucgucuauuggucagauguuugaaaccacaaugcgaggcgccaaacgcauggcaauccucggggauacugccugggacuucggaucccugggcgguguguuuaccucaauugggaaggcacuucaccaaguuuucggcgcgaucuacggagcagccuuuaguggcgugagcuggacaaugaaaauauugaucgggguaauuaucacuuggauuggaaugaacuccagaucuaccagccugucagucagucucgugcugguuggcguggucacgcuuuaucugggugcuauggugcaggccgauuccggguguguagugagcuggaagaauaaagaguugaagugcggaucuggcaucuucauaacagacaacguucacaccuggacugaacaguacaaguuucagcccgagucaccaaguaaacucgcaagcgccauucaaaaggcucaugaagaggguaucuguggcauuagguccgucacacggcuggagaauuuaauguggaaacagaucacccccgaacugaaccacauacuaucugagaaugaagugaagcucacuaucauuaccggggauaucaaaggaauuaugcaggccggcaagcgcucgcugagaccucagccaacagagcuuaaauauagcuggaagacgugggggaaggcaaaaauguuguccaccgaaucacauaaccaaacuuuccugaucgacggaccggagacagcggagugccccaauaccaacagggcuuggaauagucucgaaguggaggauuacggcuuuggugucuucacaacuaacauauggcugaaguuacgugaaaaacaggacguauuuugugacucuaagcugaugagcgccgcaauuaaagauaaucgggccgugcacgcugacaugggguauuggaucgaguccgcccuuaacgauaccuggaagauggagaaggcaucauucaucgaagugaaaagcugccacuggccuaagucucauacguugugguccaauggaguacucgagagugaaaugauuauccccaaaaauuucgcuggccccgucagccagcacaacuaccgaccugguuaucauacacagaccgccggcccauggcaccuggggaagcuagagauggacuuugauuucugugaaggaacuaccgugguugugacagaggacugcggcaauagagggcccucucugaggacuaccacagcguccggaaaacucauuacggaguggugcugucgcucaugcacccugccgccucuucgguacagaggcgaagaugguuguugguacgggauggagauaaggccauugaaggaaaaggaggaaaaccuggucaauaguuuagugacugccggacauggccaaaucgacaacuuuagccucgguguucugggcauggcucuuuuccuggaggagauguugcgcacacgaguggggaccaaacacgcaauucuccugguagccgucucguuugugacucuaaucacaggaaauauguccuuccgggaucugggccgugugauggucaugguuggggcuaccaugacggacgauauuggaaugggcgugacuuaucucgcccugcuugcagcguuuaagguaagacccaccuucgccgcugguuugcuguuaaggaaacucacaucuaaggaacugaugauggccaccaucgggauagcacuucugagccagucaacuaucccugagacaauucuagaacucaccgacgcucuggccuugggaaugauggugcugaaaaucguccgcaacauggagaaguaccaguuagcagugacaauuauggccaucaguugcguucccaaugcugugauacuccugaacgcguggaaggucuccuguacuauucuugccgcagugucuguuagcccacuguugcucaccuccucacaacagaaaacggauuggaucccucuggcucuaacaaucaagggccugaaucccaccgccauuuuucuuacuacccucagccggacaaguaaaaagagaucuuggccacugaacgaagccgugauggcugucggcaugguauccauauuggcaagcucgcugcucaaaaaugacaucccgaugacugggccucuaguggccggaggucugcuuaccguuugcuaugugcugacgggcaggucagcggacuuggagcucgagcgagcugccgaugucaagugggaagaccaggcagagauuucugggaguucccccauccugagcgugacaauuucugaagauggaagcauguccaucaaaaacgaggaggaagaacagacccuaacuauacugauccgcacaggccuucucguaauuucagguguguucccagucaguauccccauuaccgccgcugcaugguaccugugggaaguuaagaagcaacgggccgggguguugugggacgugccuagcccacccccugucggaaaagcggaguuagaagauggcgcuuauagaaucaagcagaggggcauacugggguacucucagauuggagccgguguguauaaagagggcacuuuucacacaauguggcauguuacccguggggcaguacucaugcaccgcggaaagcggaucgagccguccugggccgacgugaaaaaggaucugaucucauacggcgguggguggaaacuugaaggagaguggaaagaaggcgaggaaguccaggugcuggcuuuggagccaggcaagaaucccagagccguucaaacgaaaccugggcuauucaagacuaacaccggaacaauuggugcagugagucuggacuuuagcccaggcaccuccgggucucccaucgucgauaggaaaggaaaggugguaggccucuacgguaauggggucgugacacgaucgggagcuuauguuagcgccauagcgcagacugagaagucaauugaagacaacccugagaucgaagaugacauuuuccggaaaaagcgccugaccaucauggaucuucauccgggcgccggcaaaacgaagagauacuuacccgcaauagugagggaggcuauuaaacgggggcugcgaacacucaucuuggccccaacuagagucguggcugcagaaauggaggaggcccugcgcggacucccuaucagguaucagacccccgccauucgugcugaacacacaggucgggagaucguugaccugaugugucaugcgaccuucacuaugagacuucuguccccagugagggucccuaacuacaauuugauuauaauggacgaagcacacuuuaccgaucccgccaguaucgcugcccgcggcuauauuucuacacgaguggagaugggggaggcagccggaaucuucaugacggcuacuccaccgggcagcagagacccuuuuccccaguccaacgcgccaaucauggaugaagaacgggaaauucccgagaggucauggaacucuggucacgaauggguaaccgacuucaaggggaagacagugugguuuguuccuagcauaaaagccggaaacgauaucgcagcuugccuacgcaagaauggcaaaaaggucauucaacugagucguaaaaccuucgacuccgaguacgugaagacuagagccaacgauugggacuuuguggucacaaccgauaucagcgagaugggcgcaaauuuccgggccgaaaggguaauugacccacgccgauguaugaagcccgugauccucacggauggggaggaaagaguuauauuagcuggaccuaugccggugacucauucuucagccgcgcagcggaggggucgcaucggcagaaaccccaaaaaugagaacgaccaguauauuuacaugggggaaccacuggagaaugacgaggauugcgcacacuggaaggaagccaaaaugcuucuggacaacaucaauacaccugagggaauuauccccuccauguuugaaccagagagggaaaaggucgaugcuauagacggcgaguaccggcuccguggugaggcccgcaaaaccuucguggauuugaugcgaagaggggaccugccuguuuggcucgcuuauaggguggcagccgaaggcauuaacuacgcugaucggcgcugguguuuugacggaaucaagaauaaccaaauucuggaggaaaacgucgagguggagaucuggaccaaagaaggcgagagaaagaaacuuaaacccagguggcuagaugcccggauauauagugacccacuggcauugaaggaguucaaagaguucgcggccgggcgaaagagcuuaacucugaaucucaucacagaaaugggaagacugccuaccuuuaugacacagaaagcucgcgaugcccuugacaaccuggcaguacuccauacugcugaggccgguggcagggcauacaaucacgccuugucggagcugccggaaacgcuagagacccugcuccuucugacauuauuggcuacugugaccgggggaauuuuccuguuucucaugucuggcaaggguaucgggaagaugacacugggcaugugcugcauuaucaccgcguccauacuucugugguaugcccagauucagccccacuggaucgcagcuagcaucauucucgaguucuuuuugaucguucuguuaauaccagagccugaaaaacaacggacuccccaggauaaccagcuaacguacgucgugauugccauccugaccguggucgccgcaacaauggcuaaugagaugggauuccucgagaagacuaaaaaggaccuuggccuggggucaauuaccacacaggaaagugagucuaacaucuuggacauagaucugcguccagccuccgcguggacccucuaugcuguugccacuacauuugugacgccuaugcugagacauagcaucgaaaauucaaguguaaacgugagccuuaccgcaauugccaaucaagcuacuguccucaugggacuggguaaaggcuggcccuuguccaagauggacaucggggugccgcuguuagcaauuggauguuacucucagguuaacccaaucacacuaaccgccgcgcugcuccuucugguggcucacuacgccauuaucggcccugguuugcaggcaaaggccaccagggaggcucagaaacgcgccgcagcugggauaaugaagaaucccacagucgauggcauuacuguaaucgaccuggaaccaauccccuaugauccuaaauucgagaagcaacucggacaggugaugcugcuuauuuuaugcguuacacaggugcugaugaugcggaccacaugggcccucugugaggcguugacucuggccaccggcccgauaagcacacuaugggaagggaaccccggacgauuuuggaauaccacuaucgcagucuccauggcuaacauuuucagaggcucauaccuggccggugcagggcuccuauuuucuaucaugaaaaauacgacaaacaccaggcgcggaacuggcaauauuggugagacccugggcgaaaaguggaagagucgguugaacgcucuggggaaaucggaguuccagaucuauaagaaaagcggaauacaagagguggacagaacacucgccaaggaaggcaucaaacguggggagacugaucaucacgccgucuccaggggaucugcgaagcugcggugguuuguggaacgcaacaugguuaccccagagggcaaagugguagacuuagguugcgggcgaggaggcuggucauacuauugugguggccuuaagaaugugagagaagucaaggggcugacaaaaggaggcccugggcaugaggagcccauuccuaugagcacguacggauggaaccucguuaggcuacaguccggcguggaugucuucuucaccccacccgaaaagugcgacacucuguugugugauaucggugagaguucuccuaauccaacaauugaagcugggcggacccugcgcgugcucaaccuuguagagaauuggcugaacaauaacacucaguuuugcaucaaaguguugaaucccuauaugccgagcguuauagaaaagauggagacacugcaaagaaaauacggaggcgcacucgugaggaacccuuuaucacgaaauuccacccacgagauguacugggucaguaacgccacgggcaauauugugagcucugucaacaugaucucccggaugcugaucaaucguuucaccaugaagcacaagaaagcuacauaugaaccagacguggaucuugggucaggaacuagaaacauugguauagagagcgaaauccccaaccuggacauuaucggcaagcgcauugagaggaucaaacaggaacaugagaccucguggcacuacgaccaggaucauccuuauaagacaugggccuaccacgggucuuaugagacuaaacagaccggaagugcauccagcaugguuaauggcguagugcggcuacucacaaagccaugggacgucgugcccaugguuacccaaauggccaugacugauacgacaccguuuggucagcagagaguguucaaggaaaaagucgacacccgcacucaggagccuaaggaagggaccaaaaagcugaugaggauaacagcugagugguuguggaaagagcugggaaagaagaaaacgccccgaauguguacccgggaagaguuuacuagaaaggugaggucaaacgcggcccucggcgcaguauucacagaugaaaauaaauggaaguccgcucgcgaggccguggaagacucucguuuuugggagcuuguugaucgggagagaaaccugcacuuagaaggcaaaugcgagaccugugucuacaauaugauggggaagagggagaaaaagcugggagaguucgguaaggcaaaaggcagccgcgccaucugguauaugugguugggggcucgauuucucgaguucgaggcccugggauuucuaaacgaggaccauugguucagucggagaaauucccuuagcggcguggaaggugaggggcugcacaggcucggauacauucugcgcgaugugucuaagaaagaaggcggcgcgauguacgcagacgauacugccgggugggacacaagaaucaccuuggaggaccugaagaacgaagagauggucacaaaucauaugaaaggagagcacaagaagcucgcugaagccauuuuuaaacuuacuuaucaaaacaagguugugcggguacagaggccaaccccucgugguacggugauggauaucauuucacgacgcgaccagagaggcagugggcaggucggaaccuacggccugaauacauucacuaacauggaggcacaauuaauacggcagauggaaggugaggggaucuucaaauccauucagcaucugaccgugacagaggaaaucgcuguucaaaauugguuggccagggugggacgcgagagacucagccggauggcuaucucuggcgaugacugcgucgugaagccccuggaugacagguuugccucggcacuaacugcgcuuaacgauaugggcaaaguacgaaaggacauucagcagugggaaccaucacguggguggaaugauuggacccagguucccuucugcagccaccacuuucaugagcuggugaugaaggacggaagaguccucguggugccuugucgcaaccaagaugaacugauaggucgggccaggaucucccagggcgcuggguggaguuugaaagagacggccugcuuaggaaagucuuaugcacagauguggacacugauguacuuccacagacgcgaccuccggcuugcugccaacgcaauuuguagcgccgucccaucccauuggguuccgaccucaaggacuacauggaguauccacgcgaaacacgaguggaugaccacugaagauaugcuggcuguguggaaucgaguauggauucaggagaaccccuggauggaagacaagaccccuguggagucuugggaagaggucccauaucuaggcaaaagagaggaccaauggugcgguagccugaucgggcucacaucccgggccacgugggcaaagaauauacagaccgccaucaaccaggugaggucauugauuggaaaugaagaguacacugauuauaugcccagcaugaagcgcuuucguagagaagaggaagaggcuggcguucugugguga

SEQ ID NO: 14664 - RNA, 9876 nt, Artificial Sequence
  derived and/or modified CDS sequence (opt3) from DENV-2__EU569709__SS-prME
accgccggcgugaucauuaugcugauacccaccgcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggauuauucggcaagggcgggauugucacaugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccugacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaagguacguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaucaaguuuucggcgcuaucuauggagcggcauuuaguggcgugagcuggacuaugaaaauauugaucgggguaauuaucaccuggauuggaaugaacuccagaucuacgagccugucagucagucucgugcugguuggcguggucacacuuuaccugggugugaugguacaggccgacuccgggugugugguuagcuggaagaauaaagaauugaagugcggaucuggcaucuucauaaccgauaacguccacacuuggacagagcaguauaaguuucagcccgaaucaccaaguaaacucgcuagcgccauucaaaaggcacacgaggaagguaucuguggcauuagguccgugacccggcuggagaauuuaauguggaaacagaucacucccgagcugaaccauauacuaucugaaaaugaggugaagcucaccaucaugacaggggacauuaaaggaaucaugcaggccggcaagcgcucgcugagaccucagccaacggaacuuaaauacagcuggaagaccugggggaaggcuaaaauguuguccacugagucacacaaccaaacauuccugauugauggaccggaaaccgccgagugccccaauacaaacagggcauggaauagucucgaggucgaagacuauggcuuugguguuuucucuacuaacaucuggcugaaguuacgugagaaacaggacguguuuugugauagcaagcugauguccgcggcuauaaaagacaaucgggccgugcaugcagauaugggguacuggauugaaucagcccuuaacgacaccuggaagauggagaaggcuagcuucaucgagguaaaaucuugccacuggccuaagucccacacguuguggaguaauggaguccucgaaagcgagaugaucauucccaaaaauuucgccggccccgugucucagcauaacuaucgaccugguuaccacacacagaccgcaggcccauggcaucuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguaugggauggaaauuaggccauugaaggagaaggaagagaaccuggugaauagcuuaguuacugccggacacggccaaauagauaacuuuucgcucggugugcugggcauggcgcuuuuccuggaagagauguugcgcacacgaguagggaccaaacaugccauccuccuggucgcuguguccuuugugacucuaauuacaggaaauaugucuuuccgggaccugggccgugucaugguuauggugggggcaaccaugacggaugacaucggaaugggcguaacuuaccucgcccugcuugcugccuuuaaggugagacccaccuucgcagcggguuugcuguuaaggaaacucacaagcaaggagcugaugauggccaccauugggaucgcacuucugucacagaguacuauaccugaaacaauccuagagcucaccgaugcccuggcauugggaaugaugguccugaaaauugugcgcaacauggaaaaguaucaguuagcuguuacaaucauggccauucucugcgugcccaaugcagucauccugcaaaacgccuggaagguguccuguacuauacuugcugcgguuucugugagcccacuguugcucaccuccucacagcagaaagccgacuggauuccucuggcacuaacgaucaagggccugaaucccacagcuaucuuucuuaccacucucagccggaccaguaaaaagagaucuuggccacugaacgaggccgucauggccguaggcaugguguccauuuuggcuagcucgcugcucaaaaaugacauaccgaugacagggccucuaguugcaggaggucugcuuacugugugcuacguccugaccggcaggucagccgauuuggaacucgagcgagcggcugacgugaagugggaggaucaggccgaaaucucugggaguucccccauucugagcaucacgauuucugaggacggaagcauguccaucaaaaacgaagaggaggaacaaacacuaaccauacugauccgcacuggccuucucguaauuucagguguguucccagucaguauccccauuacagcagccgcuugguaucugugggagguuaagaagcagcgggcagggguguugugggaugugccuagcccacccccugucggaaaagccgaauuagaggacggcgcguacagaaucaagcagaggggcauauuuggguauucucagauuggagcugguguguacaaagaaggcaccuuccacacuauguggcacguuacacguggggccguacugaugcaucgcggaaagcggaucgagccguccugggcagaugugaaaaaggaccucaucucauacggcgguggguggaagcuggagggagaauggaaagagggcgaagagguccaagugcuugcccuggaaccaggcaagaaucccagagcuguucagaccaaaccuggguuguuuaagacgaacacuggaaccauuggugccgugagucuagauuucagcccaggcacauccgggucucccaucgucgacaggaaaggaaaggugguaggccuguaugguaauggggucgugacccgaucgggagcauacguuagcgcuauagcccagacagagaagucaauugaggauaacccugaaaucgaggacgauauuuuccggaaaaagcgccucacuaucauggaccugcacccgggcgcgggcaaaaccaagagauaucuucccgccauagugagggaagcaauuaaacggggguuacgaacgcugauccucgcuccaacaagagucguggccgcugagauggaagaggcauugcgcggacugccuaucagguaccagacucccgccauucgugccgagcauaccggucgggaaaucguugaccucaugugucacgcuacauuuaccaugagacugcuuuccccagugagggucccuaacuauaaucugauuauaauggaugaggcgcauuucacugaccccgcaaguaucgccgcucgcggcuacauuucuacccgaguggaaaugggggaggccgcaggaaucuuuaugacagccacgccaccgggcagcagagauccuuucccccaauccaacgcuccaaucauggacgaggaacgggagauucccgaaaggucauggaacucuggucacgaguggguaacugauuuuaaggggaagaccgugugguucguuccuagcauaaaagcgggaaacgacaucgccgcaugcuugcgcaagaauggcaaaaaggucauucagcuaagucguaaaacauuugauuccgaauaugugaagaccagagcuaacgacugggauuucguggucacuacagacaucagcgagaugggcgccaauuuucgggcagagaggguaauugauccacgccgauguaugaagcccgugauccugaccgacggggaagagagaguuauacucgccggaccuaugccggugacgcacucuucagcugcccagcggaggggucgcaucggcagaaaccccaaaaaugaaaacgaccaauacauuuacaugggggagcccuuagaaaaugaugaggacugcgcgcauuggaaggaggcaaaaaugcugcuugauaacaucaauacuccugaaggaauuauccccuccauguucgagccagaaagggagaaggucgacgccauagauggcgaauaucggcugcguggugaggcucgcaaaacauuuguggaccucaugcgaagaggggauuugccuguuuggcuggccuacaggguggcugcagagggcauuaacuaugccgaccggcgcugguguuucgauggaaucaagaauaaccagauucucgaagagaacgucgaaguggagaucuggaccaaagagggcgaaagaaagaagcugaaacccagguggcuugacgcucggauauacagugauccacuagcccugaaggaguucaaagaauuugcagcggggcgaaagagcuugaccuuaaaucugaucacugagaugggaagacucccuacauucaugacccagaaagcccgcgacgcucuggauaaccuugccguacugcacacagcagaaguggguggcagggcuuauaaucaugcccucucggaguugccggagacucuggaaacgcuacugcuccuuacccuguuagcaacaguuacugggggaauauuuuuguuccugaugucuggcaaggguaucgggaagaugacccucggcaugugcugcauuaucacagccuccauacugcuuugguacgcucagauucaaccccacuggaucgcggccagcaucauucuggaguuuuuccucaucgucuugcugauaccagaaccugagaaacagcggaccccacaggacaaccaguuaacuuauguggugauugcaauccuaacggucguugcugccaccauggccaaugaaaugggauuucuggagaagaccaaaaaggaccucggccuugggucaauuaucacucaagagagugaaucuaacauacuggauaucgacuugcguccagcauccgcuuggacccuguacgccguggcgacaaccuucguaacuccuaugcucagacacagcauugaaaauucaagugugaacgucagccugacagcuaucgccaaucaggcaacggugcuuaugggacucgguaggggcuggccccuguccaaaauggauauugggguuccguugcuggccaucggauguuacucucaggugaacccaauuaccuuaacugcugcacuacugcuccuugucgcccauuaugcgaucauaggcccuggucugcaggcuaaggccacacgcgaagcacaaaagcgggccgcugccgggauuaugaaaaaucccaccguagacggcaucaccgugaucgauuuggagccaauucccuacgacccuaaguuugaaaaacagcugggacagguuaugcuccuggugcuuugcgucacacagguguuaaugaugcgaacuacgugggcacugugugaggcucucaccuuggccacaggcccgauaagcacucugugggaggggaaccccggaagauucuggaauaccacaaucgcggucuccauggccaacauuuuuaggggcucauaucuagcuggugcugggcuacucuucucuaucaugaagaauaccacuaacacgcgccggggaacaggcaauauuggugaaacccuuggcgagaaauggaagaguagacugaacgccuuggggaagucggaauuucaaaucuacaaaaagagcggaauacaggagguggaucguacucuggcaaaagagggcaucaagagaggggaaaccgaccaccaugcuguuucccggggaucugccaaacuccgcugguucguggagcgaaacaugguaacaccagaaggcaagguggucgaucuggguugcgggagaggaggcuggucauauuacugugguggccuuaaaaauguuagggaggugaaggggcuaacuaagggaggcccugggcacgaggaaccaauuccuaugagcaccuauggauggaaccugguccggcuccaguccggcguggacguauucuuuacaccacccgagaaaugcgauacgcuacugugugacaucggugaaaguucuccuaauccaaccauugaggccgggcgcacuuugagagugcugaaccucguugaaaauuggcuuaacaauaacacacaauucugcaucaaggugcugaaucccuacaugccgagcgucauagagaaaauggaaaccuugcagaggaaguacggaggcgcgcuggugcgaaacccucucucaagaaauuccacucaugagauguauugggucaguaacgcuacaggcaauauugugagcucuguuaacaugaucucccguauguuaaucaauagauuuaccaugaaacacaagaaggcaacguacgagccagauguagaccuggggucaggaacccgcaacauugguauagaaaacgagauccccaaucuugacauuaucggcaaaaggauugaaaagaucaaacaggagcacgaaacaagcuggcauuaugaucaggaccacccuuacaagacuugggccuaucaugggucguacgagaccaaacaaacaggaucugcuaguuccauggugaacggcgucgugcggcugcuaacuaagccaugggauguugugcccauggucacccagauggccaugacagacaccacuccguucggucagcagagaguguuuaaggagaaaguagauacgcgcacacaagaaccuaaggaggggaccaaaaagcucaugaggauaacugcagaauggcuguggaaagaguugggaaagaagaaaacaccccgaauguguacacgggaggaguucacgagaaaggugaggagcaaugccgcucugggcgcgaucuuuaccgacgagaacaaauggaagucagcccgcgaagcaguugaggauucccguuucugggaacucgucgaccgggagagaaaucuucaccuggagggcaaaugcgaaacuuguguguauaacaugauggggaagagggagaaaaaguuaggagaauuugguaaggcuaaaggcucucgcgccauuugguacauguggcugggggcacgauucuuggaguuugaagcccucggauuccugaaugaggaucacugguuuagccggggcaacagucuauccgguguggagggggaaggacuucauaagcugggcuacauccucagagacgucagcaaaaaggagggcggggcuauguaugccgaugacacagcgggaugggacaccaggauuacucuggaagauuugaaaaaugaggaaaugguuacaaaccacaugaagggugagcauaagaaacuggcagaggccaucuucaagcucaccuaccagaauaaagugguacgcgugcagagaccaacaccucggggcacugucauggacauuauaucuaggaaggaucagcgugggucaggacaagugggcaccuauggucuuaacacguucaccaauauggaagcucagcugauccgacagauggagggggaaggaauuuuuaaaaguauccaacacuuaacaguuacugaggagaucgccgugcagaacuggcuggcacgcgucggcagagaacgguuguccaggauggcuauuagcggcgacgauugcgugguaaagccccucgacgaucgcuucgccucugcucugaccgcccuaaaugacauggggaagguuagaaaagauauacagcagugggagccaucgcggggauggaacgacuggacacaagugcccuuuugcucacaucacuuccacgaacuugucaugaaggaugguagggugcugguggucccuugucgaaaccaggacgagcucaucggccgugcaagaauuagccagggggcgggauggucccugaaagaaacugccugcuugggcaagaguuacgcucagauguggaccuuaauguauuuucaucgccgggaucugaggcucgccgcaaaugcuaucuguucugccguuccaagccacugggugccgacguccagaacaaccuggucaauucaugcaaaacacgaguggaugacuacagaggacaugcuugccguauggaaccgcguguggauccaagaaaaucccuggauggaggacaagaccccugucgaaaguugggaggaagugccauaccuggguaagcgggaggaucaguggugcgggucucuaauaggacugacuagcagggcgaccugggcuaaaaacauccagacagccauuaaucagguucgaucccucaucggcaacgaggaauauacggacuacaugcccucaaugaagagauuccggaaagaggaagaggaagcaggcguguugugguga

SEQ ID NO: 14665 - RNA, 9876 nt, Artificial Sequence
  derived and/or modified CDS sequence (opt3) from DENV-2__EU596485__SS-prME
accgcaggcgugaucauuaugcugauaccaacagcuauggcuuuccaccucacuacgagaaacggggaaccucauaugaucgucgggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucagucgcgcuggugccacaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugauucacauaaccaaacauuccugauugacggaccggagaccgccgaaugccccaauacaaacagggcauggaauagucucgaggucgaggacuacggcuuugguguuuucucuacuaacaucuggcugaaguuacgugaaaaacaggauguguuuugugacagcaagcugauguccgcggcuauaaaagauaaucgggccgugcacgcagacaugggguauuggauugagucagcccuuaacgauaccuggaagauggaaaaggcuagcuucaucgagguaaaaucuugccacuggccuaagucccauacguuguggaguaauggaguccucgagagcgaaaugaucauucccaagaacuucgccggccccgugucucagcacaacuaccgaccugguuaucauacacagaccgcaggcccauggcaccuggggaagcuagagauggacuuugauuucugugaaggaacuaccguuguggucacagaggacugcggcaauagagggcccucccugaggacuaccacagcuucaggaaaacucaucacggaauggugcugucgcaguugcacccugccgccucuucgguacagaggcgaggaugguuguugguacgggauggagauuaggccauugaaggaaaaggaggaaaaccuggugaauagcuuaguuacugccggacauggccaaauagacaacuuuucgcucggugugcugggcauggcgcuuuuccuggaggaaauguugcgcacacgaguagggaccaaacacgccauccuccuggucgcuguguccuuugugacucuaauuacaggaaauaugucuuuccgggaucugggccgugucaugguuauggugggggcaaccaugacggacgauaucggaaugggcguaacuuaucucgcccugcuugcugccuuuaaggugagacccaccuucgcagcggguuugcuguuaaggaaacucacaagcaaggagcugaugauggccaccauugggaucgcacuucugucacagaguacuauaccugagacaauccuagaacucaccgacgcccuggcauugggaaugaugguccugaaaauugugcgcaacauggagaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaagccgucauggccguaggcauggugagcauucuggcuucgucauugcugaaaaaugauauaccgaugacagggccuuuaguugcaggaggucuccugacugugugcuauguccuuaccggcaggucugccgaccuggaguuggaacgagcggcugaugugaagugggaggaccaggccgagaucaguggguccagccccauucucucuaucacgauuagcgaagauggauccaugucaaucaaaaacgaggaagaggagcaaacacugaccauacuaauccgcacuggccugcuuguaauuagugguguguucccagucagcauccccauuacagcagccgcuugguaccucugggaaguuaagaagcagcgggcaggggugcugugggacgugccuucuccacccccugucggaaaagccgaguuggaagauggcgcguauagaaucaagcagaggggcauauuuggguacucccagauuggagcugguguguauaaagagggcaccuuccacacuauguggcauguuacacguggggccguauuaaugcaccgcggaaagcggaucgaaccgucaugggcagacgugaaaaaggaucugaucaguuacggcgguggguggaagcucgagggagaguggaaagaaggcgaggaaguccaagugcuggcccuugagccaggcaagaaucccagagcuguucagaccaaaccugggcuguuuaagacgaacacuggaaccauuggugccgugagcuuggacuucuccccaggcacaucugggucgcccaucgucgauaggaaaggaaaggugguaggccuauacgguaauggggucgugacccgaagcggagcauauguuucagcuauagcccagacagaaaaguccauugaggacaacccugagaucgaagaugacauuuuccggaaaaagcgccugacuaucauggaccuccauccgggcgcgggcaaaaccaagagauaccugcccgccauagugagggaggcaauuaaacgggggcuucgaacguuaauccuggcuccaacaagagucguggccgcugaaauggaggaagcacuccgcggauugccuaucagguaucagacucccgccauucgugccgagcacaccggucgggagaucguugaucugaugugucaugcuacauuuaccaugagacuccugaguccagugagggucccuaacuacaaucuuauuauaauggacgaagcgcacuucacugaucccgcaucuaucgccgcucgcggcuauauuagcacccgaguggagaugggggaagccgcaggaaucuuuaugacagccacgccaccgggcuccagagacccuuucccccaaucaaacgcuccaaucauggaugaggagcgggaaauucccgagaggucuuggaauagcggucacgaauggguaacugacuuuaaggggaagaccgugugguucguuccuaguauaaaagcgggaaacgauaucgccgcaugccugcgcaagaauggcaaaaaggucauucaguugucccguaaaacauuugacagcgaguacgugaagaccagagcuaacgauugggacuucguggucacuacagauaucucugaaaugggcgccaauuuucgggcagagaggguaauugacccacgccgauguaugaagcccgugauccuaaccgacggggaggaaagaguuauacuggccggaccuaugccggugacgcauucauccgcugcccagcggaggggucgcaucggcagaaaccccaaaaaugagaacgaucaauauauuuacaugggggaaccccucgagaaugacgaagauugcgcgcacuggaaggaggcaaaaauguuacuggacaacaucaauacuccugagggaauuauccccaguauguucgaaccagagagggaaaaggucgaugccauagacggcgaguaccggcuucguggugaagcucgcaaaacauuuguggaucugaugcgaagaggggaccucccuguuugguuggccuauaggguggcugcagagggcauuaacuacgccgaucggcgcugguguuucgacggaaucaagaauaaccagauucuggaggaaaacgucgagguggaaaucuggaccaaagagggcgagagaaagaagcucaaacccagguggcuggaugcucggauauauagcgacccacuugcccuaaaggaguucaaagaguuugcagcggggcgaaagucgcugaccuugaauuuaaucacugaaaugggaagacugccuacauucaugacccagaaagcccgcgaugcucucgacaaccuggccguacuucauacagcagagguggguggcagggcuuacaaucacgcccugucugaacucccggagacuuuggagacgcugcuacugcucacccuucuggcagccguuacagggggaauauuuuuauucuugauguccggcaaggguaucgggaagaugacucugggcaugugcugcauuaucaccgcuagcauacuccugugguaugcgcagauucaaccccacuggaucgccgcaucaaucauucuugaauuuuuccugaucguccucuugauaccagagccugaaaaacagcggacaccccaggacaaccagcugaccuacguggugauugcuaucuuaacugucguugccgccacgauggcaaaugagaugggauuucuagaaaagaccaaaaaggaucugggccucgggaguauuaucacacaagagucugaguccaacauacuugacaucgaucugcguccagcuagcgccuggacuuuguaugcgguggcuaccacauucguaaccccuaugcugagacauucaauugaaaauaguagcgugaacgucucccucacugccaucgcaaaucaggccacagugcugaugggacuugguaggggcuggccccucucuaaaauggacauugggguuccgcuguuggcuaucggauguuacagccaggugaacccaauuacgcugaccgcagccuuacuacugcucgucgcgcacuacgcuaucauaggcccuggucuucaggccaaggcaacucgcgaggcccaaaagcgggcugccgcagggauuaugaaaaaucccacaguagauggcaucaccgugaucgaccuggaaccaauucccuaugauccuaaguuugagaaacaguugggacagguuaugcugcucgugcugugcgucacccaggugcuuaugaugcgaacaacuugggcuuuaugugaagcccugacgcucgcgaccggcccgauauccacauugugggaggggaaccccggaagauucuggaauacuaccaucgccgucucaauggcaaacauuuuuaggggcucuuaccuggcuggugccgggcuacuguucaguaucaugaagaauacaaccaacacucgccggggaacgggcaauauuggugagacacucggcgaaaaauggaagucgagacuuaacgcacugggaaagagcgaguuucaaaucuauaaaaaguccggaauacaggaaguggaccguaccuuggcuaaagagggcaucaagaggggagaaacugaucaucacgccguuucucgggggucagccaaacugcgcugguucguggaacgaaacaugguaaccccagagggcaagguggucgaccucgguugcgggagaggaggcuggagcuacuauugugguggccugaaaaauguuagggaagugaagggguuaacaaagggaggcccugggcaugaggaacccauuccuauguccacuuacggauggaaccuuguccggcugcagaguggcguggauguauucuuuaccccacccgagaaaugcgacacacuccuaugugauaucggugagucuagcccuaauccaacgauugaagcggggcgcacccugagaguguugaaccugguugagaauuggcucaacaauaacacucaauucugcaucaaggugcuuaaucccuauaugccgucagucauagagaaaauggagacacugcagaggaaguacggaggcgcuuuggugcgaaacccucugucccggaauaguacccacgaaauguacugggucagcaacgcaacuggcaauauugugucuuccguuaacaugaucucacguaugcucaucaauagauuuacaaugaaacacaagaaggccaccuaugagccagacguagacuuagggagcggaacgcgcaacauugguauagagaacgaaauccccaaucuggauauuaucggcaaaaggauugagaagaucaaacaggaacaugagaccucguggcacuacgaccaggaucauccuuauaagacaugggcuuaccacgggucuuaugaaacuaaacaaaccggaagugccuccagcauggugaacggcgucgugcggcuucugacaaagccaugggacguugugcccauggucacucagauggcaaugaccgauacaaccccguucggucagcagagaguguuuaaggagaaaguagacacucgcacgcaagagccuaaggaagggaccaaaaagcuaaugaggauaacagccgaguggcucuggaaagaacugggaaagaagaaaacuccccgaauguguacccgggaggaguucgcuagaaaggugaggucaaaugcggccuugggcgcaaucuuuacagaugaaaacaaauggaaguccgcucgcgaggccguugaagacucucguuucugggagcuggucgaucgggaaagaaaucuccaccuugagggcaaaugcgagacguguguguacaacaugauggggaagagggagaaaaagcugggagaguuugguaaggcaaaaggcagccgcgccauuugguauaugugguuaggggcucgauuccuggaauuugaggccuugggauuccucaaugaagaccauugguuuagucggggcaacucccugagcgguguggagggggagggacuacacaaacuuggcuacauccugagagaugucucuaaaaaggaaggcggggcgauguacgcagacgacaccgccggaugggauacuaggauuacacucgaggaccugaaaaaugaagagaugguuaccaaccauaugaagggugaacacaagaaauuggcugaggccaucuucaagcugacuuaucagaauaaagugguacgcgugcagagaccaacaccucggggcaccgucauggauauuauaucaaggaaggaccagcgugggaguggacaagugggcacauacggucucaacacuuucaccaauauggaggcacagcuuauccgacagauggaaggggagggaauuuuuaaauccauccaacaucugacgguuaccgaagagaucgcugugcagaacugguuagcccgcgucggcagagagcggcugagcaggauggcuauuucuggcgaugacugcgugguaaagcccuuggaugaccgcuucgccucggcacucacagcgcugaaugauauggggaagguuagaaaagacauacagcagugggaaccaucacggggauggaacgauuggacucaagugcccuuuugcagccaccacuuccaugagcuagucaugaaggacgguagggugcuuguggucccuugucgaaaccaggaugaacugaucggccgugccagaauuucccagggggcuggauggagucucaaagagaccgccugccugggcaagucuuaugcacagauguggacauugauguacuuucaccgccgggacuuaaggcuggcugccaaugcaaucuguagcgccguuccaucccauugggugccgacuucaagaaccacguggaguauucacgcgaaacacgaauggaugacaaccgaggacaugcucgcuguauggaaccgcguguggauccaagagaaucccuggauggaagauaagacuccugucgagucuugggaagaggugccauaucuugguaagcgggaagaccaguggugcgggagccugauaggacuaacauccagggccaccugggccaaaaacauccagacugccauuaaucagguucgaucacugaucggcaacgaggaguacaccgauuauaugcccagcaugaagagauuccggaaagaagaggaagaggcuggcgugcucugguga

SEQ ID NO: 14666 - RNA, 9876 nt, Artificial Sequence
  derived and/or modified CDS sequence (opt3) from DENV-2__EU569710__SS-prME
accgccggcgugaucauuaugcugauacccaccgcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucacauucauucugcugaccgcaguugccccauccaugacuaugagaugcaucgggauaucuaacagggauuuuguggaaggagucucggguggcucauggguggacauuguacucgagcacgggagcuguguuacaaccauggcuaagaauaagcccacguuagauuucgaacugaucaaaaccgaggccaagcagccugcgauucuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggauuauucggcaagggcgggauugucacaugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccugacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaagguacguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaucaaguuuucggcgcuaucuauggagcggcauuuaguggcgugagcuggacuaugaaaauauugaucgggguaauuaucaccuggauuggaaugaacuccagaucuacgagccugucagucagucucgugcugguuggcguggucacacuuuaccugggugugaugguacaggccgacuccgggugugugguuagcuggaagaauaaagaauugaagugcggaucuggcaucuucauaaccgauaacguccacacuuggacagagcaguauaaguuucagcccgaaucaccaaguaaacucgcuagcgccauucaaaaggcacacgaggaagguaucuguggcauuagguccgugacccggcuggagaauuuaauguggaaacagaucacucccgagcugaaccauauacuaucugaaaaugaggugaagcucaccaucaugacaggggacauuaaaggaaucaugcaggccggcaagcgcucgcugagaccucagccaacggaacuuaaauacagcuggaagaccugggggaaggcuaaaauguuguccacugagucacacaaccaaacauuccugauugauggaccggaaaccgccgagugccccaauacaaacagggcauggaauagucucgaggucgaagacuauggcuuugguguuuucucuacuaacaucuggcugaaguuacgugagaaacaggacguguuuugugauagcaagcugauguccgcggcuauaaaagacaaucgggccgugcaugcagauaugggguacuggauugaaucagcccuuaacgacaccuggaagauggagaaggcuagcuucaucgagguaaaaucuugccacuggccuaagucccacacguuguggaguaauggaguccucgaaagcgagaugaucauucccaaaaauuucgccggccccgugucucagcauaacuaucgaccugguuaccacacacagaccgcaggcccauggcaucuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguaugggauggaaauuaggccauugaaggagaaggaagagaaccuggugaauagcuuaguuacugccggacacggccaaauagauaacuuuucgcucggugugcugggcauggcgcuuuuccuggaagagauguugcgcacacgaguagggaccaaacaugccauccuccuggucgcuguguccuuugugacucuaauuacaggaaauaugucuuuccgggaccugggccgugucaugguuauggugggggcaaccaugacggaugacaucggaaugggcguaacuuaccucgcccugcuugcugccuuuaaggugagacccaccuucgcagcggguuugcuguuaaggaaacucacaagcaaggagcugaugauggccaccauugggaucgcacuucugucacagaguacuauaccugaaacaauccuagagcucaccgaugcccuggcauugggaaugaugguccugaaaauugugcgcaacauggaaaaguaucaguuagcuguuacaaucauggccauucucugcgugcccaaugcagucauccugcaaaacgccuggaagguguccuguacuauacuugcugcgguuucugugagcccacuguugcucaccuccucacagcagaaagccgacuggauuccucuggcacuaacgaucaagggccugaaucccacagcuaucuuucuuaccacucucagccggaccaguaaaaagagaucuuggccacugaacgaggccgucauggccguaggcaugguguccauuuuggcuagcucgcugcucaaaaaugacauaccgaugacagggccucuaguugcaggaggucugcuuacugugugcuacguccugaccggcaggucagccgauuuggaacucgagcgagcggcugacgugaagugggaggaucaggccgaaaucucugggaguucccccauucugagcaucacgauuucugaggacggaagcauguccaucaaaaacgaagaggaggaacaaacacuaaccauacugauccgcacuggccuucucguaauuucagguguguucccagucaguauccccauuacagcagccgcuugguaucugugggagguuaagaagcagcgggcagggguguugugggaugugccuagcccacccccugucggaaaagccgaauuagaggacggcgcguacagaaucaagcagaggggcauauuuggguauucucagauuggagcugguguguacaaagaaggcaccuuccacacuauguggcacguuacacguggggccguacugaugcaucgcggaaagcggaucgagccguccugggcagaugugaaaaaggaccucaucucauacggcgguggguggaagcuggagggagaauggaaagagggcgaagagguccaagugcuugcccuggaaccaggcaagaaucccagagcuguucagaccaaaccuggguuguuuaagacgaacacuggaaccauuggugccgugagucuagauuucagcccaggcacauccgggucucccaucgucgacaggaaaggaaaggugguaggccuguaugguaauggggucgugacccgaucgggagcauacguuagcgcuauagcccagacagagaagucaauugaggauaacccugaaaucgaggacgauauuuuccggaaaaagcgccucacuaucauggaccugcacccgggcgcgggcaaaaccaagagauaucuucccgccauagugagggaagcaauuaaacggggguuacgaacgcugauccucgcuccaacaagagucguggccgcugagauggaagaggcauugcgcggacugccuaucagguaccagacucccgccauucgugccgagcauaccggucgggaaaucguugaccucaugugucacgcuacauuuaccaugagacugcuuuccccagugagggucccuaacuauaaucugauuauaauggaugaggcgcauuucacugaccccgcaaguaucgccgcucgcggcuacauuucuacccgaguggaaaugggggaggccgcaggaaucuuuaugacagccacgccaccgggcagcagagauccuuucccccaauccaacgcuccaaucauggacgaggaacgggagauucccgaaaggucauggaacucuggucacgaguggguaacugauuuuaaggggaagaccgugugguucguuccuagcauaaaagcgggaaacgacaucgccgcaugcuugcgcaagaauggcaaaaaggucauucagcuaagucguaaaacauuugauuccgaauaugugaagaccagagcuaacgacugggauuucguggucacuacagacaucagcgagaugggcgccaauuuucgggcagagaggguaauugauccacgccgauguaugaagcccgugauccugaccgacggggaagagagaguuauacucgccggaccuaugccggugacgcacucuucagcugcccagcggaggggucgcaucggcagaaaccccaaaaaugaaaacgaccaauacauuuacaugggggagcccuuagaaaaugaugaggacugcgcgcauuggaaggaggcaaaaaugcugcuugauaacaucaauacuccugaaggaauuauccccuccauguucgagccagaaagggagaaggucgacgccauagauggcgaauaucggcugcguggugaggcucgcaaaacauuuguggaccucaugcgaagaggggauuugccuguuuggcuggccuacaggguggcugcagagggcauuaacuaugccgaccggcgcugguguuucgauggaaucaagaauaaccagauucucgaagagaacgucgaaguggagaucuggaccaaagagggcgaaagaaagaagcugaaacccagguggcuugacgcucggauauacagugauccacuagcccugaaggaguucaaagaauuugcagcggggcgaaagagcuugaccuuaaaucugaucacugagaugggaagacucccuacauucaugacccagaaagcccgcgacgcucuggauaaccuugccguacugcacacagcagaaguggguggcagggcuuauaaucaugcccucucggaguugccggagacucuggaaacgcuacugcuccuuacccuguuagcaacaguuacugggggaauauuuuuguuccugaugucuggcaaggguaucgggaagaugacccucggcaugugcugcauuaucacagccuccauacugcuuugguacgcucagauucaaccccacuggaucgcggccagcaucauucuggaguuuuuccucaucgucuugcugauaccagaaccugagaaacagcggaccccacaggacaaccaguuaacuuauguggugauugcaauccuaacggucguugcugccaccauggccaaugaaaugggauuucuggagaagaccaaaaaggaccucggccuugggucaauuaucacucaagagagugaaucuaacauacuggauaucgacuugcguccagcauccgcuuggacccuguacgccguggcgacaaccuucguaacuccuaugcucagacacagcauugaaaauucaagugugaacgucagccugacagcuaucgccaaucaggcaacggugcuuaugggacucgguaggggcuggccccuguccaaaauggauauugggguuccguugcuggccaucggauguuacucucaggugaacccaauuaccuuaacugcugcacuacugcuccuugucgcccauuaugcgaucauaggcccuggucugcaggcuaaggccacacgcgaagcacaaaagcgggccgcugccgggauuaugaaaaaucccaccguagacggcaucaccgugaucgauuuggagccaauucccuacgacccuaaguuugaaaaacagcugggacagguuaugcuccuggugcuuugcgucacacagguguuaaugaugcgaacuacgugggcacugugugaggcucucaccuuggccacaggcccgauaagcacucugugggaggggaaccccggaagauucuggaauaccacaaucgcggucuccauggccaacauuuuuaggggcucauaucuagcuggugcugggcuacucuucucuaucaugaagaauaccacuaacacgcgccggggaacaggcaauauuggugaaacccuuggcgagaaauggaagaguagacugaacgccuuggggaagucggaauuucaaaucuacaaaaagagcggaauacaggagguggaucguacucuggcaaaagagggcaucaagagaggggaaaccgaccaccaugcuguuucccggggaucugccaaacuccgcugguucguggagcgaaacaugguaacaccagaaggcaagguggucgaucuggguugcgggagaggaggcuggucauauuacugugguggccuuaaaaauguuagggaggugaaggggcuaacuaagggaggcccugggcacgaggaaccaauuccuaugagcaccuauggauggaaccugguccggcuccaguccggcguggacguauucuuuacaccacccgagaaaugcgauacgcuacugugugacaucggugaaaguucuccuaauccaaccauugaggccgggcgcacuuugagagugcugaaccucguugaaaauuggcuuaacaauaacacacaauucugcaucaaggugcugaaucccuacaugccgagcgucauagagaaaauggaaaccuugcagaggaaguacggaggcgcgcuggugcgaaacccucucucaagaaauuccacucaugagauguauugggucaguaacgcuacaggcaauauugugagcucuguuaacaugaucucccguauguuaaucaauagauuuaccaugaaacacaagaaggcaacguacgagccagauguagaccuggggucaggaacccgcaacauugguauagaaaacgagauccccaaucuugacauuaucggcaaaaggauugaaaagaucaaacaggagcacgaaacaagcuggcauuaugaucaggaccacccuuacaagacuugggccuaucaugggucguacgagaccaaacaaacaggaucugcuaguuccauggugaacggcgucgugcggcugcuaacuaagccaugggauguugugcccauggucacccagauggccaugacagacaccacuccguucggucagcagagaguguuuaaggagaaaguagauacgcgcacacaagaaccuaaggaggggaccaaaaagcucaugaggauaacugcagaauggcuguggaaagaguugggaaagaagaaaacaccccgaauguguacacgggaggaguucacgagaaaggugaggagcaaugccgcucugggcgcgaucuuuaccgacgagaacaaauggaagucagcccgcgaagcaguugaggauucccguuucugggaacucgucgaccgggagagaaaucuucaccuggagggcaaaugcgaaacuuguguguauaacaugauggggaagagggagaaaaaguuaggagaauuugguaaggcuaaaggcucucgcgccauuugguacauguggcugggggcacgauucuuggaguuugaagcccucggauuccugaaugaggaucacugguuuagccggggcaacagucuauccgguguggagggggaaggacuucauaagcugggcuacauccucagagacgucagcaaaaaggagggcggggcuauguaugccgaugacacagcgggaugggacaccaggauuacucuggaagauuugaaaaaugaggaaaugguuacaaaccacaugaagggugagcauaagaaacuggcagaggccaucuucaagcucaccuaccagaauaaagugguacgcgugcagagaccaacaccucggggcacugucauggacauuauaucuaggaaggaucagcgugggucaggacaagugggcaccuauggucuuaacacguucaccaauauggaagcucagcugauccgacagauggagggggaaggaauuuuuaaaaguauccaacacuuaacaguuacugaggagaucgccgugcagaacuggcuggcacgcgucggcagagaacgguuguccaggauggcuauuagcggcgacgauugcgugguaaagccccucgacgaucgcuucgccucugcucugaccgcccuaaaugacauggggaagguuagaaaagauauacagcagugggagccaucgcggggauggaacgacuggacacaagugcccuuuugcucacaucacuuccacgaacuugucaugaaggaugguagggugcugguggucccuugucgaaaccaggacgagcucaucggccgugcaagaauuagccagggggcgggauggucccugaaagaaacugccugcuugggcaagaguuacgcucagauguggaccuuaauguauuuucaucgccgggaucugaggcucgccgcaaaugcuaucuguucugccguuccaagccacugggugccgacguccagaacaaccuggucaauucaugcaaaacacgaguggaugacuacagaggacaugcuugccguauggaaccgcguguggauccaagaaaaucccuggauggaggacaagaccccugucgaaaguugggaggaagugccauaccuggguaagcgggaggaucaguggugcgggucucuaauaggacugacuagcagggcgaccugggcuaaaaacauccagacagccauuaaucagguucgaucccucaucggcaacgaggaauauacggacuacaugcccucaaugaagagauuccggaaagaggaagaggaagcaggcguguugugguga

SEQ ID NO: 14667 - RNA, 9876 nt, Artificial Sequence
  derived and/or modified CDS sequence (opt3) from DENV-2__EU596486__SS-prME
accgccggcgugaucauuaugcugauacccaccgcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggauuauucggcaagggcgggauugucacaugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccugacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaagguacguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaucaaguuuucggcgcuaucuauggagcggcauuuaguggcgugagcuggacuaugaaaauauugaucgggguaauuaucaccuggauuggaaugaacuccagaucuacgagccugucagucagucucgugcugguuggcguggucacacuuuaccugggugugaugguacaggccgacuccgggugugugguuagcuggaagaauaaagaauugaagugcggaucuggcaucuucauaaccgauaacguccacacuuggacagagcaguauaaguuucagcccgaaucaccaaguaaacucgcuagcgccauucaaaaggcacacgaggaagguaucuguggcauuagguccgugacccggcuggagaauuuaauguggaaacagaucacucccgagcugaaccauauacuaucugaaaaugaggugaagcucaccaucaugacaggggacauuaaaggaaucaugcaggccggcaagcgcucgcugagaccucagccaacggaacuuaaauacagcuggaagaccugggggaaggcuaaaauguuguccacugagucacacaaccaaacauuccugauugauggaccggaaaccgccgagugccccaauacaaacagggcauggaauagucucgaggucgaagacuauggcuuugguguuuucucuacuaacaucuggcugaaguuacgugagaaacaggacguguuuugugauagcaagcugauguccgcggcuauaaaagacaaucgggccgugcaugcagauaugggguacuggauugaaucagcccuuaacgacaccuggaagauggagaaggcuagcuucaucgagguaaaaucuugccacuggccuaagucccacacguuguggaguaauggaguccucgaaagcgagaugaucauucccaaaaauuucgccggccccgugucucagcauaacuaucgaccugguuaccacacacagaccgcaggcccauggcaucuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguaugggauggaaauuaggccauugaaggagaaggaagagaaccuggugaauagcuuaguuacugccggacacggccaaauagauaacuuuucgcucggugugcugggcauggcgcuuuuccuggaagagauguugcgcacacgaguagggaccaaacaugccauccuccuggucgcuguguccuuugugacucuaauuacaggaaauaugucuuuccgggaccugggccgugucaugguuauggugggggcaaccaugacggaugacaucggaaugggcguaacuuaccucgcccugcuugcugccuuuaaggugagacccaccuucgcagcggguuugcuguuaaggaaacucacaagcaaggagcugaugauggccaccauugggaucgcacuucugucacagaguacuauaccugaaacaauccuagagcucaccgaugcccuggcauugggaaugaugguccugaaaauugugcgcaacauggaaaaguaucaguuagcuguuacaaucauggccauucucugcgugcccaaugcagucauccugcaaaacgccuggaagguguccuguacuauacuugcugcgguuucugugagcccacuguugcucaccuccucacagcagaaagccgacuggauuccucuggcacuaacgaucaagggccugaaucccacagcuaucuuucuuaccacucucagccggaccaguaaaaagagaucuuggccacugaacgaggccgucauggccguaggcaugguguccauuuuggcuagcucgcugcucaaaaaugacauaccgaugacagggccucuaguugcaggaggucugcuuacugugugcuacguccugaccggcaggucagccgauuuggaacucgagcgagcggcugacgugaagugggaggaucaggccgaaaucucugggaguucccccauucugagcaucacgauuucugaggacggaagcauguccaucaaaaacgaagaggaggaacaaacacuaaccauacugauccgcacuggccuucucguaauuucagguguguucccagucaguauccccauuacagcagccgcuugguaucugugggagguuaagaagcagcgggcagggguguugugggaugugccuagcccacccccugucggaaaagccgaauuagaggacggcgcguacagaaucaagcagaggggcauauuuggguauucucagauuggagcugguguguacaaagaaggcaccuuccacacuauguggcacguuacacguggggccguacugaugcaucgcggaaagcggaucgagccguccugggcagaugugaaaaaggaccucaucucauacggcgguggguggaagcuggagggagaauggaaagagggcgaagagguccaagugcuugcccuggaaccaggcaagaaucccagagcuguucagaccaaaccuggguuguuuaagacgaacacuggaaccauuggugccgugagucuagauuucagcccaggcacauccgggucucccaucgucgacaggaaaggaaaggugguaggccuguaugguaauggggucgugacccgaucgggagcauacguuagcgcuauagcccagacagagaagucaauugaggauaacccugaaaucgaggacgauauuuuccggaaaaagcgccucacuaucauggaccugcacccgggcgcgggcaaaaccaagagauaucuucccgccauagugagggaagcaauuaaacggggguuacgaacgcugauccucgcuccaacaagagucguggccgcugagauggaagaggcauugcgcggacugccuaucagguaccagacucccgccauucgugccgagcauaccggucgggaaaucguugaccucaugugucacgcuacauuuaccaugagacugcuuuccccagugagggucccuaacuauaaucugauuauaauggaugaggcgcauuucacugaccccgcaaguaucgccgcucgcggcuacauuucuacccgaguggaaaugggggaggccgcaggaaucuuuaugacagccacgccaccgggcagcagagauccuuucccccaauccaacgcuccaaucauggacgaggaacgggagauucccgaaaggucauggaacucuggucacgaguggguaacugauuuuaaggggaagaccgugugguucguuccuagcauaaaagcgggaaacgacaucgccgcaugcuugcgcaagaauggcaaaaaggucauucagcuaagucguaaaacauuugauuccgaauaugugaagaccagagcuaacgacugggauuucguggucacuacagacaucagcgagaugggcgccaauuuucgggcagagaggguaauugauccacgccgauguaugaagcccgugauccugaccgacggggaagagagaguuauacucgccggaccuaugccggugacgcacucuucagcugcccagcggaggggucgcaucggcagaaaccccaaaaaugaaaacgaccaauacauuuacaugggggagcccuuagaaaaugaugaggacugcgcgcauuggaaggaggcaaaaaugcugcuugauaacaucaauacuccugaaggaauuauccccuccauguucgagccagaaagggagaaggucgacgccauagauggcgaauaucggcugcguggugaggcucgcaaaacauuuguggaccucaugcgaagaggggauuugccuguuuggcuggccuacaggguggcugcagagggcauuaacuaugccgaccggcgcugguguuucgauggaaucaagaauaaccagauucucgaagagaacgucgaaguggagaucuggaccaaagagggcgaaagaaagaagcugaaacccagguggcuugacgcucggauauacagugauccacuagcccugaaggaguucaaagaauuugcagcggggcgaaagagcuugaccuuaaaucugaucacugagaugggaagacucccuacauucaugacccagaaagcccgcgacgcucuggauaaccuugccguacugcacacagcagaaguggguggcagggcuuauaaucaugcccucucggaguugccggagacucuggaaacgcuacugcuccuuacccuguuagcaacaguuacugggggaauauuuuuguuccugaugucuggcaaggguaucgggaagaugacccucggcaugugcugcauuaucacagccuccauacugcuuugguacgcucagauucaaccccacuggaucgcggccagcaucauucuggaguuuuuccucaucgucuugcugauaccagaaccugagaaacagcggaccccacaggacaaccaguuaacuuauguggugauugcaauccuaacggucguugcugccaccauggccaaugaaaugggauuucuggagaagaccaaaaaggaccucggccuugggucaauuaucacucaagagagugaaucuaacauacuggauaucgacuugcguccagcauccgcuuggacccuguacgccguggcgacaaccuucguaacuccuaugcucagacacagcauugaaaauucaagugugaacgucagccugacagcuaucgccaaucaggcaacggugcuuaugggacucgguaggggcuggccccuguccaaaauggauauugggguuccguugcuggccaucggauguuacucucaggugaacccaauuaccuuaacugcugcacuacugcuccuugucgcccauuaugcgaucauaggcccuggucugcaggcuaaggccacacgcgaagcacaaaagcgggccgcugccgggauuaugaaaaaucccaccguagacggcaucaccgugaucgauuuggagccaauucccuacgacccuaaguuugaaaaacagcugggacagguuaugcuccuggugcuuugcgucacacagguguuaaugaugcgaacuacgugggcacugugugaggcucucaccuuggccacaggcccgauaagcacucugugggaggggaaccccggaagauucuggaauaccacaaucgcggucuccauggccaacauuuuuaggggcucauaucuagcuggugcugggcuacucuucucuaucaugaagaauaccacuaacacgcgccggggaacaggcaauauuggugaaacccuuggcgagaaauggaagaguagacugaacgccuuggggaagucggaauuucaaaucuacaaaaagagcggaauacaggagguggaucguacucuggcaaaagagggcaucaagagaggggaaaccgaccaccaugcuguuucccggggaucugccaaacuccgcugguucguggagcgaaacaugguaacaccagaaggcaagguggucgaucuggguugcgggagaggaggcuggucauauuacugugguggccuuaaaaauguuagggaggugaaggggcuaacuaagggaggcccugggcacgaggaaccaauuccuaugagcaccuauggauggaaccugguccggcuccaguccggcguggacguauucuuuacaccacccgagaaaugcgauacgcuacugugugacaucggugaaaguucuccuaauccaaccauugaggccgggcgcacuuugagagugcugaaccucguugaaaauuggcuuaacaauaacacacaauucugcaucaaggugcugaaucccuacaugccgagcgucauagagaaaauggaaaccuugcagaggaaguacggaggcgcgcuggugcgaaacccucucucaagaaauuccacucaugagauguauugggucaguaacgcuacaggcaauauugugagcucuguuaacaugaucucccguauguuaaucaauagauuuaccaugaaacacaagaaggcaacguacgagccagauguagaccuggggucaggaacccgcaacauugguauagaaaacgagauccccaaucuugacauuaucggcaaaaggauugaaaagaucaaacaggagcacgaaacaagcuggcauuaugaucaggaccacccuuacaagacuugggccuaucaugggucguacgagaccaaacaaacaggaucugcuaguuccauggugaacggcgucgugcggcugcuaacuaagccaugggauguuauacccauggugacccagauggccaugacagacaccacuccguucggucagcagagagucuuuaaggagaaaguggauacgcgcacacaagaaccuaaggaggggaccaaaaagcucaugaggaucacugcagaauggcuguggaaagaguugggaaagaagaaaacaccccgaauguguacacgggaggaguucacgagaaagguaaggagcaaugccgcucugggcgcgauuuuuaccgacgagaacaaauggaagucagcccgcgaagcaguggaggauucccguuucugggaacucguugaccgggagagaaaucuucaccuggagggcaaaugcgaaacuugugucuauaacaugauggggaagagggagaaaaaguuaggagaauuugguaaggcuaaaggcucucgcgccaucugguacauguggcugggggcacgauucuuggaguuugaagcccucggauuccugaaugaggaucacugguuuagccggggcaacagucuauccgguguggagggggaaggacuucauaagcugggcuacauucucagagacgugagcaaaaaggagggcggggcuauguaugccgaugacacagcgggaugggacaccaggaucacucuggaagauuugaaaaaugaggaaauggucacaaaccacaugaagggugagcauaagaaacuggcagaggccauuuucaagcucaccuaccagaauaaaguugugcgcguacagagaccaacaccucggggcacugugauggacauaaucucuaggaaggaucagcgugggucaggacaagucggcaccuauggucuuaacacguucaccaauauggaagcucagcugauucgacagauggagggggaaggaaucuuuaaaaguauccaacacuuaacagugacugaggagauugccguucagaacuggcuggcacgcgugggcagagaacgguuguccaggauggcuauaagcggcgacgauugcgucgugaagccccucgacgaucgcuucgccucugcucugaccgcccuaaaugacauggggaagguaagaaaagauauccagcagugggagccaucgcggggauggaacgacuggacacaaguucccuuuugcucacaucacuuccacgaacuugugaugaaggaugguaggguccugguggugccuugucgaagccaggacgagcucauuggccgugcaagaaucucccagggggcgggauggagucugaaagaaacugccugcuugggcaagucuuacgcucagauguggaccuuaauguauuuucaucgccgggaucugaggcucgccgcaaacgcuauuuguagcgccgucccaucccacuggguuccgacgucaagaacaaccuggaguauccaugcaaaacacgaguggaugacuacagaggacaugcuugccguguggaaucgcguauggauacaagaaaaccccuggauggaggacaagaccccuguggaaucuugggaggaagucccauaccuggguaagcgggaggaucaguggugcgggagccuaaucggacugacuuccagggcgaccugggcuaaaaauauucagacagccaucaaccaggugcgaucacucauuggcaaugaggaauauaucgacuacaugcccagcaugaagagauuccggaaagaggaagaggaagcaggcguuuugugguga

SEQ ID NO: 14668 - RNA, 9876 nt, Artificial Sequence
  derived and/or modified CDS sequence (opt3) from DENV-2__EU687212__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaagcuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauuaucacagaaaaggacuccccugugaacaucgaggccgaacccccauuuggagauagcuacauuauaaucggcgucgagccugggcaguuaaaacugaauugguucaagaagggaucgucuauuggucaaauguuugagacuaccaugcgaggcgcuaaacgcauggccauccuaggggacacagcaugggauuucggaucccucggcgguguguuuacuucaauugggaaggcccugcaccagguuuucggcgcuaucuacggagcggcauuuaguggcgugagcuggaccaugaaaauacuuaucgggguaauuaucacguggauuggaaugaacuccagaucuacaagcuugucagucagucuggugcucguuggcguggucacccuguaucuuggugccauggugcaggcugacuccggguguguagugagcuggaagaauaaagaacugaagugcggaucuggcaucuucauaacugauaacguucacacauggaccgagcaguacaaguuucaacccgaaucaccaaguaaauuggccagcgcaauucagaaggcccaugaggaagguaucuguggcauuagguccgucacucggcucgagaaucugauguggaaacagaucacccccgaguuaaaccacauacugucugaaaaugaggugaagcuaacaaucaugacgggggacauuaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguuuuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauuccaaaaagcuucgcaggccccgucucucagcacaacuaccgaccugguuaucauacucaaaccgcuggcccauggcaccucgggaagcuggaaauggauuuugacuucugugagggaacaacugugguugugaccgaagauugcggcaacagagggcccucccuaaggacaacgaccgccucaggaaaacugaucacugaguggugcugucgcaguugcacacucccgccucugcgguacagaggcgaggacgguuguugguacgggauggaaauuaggccacuuaaggagaaggaagagaauuuggucaacagccuggugaccgcgggacauggccagauagauaauuuuucguuagguguucucggcauggcccuguuccuugaagagaugcugcgcacucgaguggggacaaaacacgcuaucuugcucguagcagucuccuuugugacccugauuacgggaaacaugucuuuccgggaccuaggccgugugauggucaugguuggggccacuaugaccgaugacaucggaaugggcgugacauaucuggcucuccuggccgcauuuaagguaagacccaccuucgcggccggucuuuugcugaggaaauuaacuagcaaggagcucaugauggcuacaauugggaucgcccugcuuucacagaguaccaugccugaaacaauacuggagcuaacugaugcacucgcucugggaaugaugguguugaaaaucguccgcaauauggaaaaguaccaacuggccgugaccauuauggcaaucuccugcguucccaacgccgugauuuuacagaaugcuuggaaggucucuuguacgauccucgcgacagugagcguuuccccacugcuucugaccucaagccagcagaaagccgacuggauaccuuuggcacucacuauuaagggccugaaccccaccgcuaucuuucuaacaacucugagucggaccucuaaaaagagauccuggccacuuaaugaggccaucauggccgugggcauggucagcauucucgcuucgucacuguugaaaaacgacauaccgaugacggggccucugguagcaggagguuuacucacagugugcuauguucugaccggcaggucugccgaucuugaacuggagcgagcggcugacgugaagugggaggaucaagccgaaaucaguggguccagccccauuuugucuaucacuauuagcgaggacggauccaugucaaucaaaaaugaagaggaggaacagacacucaccauacugauccgcacuggccuacuggucauuagugguguguucccaguaagcauccccauuacagcagccgcuugguaccuuugggaggugaagaagcagcgggcagggguccucugggauguuccuucuccacccccuguggaaaaagccgagcuggaagacggagcguauagaaucaagcagaggggcauauugggcuacucccaaauuggggcuggaguguauaaagaggguaccuuucacacgauguggcaugucacucguggcgccguguuaaugcaccgcgggaagcggaucgagccgucaugggcagauguuaaaaaggaccugaucaguuacggaggcgguuggaagcucgaaggggaguggaaagaaggagaggaaguacaggugcuggcccuugagccaggcaagaaccccagagcuguccagaccaaaccuggcauuuucaagacaaauaccgggacaaucggagccgugagccuggauuuuuccccagguacuucuggcucgcccauaguugacaggaaagggaagguggucggauuguacggcaacggugugguaacccgaagcggggcauaugucucagcuauugcccagacggagaaguccaucgaagauaauccugagauugaagacgauaucuuccggaaaaagcgccuaacaauaauggaccugcauccgggagcgggcaaaacuaagagauaccuccccgccauugugagggaggcaaucaaacggggccugcgaacccuuaucuuagcuccaacaagaguuguggccgcugaaauggaggaggcacugcgcgggcucccuauuagguaucaaacccccgccauccgugccgaacacacuggacgggagauugucgacuugaugugucaugcuaccuucacaaugagacugcucaguccagugaggguuccuaacuacaaccugauaaucauggaugaagcgcacuuuacggaccccgcaucuauugccgcucgcgguuauaucagcacucgaguggagaugggcgaggccgcagggaucuucaugaccgccacaccaccgggauccagagauccuuuuccccagucaaaugcuccaauuauggacgaagagcgggaaauacccgagaggucuuggaacagcggccacgaaugggucaccgauuucaaggguaagacugugugguuuguaccuaguaucaaagcggggaaugacauugccgcaugccuucgcaagaacggaaaaaaggugauccagcugucccguaaaacauucgauagcgaguacguuaagaccagagcuaaugacugggauuuugucgugacgacugacauuucugagaugggcgccaacuucaaggcagaacgggugaucgauccaaggcgcuguaugaaacccgucauauugacagacggcgaggaacgaguaauccuagccgggccuaugccggugacccauucauccgcugcccaaagacggggaaggauuggucgcaauccaaagaacgagaaugaccaguauaucuacaugggcgaaccccuggagaacgaugaggacugcgcgcacuggaaagaagcaaagaugcucuuagauaauauuaacaccccugaggggaucauacccaguauguuugaaccagagagagaaaaaguugacgccauugauggagaguacaggcugcggggcgaggcucguaagacuuucguggaccuuaugcgccgaggugaucugccugucuggcucgccuauaaaguggcugcagaagggaucaauuacgccgacagaaagugguguuuugauggcauuaagaacaaucagaucuuggaggaaaacguugagguggagauauggacaaaagaaggagagaggaagaaacugaagccccgguggcucgacgcucgcaucuauagcgauccacuggcccuuaaagaauucaaggaguucgcagcgggcagaaagucgcuaacccugaacuugauuacagaaauggggagguuaccuacuuuuaugacgcagaaagcccggaaugcucuggacaaccucgccguccugcauaccgcagaggcuggaggucgagccuacaaucacgcacuuucugagcugccggaaacacucgagacuuugcugcuacugacccuccuugccacagugaccggcgggaucuuccuguuuuuaauguccggaaagggcauugguaaaaugacuuuggggaugugcugcaucauaacggcuagcauucugcucugguaugcgcaaauccagccccacuggaucgccgcaucaauuauccuggaauucuuucuuauaguacugcucauuccagagccugaaaagcagagaaccccccaggauaaccaauugacauacgugguuaucgcuauucugacugucguggccgccaccauggcaaaugagaugggcuucuuagagaaaacaaagaaggaccuaggacugggcaguaucaccacucaggaaucugaguccaacauacucgacaucgaucuucgcccagcuagcgccuggacacuguaugcgguggcuacgaccuuugucacuccuauguugaggcauucaauugaaaauaguagcguuaacgugucccugacagccaucgcaaaucaggccaccguacucauggggcugggaaaagguuggccccuuucuaagauggacauuggcgugccgcuccuggcuaucggguguuacagccaggucaacccaauuaccuugacagcagcccuguuacuacugguggcgcacuacgcuaucauaggaccuggccuccaagccaaagcaacucgggaggcccagaagcgugcugccgcagguauuaugaaaaaucccacgguugaugggaucaccgugaucgaccuugaaccaauucccuaugauccuaaguucgagaagcagcugggccaggucauguugcugauacucugcguaacacaagugcugaugaugagaacuaccugggcucuuugugaggccuuaacacuggcgaccggaccgaucuccacucucugggaaggcaaccccgggagguuuuggaauacgacaauugccguuucaauggcaaacaucuuccgcggaucuuacuuggcuggcgccggucugcuauuuaguauuaugaaaaauaccacuaacacccggcgagggacaggaaauaucggcgagacucugggugaaaaguggaaaucgagacucaacgcacuuggcaagagcgaguuccagauauauaaaaaguccgggauccaggagguggacaggacccuggcuaaagaaggaauuaagcgcggcgagacagaucaucacgccgucucucgggggucagccaaguugagaugguuuguggaacguaacauggucacgccagagggaaaagugguugaccugggcugcgguagggggggauggagcuacuauuguggcggucucaagaaugugcgggaaguaaaaggccugaccaaggggggaccuggccaugaggagcccgugccuauguccacuuacggguggaacuuaguccgccuucaaaguggaguugauguguucuucacaccacccgaaaaaugcgacacccugcucugugauaucggcgagucuagcccuaauccaacuauugaagcgggucgaacacuaagaguccugaacuugguggagaauuggcugaacaauaacacccaguuuugcaucaagguacucaaucccuauaugccgucagugauagaaaagauggagacgcuucagaggaaauacgggggagcucugguucggaacccuuugucccgcaauaguacccacgagauguacugggugagcaacgcaacaggcaauauugucucuuccgugaacaugaucucaagaaugcugaucaauagguucacuaugaagcacaaaaaggccaccuaugaaccagacgucgaucucggcagcgggacacgaaacauuggaauagagucggaaauccccaacuuagacauuaucgguaaacggauugagaagaucaagcaggaacaugagacuucuuggcacuacgaccaagaucauccuuauaaaaccugggcuuaccacggcaguuaugagacaaagcagaccggguccgccagcucaauggugaauggaguuguacgucugcuuacuaaaccaugggacgugguccccauggugacgcagauggcaaugacagauaccacuccguuuggccagcaaagaguuuucaaggaaaaaguggacacccgcacacaggagccuaaggaagguacgaagaaacugaugaagauaaccgccgaguggcuauggaaagagcucgggaagaaaaagacucccaggauguguacacgggaagaguuuaccaaaaaggucagauccaacgcugcgcugggagccaucuucacugaugaaaauaaguggaaaucugcacgcgaggcuguggaagacggcagguuuugggaguugguagaucgagagcggaaccugcaccucgaaggcaagugcgagacauguguguacaauaugauggggaaaagagaaaagaaacuuggagaguucgguaaggccaagggcagcagggcaauuugguauauguggcugggggcccgcuuuuuagaauucgaggcucugggauuuuugaacgaggaccauugguucagucguggcaauucccucagcgguguugaaggggagggacugcaccggcuaggcuacauccuuagagaagucggcaaaaaggaggggggagccauguacgcggaugacaccgcagguugggauacaaggauuacucuggaagaccucaaaaacgaggagauggugaccaaucauaugaagggcgaacacaaaaagcuggccgaggcuaucuuuaaguugacguaucagaacaaagugguccgcguucagcgaccaaccccucgggggacagugauggacauuauaucuagaagggaucaacgcggaucaggccagguagguacuuacgggcugaauaccuucacaaacauggaagcccagcucaucagacaaauggagggagagggcauuuucaagaguauccagcaucuuacugcaaccgaagagaucgcugugcagaauuggcuggcccgggucggcagggaacguuuaucccgaauggcuauuagcggggacgauugcgugguuaaacccauagacgaucgcuuugccucugcacugacggcguugaacgacaugggaaaggugagaaaagauauccagcaaugggagccaucgcgggguuggaaugacuggacacagguccccuucugcucacaccacuuucaugaacucgugaugaaggauggcaggguacugguugugccuugucgcaaccaggacgagcuaauugggagagcccggaucagccagggagcuggcuggucccuuaaggagaccgccugccuggguaaaaguuaugcacaaauguggacucucauguacuuccacaggcgagaucugcguuuggcugccaacgcaauuuguucugccgucccaagccauugggugccgacauccagaaccacuuggucaauccacgcgaagcacgaauggaugaccacagaggacauguuagcuguguggaaucgcgucuggauacaggaaaaccccuggauggaggauaaaacgccuguugaaaguugggaggaggugccauaucuggggaagcgggaagaccaguggugcggaucucucaucggccuuaccagcagggccacuugggcaaaaaauauucagacagccaucaaccaaguaagaucccugauuggcaaugaggaauacaccgacuauaugcccucaaugaagcgcuuucggagggaggaagaggaggcuggggugcuaugguga

SEQ ID NO: 14669 - RNA, 9876 nt, Artificial Sequence
  derived and/or modified CDS sequence (opt3) from DENV-2__EU660400__SS-prME
accgccggcgugaucauuaugcugauaccaacggcuauggcauuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacaaccguugcaccauccaugacuaugagaugcauagggauuucuaacagggauuuuguggaaggagucucggguggcucauggguggacaucguacucgagcacgggagcuguguuacaaccauggccaagaauaagcccacguuagauuucgaacugauuaaaaccgaggcuaagcagccugccacacuucggaaauauugcaucgaagcgaaguugacuaacaccacaacugagagucgcuguccaacccaaggagagcccucccugaaugaagaacaggacaaacgauuuaucugcaagcauucuaugguggauagaggcugggguaacggguguggacuauucggcaagggcgggauugucacaugcgcaauguuuaccugcaaaaagaauauggaaggaaaaguggugcucccugagaaccuggaauacacuauagucaucacgccacacagcggugaggagcaugccguuggcaaugacacagggaagcacggaaaagaaauuaagaucaccccgcaguccucaauaacugaggcugaacuuaccggcuaugguacagugaccauggaguguagucccaggacugggcuggauuucaacgaaaugguauugcuccagauggaggacaaagccuggcuggugcaccggcaaugguuuuuagaucugccucucccauggcuucccggcgcagacacacagggaagcaauuggauucagaaggagacgcuggucaccuucaagaacccucaugcuaaaaagcaggacgugguuguguugggcucucaagaaggggccaugcacacugcgcuaacaggagccaccgagauccagauguccucagguaaucugcucuuuacaggccaucugaaaugccgucuucgcauggauaagcugcaguugaaagggaugagcuacaguauguguacuggaaaguucaagaucgucaaagaaauugcagagacccaacacggcacgaucgugauuagaguacaguaugagggugacgggucuccaugcaagauacccuucgaaaucauggaucucgagaaaaggcauguucugggccgguuaauuaccgugaacccgaucgucacagaaaaggacuccccugugaacaucgaggcugaacccccauuuggagauagcuacauuauaaucggcgucgagccugggcagcugaaacuaaauugguucaagaagggaucgucuauuggucagauguuugagacuaccaugcgaggcgccaaacgcauggcuauccucggggacacagccugggauuucggaucccugggcgguguguuuacuucaauugggaaggcacuucaccaaguuuucggcgccaucuacggagcugcguuuaguggcgugagcuggaccaugaaaauauugaucgggguaauuaucacguggauuggaaugaacuccagaucuacaagccugucagucagucucgugcugguuggcguggucacccuuuaucugggugugaugguacaggcagacuccgggugugugguuagcuggaagaauaaagaauugaagugcggaucuggcaucuucauaacugauaacguccacacauggaccgagcaguacaaguuucagcccgaaucaccaaguaaacucgccagcgcuauucaaaaggcccaugaggaagguaucuguggcauuagguccgugacucggcuggagaauuuaauguggaaacagaucacccccgagcugaaccacauacuaucugaaaaugaggugaagcucacaaucaugacgggggacauuaaaggaaucaugcaggcaggcaagcgcucgcugagaccucagccaaccgaacuuaaauauagcuggaagacuugggggaaggccaaaauguuguccacagagucacauaaccaaaccuuccugauugauggaccggaaacagcugagugccccaauacuaacagggccuggaauagucucgaggucgaagacuacggcuuugguguuuucucuaccaacaucuggcugaaguuacgugagaaacaggacguguuuugugauagcaagcugauguccgcagcgauaaaagacaaucgggcugugcacgccgauaugggguauuggauugaaucagcacuuaacgacacguggaagauggagaaggccagcuucaucgagguaaaaucuugccacuggccuaagucccauacauuguggaguaauggaguccucgaaagcgagaugaucauucccaagaacuucgcuggccccgugucucagcacaacuaccgaccugguuaucauacccagacugccggcccauggcaccuggggaagcuagaaauggauuuugacuucugugagggaaccacaguuguggucacugaagauugcggcaauagagggcccucccugaggaccacaacggcaucaggaaaacucaucaccgaguggugcugucgcaguugcacucugccgccucuucgguacagaggcgaggacgguuguugguacgggauggaaauuaggccauugaaggagaaggaagagaaccuggugaauagcuuaguuacagcuggacauggccaaauagauaacuuuucgcucggugugcugggcauggcccuuuuccuggaagagauguugcgcacccgaguagggacuaaacacgcgauccuccuggucgccguguccuuugugacacuaauuaccggaaauaugucuuuccgggaccugggccgugucaugguuauggugggggcuacgaugacugaugacaucggaaugggcguaaccuaucucgcacugcuugccgcuuuuaaggugagacccacauucgccgcagguuugcuguuaaggaaacucaccagcaaggagcugaugauggcgacuauugggaucgcccuucugucacagaguacaauaccugaaaccauccuagagcucacagaugcucuggccuugggaaugaugguccugaaaauugugcgcaacauggaaaaguaccaguuagcaguuacuaucauggcuauuuccugcgugcccaaugccgucauccuccaaaacgcauggaaggugucuuguaccauacuggccgcuguuagcguguccccacuucuguugacgucaagccggcagaaagcggacuggauuccucucgcccugacaaucaagggccuaaaucccaccgcaaucuuucugacuacccuuaguagaacaucuaaaaagagguccuggccacucaacgaggcugucauggccguaggcauggugagcauucuggccucgucauugcugaaaaaugacauaccgaugacugggccuuuaguugcuggaggucuccugaccgugugcuauguccuuacgggccgaucugcagaucuggaauuggagcgcgccgcggacgugaagugggaggaucaggcugaaaucaguggguccagccccauucucucuaucacaauuagcgaggacggauccaugucaaucaaaaacgaagaggaggaacacacccugacuauacuaauccggacaggccugcuuguaauuagugguguguucccagucagcauccccauuaccgccgcagccugguaccucugggagguuaagaagcagagagcuggggugcugugggaugugccuucuccacccccugucggaaaagcagaauuggaggacggcgccuauaggaucaagcaacguggcauauuuggguacucccagauuggagcggguguguauaaagaaggcacuuuccauacaauguggcacguuacccgcggggcuguauuaaugcaucggggaaagagaaucgagccgucaugggccgaugugaaaaaggaccugaucaguuacggcgguggguggaagcucgagggagaauggaaagagggcgaagagguccaggugcuggcacuugaaccaggcaagaaucccagggccguucagacgaaaccugggcuguuuaagacuaacaccggaacaauuggugcugugagcuuggauuucuccccaggcaccucugggucgcccaucgucgaccgaaaaggaaaggugguaggccuauacgguaauggggucgugacacggagcggagccuauguuucagcaauagcucaaacugagaaguccauugaggauaacccugaaaucgaggacgauauuuuccgcaaaaagagacugaccaucauggaccuccacccgggcgccggcaaaacgaagagguaccugcccgcgauagugcgggaagccauuaaacgagggcuuagaacauuaauccuggcaccaacucgcgucguggcugccgagauggaagaggcucucaggggauugccuauccguuaucagacccccgcaauucgggccgagcauacagguagagaaaucguugaccugaugugucacgccaccuuuacuaugaggcuccugaguccagugcgcgucccuaacuacaaucuuauuauaauggaugaggcucacuucaccgaccccgcgucuaucgcagcccgaggcuauauuagcacaagaguggaaaugggggaggcugccggaaucuuuaugacggcaacuccaccgggcucccgggauccuuucccccagucaaacgccccaaucauggacgaggaaagggagauucccgaacgcucuuggaauagcggucaugaguggguaaccgauuuuaaggggaagacagugugguucguuccuaguauaaaagcuggaaacgacaucgcggccugccugcguaagaauggcaaaaaggucauucaguuguccagaaaaaccuuugauagcgaauacgugaagacucgggcaaacgacugggauuucguggucacaaccgacaucucugagaugggcgcuaauuuuagggccgagcgcguaauugauccacgaagauguaugaagcccgugauccuaacggacggggaagaacggguuauacuggcaggaccuaugccggugacucacucauccgccgcucaaaggcgcgguagaaucggcaggaaccccaaaaaugaaaacgaccaguauauuuacaugggggagccccucgaaaaugaugaggacugcgcccauuggaaggaggcgaaaauguuacuggauaacaucaauacaccugaaggaauuauccccaguauguucgagccagaacgggagaaggucgacgcaauagauggcgaauaccgucuucgcggugaggcccgaaaaaccuuuguggaccugaugagaagaggggaucucccuguuugguuggcuuaucggguggccgcugagggcauuaacuacgcagaccgcagaugguguuucgauggaaucaagaauaaccagauucuggaagagaacgucgaaguggagaucuggaccaaagagggcgaaaggaagaagcucaaaccccgguggcuggacgcccgaauauauagcgauccacuugcucuaaaggaguucaaagaauuugccgcagggagaaagucgcugacuuugaauuuaaucacagagaugggacgccugccuaccuucaugacacaaaaagcgagggacgcccucgauaaccuggcuguacuucacacugccgaaguggguggccgggcauacaaucacgcucugucugagcucccggagacguuggaaacccugcuacugcucacacuucuggccacuguuaccgggggaauauuuuuauucuugauguccggcaaggguaucgggaagaugacacugggcaugugcugcauuaucaccgcaagcauacuccugugguaugcccagauucagccccauuggaucgcugcgucaaucauucuugaguuuuuccugaucguccucuugauaccagaaccugagaaacagcguacuccccaagacaaccagcugacguacguggugauugccaucuuaaccgucguugcagcuacaauggccaaugaaaugggauuucuagagaagacuaaaaaggaccugggccucgggaguauuaccacacaggagucugaauccaacauccuugauauagaccugagaccagccagcgcauggaccuuguaugcuguggccacuacauucguaacgccuaugcugaggcacucaaucgagaauaguagcgugaacgucucccucaccgcgauugcuaaucaggccacugugcugaugggacuuggucgcggcuggccccucucuaaaauggauaucgggguuccgcuguuggcaauuggauguuacagccaagugaacccaaucacacugaccgccgcuuuacuacugcucgucgcacauuacgccauuaucggcccuggucuucaggcgaaggcuacccgggaagcccagaagcgagcagccgcugggauaaugaaaaaucccacaguagacggcauuacugugaucgaucuggagccaauccccuaugacccuaaguuugaaaaacaguugggacaaguuaugcugcucgugcugugcgucacacaggugcuuaugaugagaaccacaugggccuuaugugaggcacugacucucgcuaccggcccgauuuccacauugugggaggggaaccccggaagguucuggaauaccacuauagccgucucaauggcgaacaucuuucgcggcucuuaccuggccggugcagggcuacuguucaguauuaugaagaauacgacaaacacccggagaggaacuggcaauaucggugaaacccucggcgagaaauggaagucgcgucuuaacgcucugggaaagagcgaauuucagauuuauaaaaaguccggaauccaggagguggauaggacauuggccaaagagggcauaaagagaggggaaacugaccaccaugcaguuucucgcggaucagcuaaacugcgaugguucguggagagaaacaugguaaccccagaaggcaagguggucgaucucgguugcgggaggggaggcuggagcuacuauugugguggccugaaaaauguucgggaggugaagggguuaacaaagggaggcccugggcacgaggaaccaaucccuauguccacguacggauggaaccuuguccgccugcaaaguggcguggacguauucuuuaccccacccgagaaaugcgauacucuccuaugugacauuggugaaucuagcccuaauccaacaaucgaggccgggagaacccugaggguguugaaccugguugaaaauuggcucaacaauaacacucaguucugcauuaaggugcuuaaucccuauaugccgucagucaucgagaaaauggaaacacugcagcgaaaguacggaggcgccuuggugcggaacccucugucccguaauaguacccacgagauguacugggucagcaacgcgacgggcaauauagugucuuccguuaacaugauuucaagaaugcucaucaaucgcuuuaccaugaaacauaagaaggcuacauaugagccagauguagacuuagggagcggaacuaggaacaucgguauugaaaacgagauacccaaucuggacaucauuggcaaacggaucgaaaagauuaaacaagagcacgaaaccucguggcauuacgaucaggaccacccuuauaagacaugggcauaccacgggucuuaugagacuaaacagaccggaagugccuccagcauggugaacggcgucgugaaacuucugacaaagccaugggauguugugcccauggucacccagauggcuaugacugacacgacaccguucggucaacagagaguguuuaaagagaagguagauacccgcacucaggaaccuaaagaggggaccaagaaacuaaugaggaucacagccgaauggcucuggaaggagcugggaaagaaaaagacgccccgaauguguacccgggaggaguucacuagaaaagugaggucaaaugcagccuugggcgcuauauuuacagacgagaacaaguggaaauccgcgcgcgaagccguugaggauucucguuucugggaacuggucgaccgggagagaaaucuccaucuugagggcaagugcgaaaccuguguguacaacaugauggggaaaagggagaagaagcugggagaauuugguaaagcaaagggcagccgcgcuaucugguauaugugguuaggggcccgauuccuggaguuugaagcauugggauuccucaaugaggaucacugguuuagucggggcaacucccugagcgguguggagggggaaggacuacauaaacuuggcuacauucugagagacgucucuaagaaagagggcggggccauguacgcugaugacacugccggaugggacacaaggaucacccucgaagaucugaagaaugaggaaaugguuacaaaccacaugaagggugagcauaaaaaguuggcggaggcaauuuucaaacugacuuaucagaauaaggugguacgcgugcaaagaccaaccccucggggcacggucauggacaucauuucaaggaaagaucagcgugggaguggacaggugggcaccuacggucucaacacauucacuaauauggaagcccagcuuauacgacaaauggagggggaaggaaucuuuaaguccauucagcgccugaccguuacagaggagaucgcugugcagaacugguuagccagagucggccgggaaaggcugagccgcauggcaaucucuggcgacgauugcgugguaaagcccuuggacgauagauucgcuucggcccucacugcucugaaugacauggggaaaguucggaaggauauucaacagugggagccaucaaggggauggaacgacuggacccaggugcccuuuugcagccaccacuuccaugagcuagucaugaaagauggucgagugcuuguggucccuugucguaaccaggacgagcugauaggcagagcccgcaucucccaaggggcaggauggagucucaaggaaacggcgugccugggcaaaucuuaugcccagauguggacauugauguacuuucaccggagggauuuaagacuggcugccaaugcaauuuguagcgcuguuccaucccauugggugccgaccucacgcacuacauggaguauccacgccaagcacgaguggaugaccacugaggacaugcucgcaguauggaaccggguguggauucaggaaaaucccuggauggaggacaagaccccugucgaaucuugggaggaagugccauaucuugguaaaagggaggaucaguggugcgggagccugaucggacuaacaucccgagccacgugggcgaagaacauacaaaccgcuaucaaucagguuagaucacugauuggcaacgaggaauacacugacuauaugcccagcaugaaacgguucaggaaggaggaagaggaagccggcgugcucugguga

SEQ ID NO: 14670 - RNA, 9876 nt, Artificial Sequence
  derived and/or modified CDS sequence (opt3) from DENV-2__EU569711__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauauucugggccgguuaaucacgguuaacccgaucgugaccgaaaaggacuccccugucaacauugaggccgaacccccauuuggagauagcuacauaaucauuggcguggagccugggcagcugaaacuaaauugguucaagaagggaucgucuaucggucagauguuugagacaacuaugcgaggcgcuaaacgcauggccauucucggggacaccgcaugggauuucggaucccugggcggugucuuuacaucaaucgggaaggcccuucaccaaguguucggcgcuauauacggagcggcauuuaguggcguuagcuggacuaugaaaaucuugauuggggugaucauuaccuggaucggaaugaacuccagaucuacgagccugucaguaagucucguccuggugggcguugugacacuuuaucugggugucauggugcaggccgacuccggguguguagugagcuggaagaauaaagaauugaagugcggaucuggcauauucauuaccgauaacguucacacuuggacagagcaguacaaguuucagcccgaaucaccaaguaaacucgcuagcgccauccaaaaggcacaugaggaagguauuuguggcaucagguccgucacccggcuggagaauuuaauguggaaacagauaacucccgagcugaaccacauccuaucugaaaaugaggugaagcucaccauuaugacaggggacaucaaaggaauuaugcaggccggcaagcgcucgcugagaccucagccaacggaacuuaaauauagcuggaagaccugggggaaggcuaaaauguuguccacugagucacauaaccaaacauuccugaucgauggaccggaaaccgccgagugccccaauacaaacagggcauggaauagucucgagguggaagacuacggcuuuggugucuucucuacuaacauauggcugaaguuacgugagaaacaggacguuuuuugugauagcaagcugauguccgcggcuauuaaagacaaucgggccgugcacgcagauaugggguauuggaucgaaucagcccuuaacgacaccuggaagauggagaaggcuagcuucaucgaggugaaaucuugccacuggccuaagucccauacguuguggaguaauggaguacucgaaagcgagaugauuaucccaaaaaacuucgccggccccgucucucagcacaacuaccgaccugguuaucauacacagaccgcaggcccauggcaccuggggaagcuagaaauggauuuugacuucugugagggaacuaccgugguugugacagaagauugcggcaauagagggcccucccugaggacuaccacagcuucaggaaaacucauuacggaguggugcugucgcaguugcacccugccgccucuucgguacagaggcgaggacgguuguugguacgggauggaaauaaggccauugaaggagaaggaagagaaccuggucaauagcuuagugacugccggacauggccaaaucgauaacuuuucgcucgguguucugggcauggcgcuuuuccuggaagagauguugcgcacacgaguggggaccaaacacgccauucuccugguagcugucuccuuugugacucuaaucacaggaaauaugucuuuccgggaccugggccgugugauggucaugguuggggcaaccaugacggaugacauuggaaugggcgugacuuaucucgcccugcuugcugccuuuaagguaagacccaccuucgcagcggguuugcuguuaaggaaacucacaagcaaggagcugaugauggccaccaucgggauagcucuucugucacagaguacuaucccugaaacaauucuagagcucaccgaugcccuggcauugggaaugauggugcugaaaaucguccgcaacauggaaaaguaccaguuagcugugacaauuauggccaucuccugcguucccaaugcagugauacuccaaaacgccuggaaggucucuuguacuauucuggcugcggugagcguuuccccacuucuguugaccucaagccagcagaaagccgacuggaucccucucgcacugacgaucaagggccuaaaucccacagcuauuuuucugaccacucuuagucggaccucuaaaaagagauccuggccacucaacgaggccgugauggccgucggcaugguaagcauacuggcuucgucauugcugaaaaaugacaucccgaugacagggccuuuaguggcaggaggucuccugacuguuugcuaugugcuuaccggcaggucugccgaucuggaauuggagcgagcggcugacgucaagugggaggaucaggccgaaauuaguggguccagccccauccucucuauuacgaucagcgaggacggauccaugucaauaaaaaacgaagaggaggaacacacacugaccauccuaauucgcacuggccugcuugugaucagugguguauucccagugagcauucccaucacagcagccgcuugguaccucugggaggucaagaagcaacgggcagggguucugugggaugugccuucuccacccccugugggaaaagccgaauuggaggacggcgcguauagaauaaagcagaggggcauuuuuggguacucccagaucggagcuggugucuauaaagaaggcaccuuccauacuauguggcacgugacacguggggccguuuuaaugcaucgcggaaagcggaucgagccgucaugggcagauguaaaaaaggaccugauuaguuacggcgguggguggaagcucgagggagaauggaaagagggcgaagaggugcagguccuggcccuugaaccaggcaagaaucccagagcugugcaaaccaaaccugggcuguuuaagacgaacacuggaaccaucggugccguuagcuuggauuucuccccaggcacaucugggucgcccauaguggacaggaaaggaaaggucgugggccuauacgguaaugggguagucacccgaagcggagcauaugugucagcuauugcccagacagagaaguccaucgaggauaacccugaaauugaggacgauaucuuccggaaaaagcgccugacuauaauggaccuccacccgggcgcgggcaaaaccaagagauaccugcccgccauuguuagggaagcaaucaaacgggggcuucgaacguuaauccuggcuccaacaagaguggucgccgcugagauggaagaggcacuccgcggauugccuauuagguaucagacucccgccauccgugccgagcauaccggucgggaaauuguggaccugaugugucacgcuacauuuaccaugagacuccugaguccaguuagggugccuaacuacaaucuuauaaucauggaugaggcgcacuucacugaccccgcaucuauugccgcucgcggcuauaucagcacccgagucgaaaugggggaggccgcaggaaucuuuaugacagccacgccaccgggcuccagagauccuuucccccagucaaacgcuccaauuauggacgaggaacgggagauacccgaaaggucuuggaauagcggucaugagugggugacugauuuuaaggggaagaccguaugguucgugccuaguaucaaagcgggaaacgacauugccgcaugccugcgcaagaauggcaaaaagguuauccaauugucccguaaaacauuugauagcgaauacgucaagaccagagcuaacgacugggauuucguggugacuacagacauuucugagaugggcgccaauuuucgggcagagagggucaucgauccacgccgauguaugaagcccguaauacuaaccgacggggaagagagagugauccuggccggaccuaugccgguuacgcacucauccgcugcccagcggaggggucgcauuggcagaaacccaaaaaaugaaaacgaccaguauaucuacaugggggagccccucgaaaaugaugaggacugcgcgcauuggaaggaggcaaaaauguuacuggauaacauuaauacuccugaaggaaucauacccaguauguucgagccagaaagggagaagguggacgccauugauggcgaauaccggcuucguggugaggcucgcaaaacauuugucgaccugaugcgaagaggggaucucccugugugguuggccuauaggguugcugcagagggcaucaacuacgccgaccggcgcugguguuucgauggaauuaagaauaaccaaauccuggaagagaacguggaagucgagauauggaccaaagagggcgaaagaaagaagcucaaacccagguggcuggacgcucggaucuauagcgauccacuugcccuaaaggaguucaaagaauuugcagcggggcgaaagucgcugaccuugaauuuaauuacugagaugggaagacugccuacauucaugacccagaaagcccgcgacgcucucgauaaccuggccgugcuucacacagcagaaguagguggcagggcuuacaaucacgcccugucugagcucccggagacuuuggaaacgcugcuacugcucacccuucuggcaacagugacugggggaaucuuuuuauucuugauguccggcaaggguauugggaagaugacccugggcaugugcugcaucauaacagccagcauucuccugugguaugcucagauccagccccauuggaucgcggccucaauuauccuugaguuuuuccugauaguucucuugauuccagaaccugagaaacaacggaccccccaggacaaccagcugacuuacgucgugaucgcaauuuuaacgguggucgcugccaccauggccaaugaaaugggauuucuagagaagacaaaaaaggaccugggccucgggaguaucacuacccaggagucugaauccaacauacuugauaucgaccugcguccagcaagcgcuuggacauuguaugccguugcgaccacuuucgugacaccuaugcugagacacucaauugagaauaguagcguaaacgugucccucacggcuaucgccaaucaagcaaccguccugaugggacuugguaggggcuggccccucucuaaaauggauauuggggugccgcuguuggccaucggauguuacagccagguuaacccaauuacucugacagcugcauuacuacugcucguggcccauuacgcgaucauaggcccuggucuucaggcuaaggccacccgcgaagcacagaagcgggccgcugccgggauuaugaaaaaucccaccgucgacggcaucacaguaaucgaucuggagccaauucccuaugacccuaaguuugaaaaacaauugggacaggugaugcugcucguucugugcgugacucagguccuuaugaugcgaacgaccugggcauuaugugaggcucugacacucgccacuggcccgauauccaccuugugggaggggaaccccggaagauucuggaauacaaccaucgcggugucaauggccaacauuuuuaggggcucuuaccuggcaggugcugggcuacuguucaguaucaugaagaauacuacgaacacacgccggggaaccggcaauauuggugaaacucucggcgagaaauggaagucgagacuuaacgcccuggggaagagcgaauuucagaucuauaaaaaguccggaauacaagaggucgaucguaccuuggcaaaagagggcaucaagaggggggaaacagaccaccaugcugugucucggggaucagccaaacugcgcugguucguugagcgaaacauggugacuccagaaggcaagguaguggaucucgguugcgggagaggaggcuggagcuacuauugugguggccugaaaaaugucagggagguuaagggguuaaccaagggaggcccugggcacgaagagcccauuccuauguccacauacggauggaaccuugugcggcugcagaguggcgucgacguguucuuuacgccacccgagaaaugcgauacccuccuaugugacaucggugaaucuagcccuaauccaacuauugaggccgggcgcacacugagaguauugaaccugguggaaaauuggcucaacaauaacacccaguucugcaucaagguucuuaaucccuauaugccgucagugauagagaaaauggaaacucugcaaaggaaguacggaggcgcguugguccgaaacccucugucccggaauaguacacacgagauguacugggugagcaacgcuaccggcaauauugucucuuccgugaacaugaucucacguaugcucaucaauagauuuacgaugaaacauaagaaggcaaccuaugagccagauguugacuuagggagcggaacacgcaacauugguauagaaaacgagauccccaaucuggacauuaucggcaaaaggauugaaaagaucaaacaggagcacgaaacuucguggcauuacgaucaggaccacccuuauaagaccugggccuaccacgggucuuaugagacaaaacagacuggaagugcuuccagcaugguaaacggcgugguccggcuucugaccaagccaugggaugugguucccauggugacacaaauggccaugaccgacacuacgccguucggucagcagagagucuuuaaggagaaaguggauacacgcacccaggaaccuaaggaggggacuaaaaagcuaaugaggauaaccgcagaauggcucuggaaagagcugggaaagaagaaaacaccccgaauguguacgcgggaggaauucaccagaaagguaaggucaaaugccgcuuugggcgcgaucuuuacugacgagaacaaauggaaguccgcccgcgaagcaguggaggauucucguuucugggaacugguugaccgggagagaaaucuccaucuugagggcaaaugcgaaacaugugucuacaacaugauggggaagagggagaaaaagcugggagaauuugguaaggcuaaaggcagccgcgccauuugguauaugugguuaggggcacgauuccuggaguuugaagccuugggauuccucaaugaggaucacugguuuagucggggcaacucccugagcgguguggagggggaaggacuacauaagcuuggcuacauccugagagacgugucuaaaaaggagggcggggcuauguacgccgaugacaccgcgggaugggacacuaggauuacacucgaagaucugaaaaaugaggaaauggucaccaaccacaugaagggugagcauaagaaauuggcagaggccaucuucaagcugacauaucaaaauaaaguugugcgcguacagagaccaacuccucggggcaccgugauggacauuauaucaaggaaggaucagcgugggaguggacaggucggcacguacggucucaacaccuucacaaauauggaagcucaacuuauccgacagauggagggggaaggaauuuuuaaauccauccagcgccugacugugaccgaggagaucgccguucaaaacugguuagcaagagugggccgggaaaggcugagccgcauggcuauuucuggcgacgauugcgucgugaagcccuuggacgauagauucgccucggcucucacagcccugaaugacauggggaagguacggaaagauauacagcagugggagccaucaaggggauggaacgacuggacucagguucccuuuugcagccaccacuuccaugaacuagugaugaaggauggucgaguccuuguggugccuugucguaaccaagacgagcugaucggcagagcacgcauuucccagggggcgggauggagucucaaagaaaccgccugccugggcaagucuuaugcucagauguggacguugauguacuuucaccggagggauuuaagacuggccgcaaaugcuaucuguagcgccgucccaucccauuggguuccgacaucacgcaccacuuggaguauucacgcaaaacacgaguggaugacaaccgaggacaugcucgccguguggaaccggguauggauccaggaaaaucccuggauggaggacaagacuccuguggaaucuugggaggaagucccauaucuugguaagagggaggaucaauggugcgggagccugauaggacuaaccucccgagcgacaugggcuaaaaacauccagacggccauuaaucaggugagaucacugaucggcaacgaggaauacaccgacuauaugcccagcaugaagcgguucaggaaagaggaagaggaagcaggcguucucugguga

SEQ ID NO: 14671 - RNA, 9876 nt, Artificial Sequence
  derived and/or modified CDS sequence (opt3) from DENV-2__EU569712__SS-prME
accgccggaaugaucauuaugcugauacccacagcuauggcuuuccaccucacuacgcggaacggggaaccucauaugaucgugggaaggcaggaaaaggguaaaagccuucuguuuaagaccgaggacggcguaaauaugugcacauugauggccauugauuuaggggaacugugugaggacacuaucaccuacaaaugcccauuacuccggcaaaacgaaccggaggauauugacuguuggugcaauuccacaucuaccuggguuacuuauggaacauguaccacgacuggcgagcaccgccgagaaaagcguucaguggcgcugguuccccauguggguauggggcuugagaccagaacagaaacuuggaugaguagcgagggagcuuggaaacacguccagaggaucgagaccuggauucugcggcauccuggcuucacaaucauggccgcaauuuuggccuacaccaucggcacgacucacuuucagcgcgcucucauuuucauccugcugacagcaguggccccauccaugaccaugagaugcauagggauuucuaacagggauuuuguugaaggagugucggguggcucaugggucgacaucgugcucgagcacgggagcuguguaacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguugauagaggcugggguaacggguguggauuauucggcaagggcgggauugugaccugcgccauguuuacaugcaaaaagaauauggaaggaaaagucgugcucccugagaaccuggaauacaccauagugaucacuccacacagcggugaggagcaugcugucggcaaugacacggggaagcacggaaaagaaauuaagaucacaccgcaguccucaauaaccgaggccgaacuuacuggcuaugguaccguuacaauggaguguagucccaggaccgggcuggauuucaacgaaaugguguugcuccagauggaggacaaagcauggcugguacaccggcaaugguuuuuagaucugccucucccauggcuucccggcgcugacacucagggaagcaauuggauucagaaggagacacuggugacguucaagaacccucaugccaaaaagcaggacgucgugguuuugggcucucaagaaggggcgaugcacaccgcccugacuggagcaacagagauccagauguccucagguaaucugcucuuuaccggccaucugaaaugccgucuucgcauggauaagcugcaguugaaagggaugagcuacaguauguguacaggaaaguucaagaucgugaaagaaauugcugagacucaacacggcaccaucgucauuagagugcaguaugagggugacgggucuccaugcaagauacccuucgaaaucauggaucucgagaaaagguacguacugggccgguuaauuacgguuaacccgaucgugaccgaaaaggacuccccugucaacaucgaggccgaacccccauuuggagauagcuacauuauaaucggcguggagccugggcagcugaaacuaaauugguucaagaagggaucgucuauuggucagauguuugagacaacuaugcgaggcgcuaaacgcauggccauccucggggacaccgcaugggauuucggaucccugggcggugucuuuacaucaauugggaaggcccuucaucaaguguucggcgcuaucuauggagcggcauuuaguggcguuagcuggacuaugaaaauauugaucggggugauuaucaccuggauuggaaugaacuccagaucuacgagccugucaguaagucucguccuggugggcguugugacacuuuaccugggugucauggugcaggccgacuccggguguguagugagcuggaagaauaaagaauugaagugcggaucuggcaucuucauaaccgauaacguucacacuuggacagagcaguauaaguuucagcccgaaucaccaaguaaacucgcuagcgccauucaaaaggcacacgaggaagguaucuguggcauuagguccgucacccggcuggagaauuuaauguggaaacagaucacucccgagcugaaccauauacuaucugaaaaugaggugaagcucaccaucaugacaggggacauuaaaggaaucaugcaggccggcaagcgcucgcugagaccucagccaacggaacuuaaauacagcuggaagaccugggggaaggcuaaaauguuguccacugagucacacaaccaaacauuccugauugauggaccggaaaccgccgagugccccaauacaaacagggcauggaauagucucgagguggaagacuauggcuuuggugucuucucuacuaacaucuggcugaaguuacgugagaaacaggacguauuuugugauagcaagcugauguccgcggcuauaaaagacaaucgggccgugcaugcagauaugggguacuggauugaaucagcccuuaacgacaccuggaagauggagaaggcuagcuucaucgaggugaaaucuugccacuggccuaagucccacacguuguggaguaauggaguacucgaaagcgagaugaucauucccaagaauuucgccggccccgucucucagcauaacuaucgaccugguuaccacacacagaccgcaggcccauggcaucuggggaagcuagaaauggauuuugacuucugugagggaacuaccgugguugugacagaagauugcggcaauagagggcccucccugaggacuaccacagcuucaggaaaacucaucacggaguggugcugucgcaguugcacccugccgccucuucgguacagaggcgaggacgguuguugguaugggauggaaauuaggccauugaaggagaaggaagagaaccuggucaauagcuuagugacugccggacacggccaaauagauaacuuuucgcucgguguucugggcauggcgcuuuuccuggaagagauguugcgcacacgaguggggaccaaacaugccauccuccugguagcugucuccuuugugacucuaauuacaggaaauaugucuuuccgggaccugggccgugugauggucaugguuggggcaaccaugacggaugacaucggaaugggcgugacuuaccucgcccugcuugcugccuuuaagguaagacccaccuucgcagcggguuugcuguuaaggaaacucacaagcaaggagcugaugauggccaccauugggaucgcacuucugucacagaguacuauaccugaaacaauccuagagcucaccgaugcccuggcauugggaaugauggugcugaaaauuguccgcaacauggaaaaguaucaguuagcugugacaaucauggccauucucugcguucccaaugcagugauccugcaaaacgccuggaaggucuccuguacuauacuugcugcggugucuguuagcccacuguugcucaccuccucacagcagaaagccgacuggauuccucuggcacuaacgaucaagggccugaaucccacagcuaucuuucuuaccacucucagccggaccaguaaaaagagaucuuggccacugaacgaggccgugauggccgucggcaugguauccauuuuggcuagcucgcugcucaaaaaugacauaccgaugacagggccucuaguggcaggaggucugcuuacuguuugcuacgugcugaccggcaggucagccgauuuggaacucgagcgagcggcugacgucaagugggaggaucaggccgaaaucucugggaguucccccauucugagcaucacgauuucugaggacggaagcauguccaucaaaaacgaagaggaggaacaaacacuaaccauacugauccgcacuggccuucucgugauuucagguguauucccagugaguauccccauuacagcagccgcuugguaucugugggaggucaagaagcagcgggcagggguuuugugggaugugccuagcccacccccuguggaaaaagccgaguuagaagacggagcguacagaaucaagcagaggggcauauuuggcuauucucagauuggggcuggagucuacaaagaggguaccuuccacacuauguggcacgugacacguggcgccguucugaugcaucgcgggaagcggaucgagccguccugggcagaugucaaaaaggaccucaucucauacggaggcgguuggaagcuggaaggggaguggaaagaaggagaggaagugcaaguccuugcccuggagccaggcaagaaucccagagcugugcagaccaaaccuggcuuguuuaagacgaacacugggaccauuggagccguuagucuagauuucagcccagguacauccggcucucccaucguggacaggaaagggaaggucgugggacuguauggcaaugguguagucacccgaucgggggcauacgugagcgcuauagcccagacagagaagucaauugaagauaacccugagaucgaagacgauauuuuccggaaaaagcgccucacuaucauggaccugcacccgggagcgggcaaaaccaagagauaucuucccgccauaguuagggaggcaauuaaacggggcuuacgaacgcugauccucgcuccaacaagaguggucgccgcugaaauggaggaggcauugcgcgggcugccuaucagguaccagacucccgccauucgugccgaacauaccggacgggagaucguggaccucaugugucacgcuacauuuaccaugagacugcuuuccccaguuagggugccuaacuauaaucugauuauaauggaugaagcgcauuucacugaccccgcaaguaucgccgcucgcgguuacauuucuacccgagucgagaugggcgaggccgcagggaucuuuaugacagccacgccaccgggaagcagagauccuuucccccaauccaacgcuccaaucauggacgaagaacgggaaauucccgagaggucauggaacucuggccacgaaugggugacugauuuuaaggguaagaccguaugguucgugccuagcauaaaagcggggaacgacaucgccgcaugcuugcgcaagaauggcaaaaagguuauucagcuaagucguaaaacauuugauuccgaguaugucaagaccagagcuaacgacugggauuucguggugacuacagacaucagcgagaugggcgccaauuuucgggcagaaagggucauugauccacgccgauguaugaagcccguaauccugaccgacggcgaggaaagagugauacucgccgggccuaugccgguuacgcacucuucagcugcccagcggaggggacgcaucgguagaaaccccaaaaaugagaacgaccaauacauuuacaugggcgaacccuuagagaaugaugaggacugcgcgcauuggaaggaagcaaaaaugcugcuugauaacaucaauacuccugaggggauuauccccuccauguucgaaccagagagggaaaagguggacgccauagauggagaguaucggcugcguggcgaggcucgcaaaacauuugucgaccucaugcgaagaggugauuugccuguguggcuggccuacaggguugcugcagaagggauuaacuaugccgaccggcgcugguguuucgauggcaucaagaauaaccagauucucgaggaaaacguggaggucgagaucuggaccaaagaaggagagagaaagaagcugaaacccagguggcuugacgcucggauauacagugauccacuagcccugaaggaguucaaagaguuugcagcgggccgaaagagcuugaccuuaaaucugaucacugaaauggggagacucccuacauucaugacccagaaagcccgcgacgcucuggauaaccuugccgugcugcacacagcagagguaggagguagggcuuauaaucaugcccucucggaguugccggaaacucuggagacgcuacugcuccuuacccuguuagcaacagugacuggcgggauauuuuuguuccugaugucuggaaagggcaucgguaagaugacccucgggaugugcugcauuaucacagccuccauacugcuuugguacgcucagauucaaccccacuggaucgcggccagcaucauucuggaauuuuuccucaucguuuugcugauaccagagccugaaaaacagcggacaccacaggacaaccaguuaacuuaugucgugauugcaauccuaacgguggucgcugccaccauggccaaugagaugggcuuucuggagaagaccaaaaaggaccucggacuuggcucaauuaucacucaagaaagugagucuaacauacuggauaucgacuugcguccagcauccgcuuggacccuguacgccguugcgacaaccuucgugacuccuaugcucagacacagcauugaaaauucaaguguaaacgugagccugacagcuaucgccaaucaggcaacgguccuuauggggcucggaagggguuggccccuguccaaaauggauauuggcgugccguugcuggccaucggguguuacucucagguuaacccaauuaccuuaacugcugcacuacugcuccuuguggcccauuaugcgaucauaggaccuggccugcaggcuaaggccacacgcgaggcacaaaagcgggccgcugccgguauuaugaaaaaucccaccgucgacgggaucaccguaaucgauuuggaaccaauucccuacgacccuaaguuugagaaacagcugggccaggugaugcuccugguucuuugcgugacacaggucuuaaugaugcgaacuacgugggcacugugugaggcucucaccuuggccacaggaccgauaagcacucugugggaaggcaaccccgggagauucuggaauaccacaaucgcgguguccauggccaacauuuuuaggggaucauaucuagcaggcgcuggucuacucuucucuaucaugaagaauaccacuaacacgcgccgggggacaggaaauauuggcgagacccuuggugaaaaauggaagaguagacugaacgccuugggcaagucggaguuucaaaucuacaaaaagagcgggauacaggaggucgaucguacucuggcaaaagaaggaaucaagaggggcgagaccgaccaccaugcugugucccgggggucugccaaacuccgcugguucguugaacgaaacauggugacaccagagggaaagguaguggaucugggcugcgguagagggggauggucauauuacuguggcggucuuaaaaaugucagggaaguuaagggccuaacuaaagggggaccuggccacgaggagcccauuccuaugagcaccuauggguggaaccuggugcggcuccaguccggagucgacguguucuuuacaccacccgaaaaaugcgauacgcuacugugugacaucggcgagaguucuccuaauccaaccauugaagccggucgcacuuugagaguacugaaccucguggagaauuggcuuaacaauaacacacaauucugcaucaagguucugaaucccuacaugccgagcgugauagagaaaauggagaccuugcagaggaaguacgggggagcgcugguccgaaacccucucucaagaaauuccacucaugagauguauugggugaguaacgcuacaggcaauauugucagcucugugaacaugaucucccguauguuaaucaauagauuuaccaugaaacacaagaaggcaacguacgaaccagauguugaccugggcucagggacccgcaacauuggaauagagaacgaaauccccaaucuugacauuaucgguaaaaggauugagaagaucaaacaggaacacgagacaagcuggcauuaugaucaggaccacccuuacaagacuugggccuaucauggcucguacgagaccaaacaaacagggucugcuaguuccaugguaaacggagugguccggcugcuaacuaagccaugggaugugguucccauggugacccagauggccaugacagacaccacuccguucggccagcagagagucuuuaaggaaaaaguggauacgcgcacacaagagccuaaggaagguaccaaaaagcucaugaggauaacugcagaguggcuguggaaagaguuggggaagaagaaaaccccacgaauguguacacgggaagaguucacgagaaagguaaggagcaaugccgcucugggagcgaucuuuaccgacgaaaacaaauggaagucagcccgcgaggcaguggaagauucccguuucugggagcucguugaccgggagagaaaucuucaccuggaaggcaaaugcgagacuugugucuauaacaugaugggcaagagggagaaaaaguuaggggaguuuggaaaggcuaaagguucucgcgccauuugguacauguggcugggcgcacgauucuuggaauuugaggcccucggguuccugaaugaggaucacugguuuagccggggaaacagucuauccggcguggaaggugaggggcuucauaagcugggauacauccucagagacgugagcaaaaaggaaggcggcgcuauguaugccgaugacacagcggggugggacaccaggauuacucuggaggauuugaaaaaugaagagauggucacaaaccacaugaagggagagcauaagaaacuggcagaagccaucuucaagcucaccuaccagaauaaaguugugcgcguacagagaccaacaccucgggguacugugauggacauuauaucuaggaaggaucagcguggcucagggcaagucggaaccuauggccuuaacacguucaccaauauggaggcucagcugauccgacagauggaaggugaggggauuuuuaaaaguauccaacacuuaacagugacugaggaaaucgccguucgcaacuggcuggcaagagugggacgggagagguugucccgcauggcuauuagcggcgacgauugcgucgugaagccccucgacgauagauucgccucugcucugaccgcccuaaaugacaugggcaagguacggaaagauauacagcagugggaaccaucgaggggguggaacgacuggacacagguucccuuuugcucacaucacuuccacgagcuugugaugaaggauggacgaguccugguggugccuugucguaaccaagacgaacucaucgguagagcacgcauuagccagggcgcgggguggucccugaaagagacugccugcuugggaaagaguuacgcucagauguggaccuuaauguauuuucaucggagggaucugagacucgccgcaaaugcuaucuguucugccgucccaagccacuggguuccgacgucccgcacaaccuggucaauucaugcaaaacacgaguggaugacuacagaagacaugcuugccguguggaaccggguauggauccaggagaaucccuggauggaagacaagaccccuguggagaguugggaagaggucccauaccugggcaagagggaggaucaauggugcgguucucuaauagggcugacuagccgagcgaccugggcuaaaaacauccagacagccauuaaucaggugagaucccucaucggaaacgaagaguauacggacuacaugcccucaaugaagcgguucaggaaagaagaggaagaggcaggcguuuugugguga

SEQ ID NO: 14672 - RNA, 9876 nt, Artificial Sequence
  derived and/or modified CDS sequence (opt3) from DENV-2__EU596487__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauuccaaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcucuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacacacacugaccauacuaauccgcacuggccugcuuguaauuagugguguguucccagucagcauccccauuacagcagccgcuugguaccucugggagguuaagaagcaacgggcaggggugcugugggaugugccuucuccacccccugucggaaaagccgaauuggaggacggcgcguauagaaucaagcagaggggcauauuuggguacucccagauuggagcugguguguauaaagaaggcaccuuccauacuauguggcacguuacacguggggccguauuaaugcaucgcggaaagcggaucgagccgucaugggcagaugugaaaaaggaccugaucaguuacggcgguggguggaagcucgagggagaauggaaagagggcgaagagguccaggugcuggcccuugaaccaggcaagaaucccagagcuguucaaaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccacccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcauaccggucgggaaaucguugaccugaugugucacgcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccagucaaacgcuccaaucauggacgaggaacgggagauucccgaaaggucuuggaauagcggucaugaguggguaacugauuuuaaggggaagaccgugugguucguuccuaguauaaaagcgggaaacgacaucgccgcaugccugcgcaagaauggcaaaaaggucauucaauugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcacucauccgcugcccagcggaggggucgcaucggcagaaacccaaaaaaugaaaacgaccaguauauuuacaugggggagccccucgaaaaugaugaggacugcgcgcauuggaaggaggcaaaaauguuacuggauaacaucaauacuccugaaggaauuauccccaguauguucgagccagaaagggagaaggucgacgccauagauggcgaauaccggcuucguggugaggcucgcaaaacauuuguggaccugaugcgaagaggggaucucccuguuugguuggccuauaggguggcugcagagggcauuaacuacgccgaccggcgcugguguuucgauggaaucaagaauaaccaaauucuggaagagaacgucgaaguggagaucuggaccaaagagggcgaaagaaagaagcucaaacccagguggcuggacgcucggauauauagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucacacagcagaaguggguggcagggcuuacaaucacgcccugucugagcucccggagacuuuggaaacgcugcuacugcucacccuucuggcaacaguuacugggggaauuuuuuuauucuugauguccggcaaggguaucgggaagaugacccugggcaugugcugcauuaucacagccagcauacuccugugguaugcucagauucagccccauuggaucgcggccucaaucauucuugaguuuuuccugaucguccucuugauaccagaaccugagaaacaacggaccccccaggacaaccagcugacuuacguggugauugcaaucuuaacggucguugcugccaccauggccaaugaaaugggauuucuagagaagacaaaaaaggaccugggccucgggaguauuacuacccaggagucugaauccaacauccuugauauagaccugcguccagcaagcgcuuggacauuguaugccguggcgaccacuuucguaacaccuaugcugagacacucaaucgagaauaguagcgugaacgucucccucacggcuauugccaaucaagcaaccgugcugaugggacuugguaggggcuggccccucucuaaaauggauaucgggguuccgcuguuggccauuggauguuacagccaggugaacccaaucacucugacagcugcauuacuacugcucgucgcccauuacgcgauuaucggcccuggucuucaggcuaaggccacccgcgaagcacagaagcgggccgcugccgggauaaugaaaaaucccaccguagacggcauuacagugaucgaucuggagccaauccccuaugacccuaaguuugaaaaacaauugggacagguuaugcugcucgugcugugcgucacucaggugcuuaugaugcgaacgaccugggcauuaugugaggcucugacacucgccacuggcccgauuuccaccuugugggaggggaaccccggaagauucuggaauacaaccauagcggucucaauggccaacaucuuuaggggcucuuaccuggcaggugcugggcuacuguucaguauuaugaagaauacuacgaacacacgccggggaaccggcaauaucggugaaacucucggcgagaaauggaagucgagacuuaacgcccuggggaagagcgaauuucagauuuauaaaaaguccggaauccaagagguggaucguaccuuggcaaaagagggcauaaagaggggggaaacagaccaccaugcuguuucucggggaucagccaaacugcgcugguucguggagcgaaacaugguaacuccagaaggcaagguggucgaucucgguugcgggagaggaggcuggagcuacuauugugguggccugaaaaauguuagggaggugaagggguuaaccaagggaggcccugggcacgaagagcccaucccuauguccacauacggauggaaccuuguccggcugcagaguggcguggacguauucuuuacgccacccgagaaaugcgauacccuccuaugugacauuggugaaucuagcccuaauccaacuaucgaggccgggcgcacacugagaguguugaaccugguugaaaauuggcucaacaauaacacccaguucugcauuaaggugcuuaaucccuauaugccgucagucaucgagaaaauggaaacucugcaaaggaaguacggaggcgcguuggugcgaaacccucugucccggaauaguacacacgagauguacugggucagcaacgcuaccggcaauauagugucuuccguuaacaugauuucacguaugcucaucaauagauuuacgaugaaacauaagaaggcaaccuaugagccagauguagacuuagggagcggaacacgcaacaucgguauugaaaacgagauacccaaucuggacaucauuggcaaaaggaucgaaaagauuaaacaggagcacgaaacuucguggcauuacgaucaggaccacccuuauaagaccugggccuaccacgggucuuaugagacaaaacagacuggaagugcuuccagcauggugaacggcgucgugaagcuucugaccaagccaugggauguugugcccauggucacacaaauggccaugaccgacacuacgccguucggucagcagcggguguuuaaagagaagguagauacaagaacccaggaaccuaaagaggggacuaagaaacuaaugcgcaucaccgcagaauggcucuggaaggagcugggaaagaaaaagacacccaggauguguacgcgagaggaauucacccggaaagugagaucaaaugccgcuuugggcgcgauauuuacugacgagaacaaguggaaauccgccagggaagcaguugaggauucucgcuucugggaacuggucgaccgugagcggaaucuccaucuugagggcaagugcgaaacauguguguacaacaugauggggaaaagagagaagaagcugggagaauuugguaaagcuaagggcagcagggccaucugguauaugugguuaggggcacgcuuccuggaguuugaagccuugggauuccucaaugaggaucacugguuuagucgaggcaacucccugagcgguguggagggggaaggacuacauaaacuuggcuacauucugcgggacgucucuaagaaagagggcggggcuauguacgccgaugacaccgcgggaugggacacuagaaucacacucgaagaucugaagaaugaggaaaugguuaccaaccacaugaagggugagcauaaaaaguuggcagaggccauuuucaaacugacauaucaaaauaaggugguaagggugcagcgcccaacuccuagaggcaccgucauggacaucauuucacggaaagaucagagggggaguggacaggugggcacguacggucucaacaccuucacaaauauggaagcucaacuuauacgucagauggagggggaaggaaucuuuaaguccauucagcgacugacuguuaccgaggagaucgccgugcaaaacugguuagcacgcgucggcagagaacggcugagcaggauggcuaucucuggcgacgauugcgugguaaagcccuuggacgaucgcuucgccucggcucucacagcccugaaugacauggggaaaguuagaaaggauauucagcagugggagccaucacggggauggaacgacuggacucaggugcccuuuugcagccaccacuuccaugaacuagucaugaaagaugguagggugcuuguggucccuugucgaaaccaagacgagcugauaggccgugcaagaaucucccagggggcgggauggagucucaaggaaaccgccugccugggcaaaucuuaugcucagauguggacguugauguacuuucaccgccgggauuuaaggcuggccgcaaaugcuauuuguagcgccguuccaucccauugggugccgacaucaagaaccacuuggaguauccacgcaaagcacgaguggaugacaaccgaggacaugcucgccguauggaaccgcguguggauucaggaaaaucccuggauggaggacaagacuccugucgaaucuugggaggaagugccauaucuugguaaacgggaggaucaauggugcgggagccugaucggacuaaccuccagggcgacaugggcuaagaacauacagacggccaucaaucagguucgaucacugauuggcaacgaggaauacaccgacuauaugcccagcaugaaaagauuccggaaggaggaagaggaagcaggcgugcucugguga

SEQ ID NO: 14673 - RNA, 9876 nt, Artificial Sequence
  derived and/or modified CDS sequence (opt3) from DENV-2__EU569713__SS-prME
accgccggcgugaucauuaugcugauacccaccgcuauggcauuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggauuauucggcaagggcgggauuguaacaugcgccauguuuacaugcaaaaagaauauggaaggaaaaguggugcucccugagaaccuggaauacaccauagucaucacuccacacagcggugaggagcaugcuguuggcuccgacacggggaagcacggaaaagaaauuaagaucacaccgcagucaaguauaaccgaggccgaacuuacuggcuaugguaccgugacaauggaguguagccccaggaccgggcuggauuucaaugaaaugguauugcuccagauggaggacaaagcauggcuggugcaccggcaaugguuuuuagaucugccucucccauggcuucccggcgcugacacucagggaucuaacuggauucagaaggagacacuggucacguucaagaauccucaugccaaaaagcaggacgugguuguguugggcucccaagaaggggcgaugcacaccgcccugacuggagcaacagagauccagaugucaagcgguaaccugcucuuuaccggccaucugaaaugccgucuucgcauggauaagcugcaguugaaagggaugaguuacucuauguguacaggaaaguucaagaucgucaaagaaauugcugagacucaacacggcaccaucgugauuagaguacaguaugagggugacggguccccaugcaagauacccuucgaaaucauggaucucgagaaaagguacguucugggccgguuaauuacggugaauccgaucgucaccgaaaaggacagcccugugaacaucgaggccgaacccccauuuggagauucguacauuauaaucggcgucgagccugggcagcugaaacuaaacugguucaagaagggaucuuccauuggucagauguuugagacaacuaugcgaggcgcuaaacgcauggccauccucggggacaccgcaugggauuucggaucacugggcgguguguuuacaaguauugggaaggcccuucaucaaguuuucggcgcuaucuauggagcggcauuuagcggcguguccuggacuaugaaaauauugaucgggguaauuaucaccuggauuggaaugaacucuagaagcacgucacugagugucucccucgugcugguuggcguggucacacuuuaccugggugugaugguacaggccgacagcgggugugugguuucuuggaagaacaaagaauugaagugcggaucaggcaucuucauaaccgauaauguccacacuuggacagagcaguauaaguuucagcccgaaaguccaagcaaacucgcuuccgccauucaaaaggcacacgaggaagguaucuguggcauuaggucugugacccggcuggagaacuuaauguggaaacagaucacucccgagcugaaucauauacuaucggaaaacgaggccaagcucaccaucaugacaggggacauuaaaggaaucaugcaggcuggcaagcgcagccugagaccucagccaacggaacuuaaauacuccuggaagaccugggggaaggccaaaauguugucaacugagagucacaaucaaacauuccugauugauggaccggaaaccgcagagugccccaacacaaauagggcguggaacucucucgagguggaagacuauggcuuuggugucuucagcacuaauaucuggcugaaguuacgugagaaacaggacguauuuugugauuccaagcugaugucagcugccauaaaagacaaccgggcagugcaugccgauaugggguacuggauugaaagcgcucuuaaugacaccuggaagauggagaaggccucuuucaucgaggugaaauccugccacuggccuaagagucacacguuguggagcaacggaguacucgaaucugagaugaucauucccaaaaauuucgcaggccccgucucccagcauaacuaucgaccugguuaccacacacagaccgcuggcccauggcaucuggggaagcuagaaauggauuuugacuucugugagggaacuaccgugguugugacagaagauugcggcaacagagggcccucacugaggacuaccacagccaguggaaaacucaucacggaguggugcugucgcagcugcacccugccgccucuucgguacagaggcgaggacgguuguugguaugggauggaaauuaggccauugaaggagaaggaagagaaucuggucaacucguuagugacugcgggacacggccaaauagauaauuuuucccucgguguucugggcauggcccuuuuccuggaagagauguugcgcacacgaguggggaccaaacaugcuauccuccugguagcagucucuuuugugacucuaauuacaggaaacaugagcuuccgggaccugggccgugugauggucaugguuggggccaccaugacggaugacaucggaaugggcgugacuuaccucgcucugcuugccgcauuuaagguaagacccaccuucgcggccgguuugcuguuaaggaaacucacaucaaaggagcugaugauggcuaccauugggaucgcccuucugagucaguccacuauaccugaaacaauccuagagcucaccgaugcacuggcuuugggaaugauggugcugaaaauuguccgcaauauggaaaaguaucaguuagccgugacaaucauggcaauucucugcguucccaacgccgugauccugcaaaaugcuuggaaggucucuuguacuauacuugcggccgugagcguuuccccacuguugcucaccucaagccagcagaaagcagacuggauuccucuggcucuaacgaucaagggccugaaccccacagccaucuuucuuaccacucucagucggaccucuaaaaagagauccuggccacugaaugaggccgugauggcugucggcaugguaagcauuuuggcaucgucacugcucaaaaaugacauaccgaugacagggccucuaguggccggaggucugcuuacuguuugcuacgugcugaccggcaggucugcggauuuggaacucgagcgagcugccgacgucaagugggaggaucaggcagaaaucaguggguccagccccauucugucuaucacgauuagcgaggacggauccaugucaaucaaaaaugaagaggaggaacaaacacuaaccauacugauccgcacuggccuucucgugauuagugguguauucccagugagcauccccauuacagccgcugcaugguaucugugggaggucaagaagcagcgggccgggguuuugugggaugugccuucuccacccccugugggaaaagcggaauuagaggacggcgcuuacagaaucaagcagaggggcauauuuggguauucccagauuggagccggugucuacaaagaaggcaccuuccacacuauguggcacgugacacguggggcaguucugaugcaucgcggaaagcggaucgagccgucaugggccgaugucaaaaaggaccucaucaguuacggcgguggguggaagcuggagggagaauggaaagagggcgaagaggugcaaguccuugcucuggaaccaggcaagaaccccagagccgugcagaccaaaccuggguuguuuaagacgaauacuggaaccauuggugcaguuagccuagauuucuccccaggcacaucugggucgcccaucguggacaggaaaggaaaggucgugggccuguaugguaacgggguagucacccgaagcggagcuuacgugucagccauagcgcagacagagaaguccauugaggauaauccugaaaucgaggacgauauuuuccggaaaaagcgccucacuaucauggaccugcacccgggcgccggcaaaaccaagagauaucuucccgcaauaguuagggaagcuauuaaacggggguuacgaacgcugauccucgccccaacaagaguggucgcugcagagauggaagaggccuugcgcggacugccuaucagguaccagacucccgccauucgugcugagcauaccggucgggaaaucguggaccucaugugucacgcgacauuuaccaugagacugcuuaguccaguuagggugccuaacuauaaccugauuauaauggaugaggcacauuucacugaccccgccucuaucgcugcccgcggcuacauuagcacccgagucgaaaugggggaggcagccggaaucuuuaugacagcuacgccaccgggcuccagagauccuuucccccaaucaaaugcgccaaucauggacgaggaacgggagauucccgaaaggucuuggaacagcggucacgagugggugacugauuuuaaggggaagaccguaugguucgugccuaguauaaaagccggaaaugacaucgcagcuugcuugcgcaagaacggcaaaaagguuauucagcuaucccguaaaacauuugauagcgaauaugucaagaccagagccaaugacugggauuucguggugacuacagacaucucugagaugggcgcaaacuuucgggccgagagggucauugauccacgccgauguaugaagcccguaauccugaccgacggggaagagagagugauacucgcuggaccuaugccgguuacgcacucauccgccgcgcagcggaggggucgcaucggcagaaaucccaaaaacgaaaaugaccaauacauuuacaugggggagcccuuagaaaacgaugaggacugcgcacauuggaaggaggccaaaaugcugcuugauaauaucaacacuccugaaggaauuauccccaguauguucgagccagaaagggagaagguggacgcuauagauggcgaauaucggcugcguggugaggcccgcaaaacauuugucgaccucaugcgaagaggggauuugccuguguggcuggcuuacaggguugcagccgagggcauuaauuaugcugaccggcgcugguguuucgauggaaucaagaacaaucagauucucgaagagaacguggaagucgagaucuggaccaaagagggcgaaagaaagaagcugaaacccagguggcuugacgcccggauauacagcgauccacuagcacugaaggaguucaaagaauuugcggccgggcgaaagucguugaccuuaaaccugaucacugagaugggaagacucccuacauucaugacccagaaagcucgcgacgcccuggauaaucuugcagugcugcacacagcugaaguagguggcagggccuauaaccaugcacucucugaguugccggagacucuggaaacgcuacugcuccuuacccuguuagccacagugacugggggaauauuuuuguuccugauguccggcaaggguaucgggaagaugacccucggcaugugcugcauuaucacagcuagcauacugcuuugguacgcgcagauucaaccccacuggaucgccgcaucaaucauucuggaguuuuuccucaucguuuugcugauaccagaaccugagaaacagcggaccccacaggacaaucaguuaacuuaugucgugauugcuauccuaacgguggucgccgccaccauggcaaacgaaaugggauuucuggagaagaccaaaaaggaccucggccuugggaguauuaucacucaagagucugaauccaauauacuggauaucgacuugcguccagcuagcgccuggacccuguacgcgguugcuacaaccuucgugacuccuaugcucagacacucaauugagaacaguagcguaaaugugucccugacagccaucgcaaaccaggccacgguccuuaugggacucgguaggggcuggccccugucuaaaauggauauuggggugccguugcuggcuaucggauguuacagccagguuaauccaauuaccuuaacugcagcccuacugcuccuuguggcgcauuaugcuaucauaggcccuggucugcaggccaaggcaacacgcgaagcccaaaagcgggcugccgcagggauuaugaaaaaccccaccgucgacggcaucaccguaaucgauuuggagccaauucccuacgacccuaaguuugaaaaacagcugggacaggugaugcuccugguucuuugcgugacacaggucuuaaugaugcgaacuacgugggcucugugugaggcccucaccuuggcgacaggcccgauauccacucugugggaggggaaucccggaagauucuggaacaccacaaucgccgugucaauggcaaauauuuuuaggggcucuuaucuagcuggugccgggcuacucuucaguaucaugaagaacaccacuaauacgcgccggggaacaggcaacauuggugaaacccuuggcgagaaauggaagucgagacugaaugcauugggaaagagcgaauuucaaaucuacaaaaaguccggaauacaggaggucgaucguacucuggcuaaagagggcaucaagagaggggaaaccgaccaccaugccgugucucggggaucagccaaacuccgcugguucguugagcgaaacauggugacaccagaaggcaagguaguggaucuggguugcgggagaggaggcuggagcuauuacugugguggccuuaaaaacgucagggagguuaaggggcuaacuaagggaggcccugggcacgaggaaccaauuccuauguccaccuauggauggaaucuggugcggcuccagaguggcgucgacguguucuacacaccacccgagaaaugcgauacgcuacugugugacaucggugaaucuagcccuaacccaaccauugaggcggggcgcacuuugagaguacugaaucucguggaaaacuggcuuaauaacaauacacaauuuugcaucaagguucugaaccccuacaugccgucagugauagagaaaauggaaaccuugcagaggaaguauggaggcgcucugguccgaaauccucucucccggaacaguacucaugagauguacugggugagcaaugcaacaggcaacauugucucuuccgugaauaugaucucacguauguuaaucaacagauucaccaugaaacacaagaaggccacguaugagccagauguugaccuggggagcggaacccgcaauauugguauagaaaacgagauccccaaccuugacauuaucggcaaaaggauugaaaagaucaaacaggagcacgaaacaucguggcauuacgaucaggaccacccuuauaagacuugggcuuaccaugggucuuaugagaccaaacaaacaggaagugccuccagcaugguaaauggcgugguccggcugcuaacuaagccaugggaugugguucccauggugacccagauggcaaugacagacaccacuccguuuggucagcagagagucuucaaggagaaaguggauacgcgcacacaagaaccuaaggaggggaccaaaaagcucaugaggauaacugccgaauggcuguggaaagaguugggaaagaagaaaacaccccgaauguguacacgggaggaauuuacgagaaagguaaggucaaacgcugcgcugggcgccaucuucaccgacgagaauaaauggaaguccgcacgcgaagcuguggaggauucucguuuuugggaacucguugaccgggagagaaaccuucaccuggagggcaaaugcgaaacuugugucuacaauaugauggggaagagggagaaaaaguuaggagaguucgguaaggccaaaggcagccgcgcaauuugguacauguggcugggggcccgauuuuuggaguucgaagcucucggauuucugaacgaggaucacugguucagucggggcaauucccuaagcgguguggagggggaaggacuucauaagcugggcuauauccucagagacgugucuaaaaaggagggcggggccauguacgcggaugacacagcaggaugggacaccaggauuacucuggaagauuugaaaaacgaggaaauggucacaaaucacaugaagggugagcauaagaaacuggccgaggcuaucuuuaagcucaccuaucagaacaaaguugugcgcguacagagaccaacaccucggggcacugugauggacauuauaucaaggaaggaucagcgugggaguggacaagucggcaccuacggucuuaauacguucaccaacauggaagcccagcugauccgacagauggagggggaaggaauuuucaaauccauccaacacuuaacagugacugaggagaucgcaguucagaauuggcuggcucgcgugggcagagaacgguugagcaggauggccauuucuggcgacgauugcgucgugaagccccucgacgaucgcuuugcuucggcccugaccgcacuaaacgacauggggaagguaagaaaagauauacagcagugggagccaucacggggauggaaugacuggacacaaguucccuucugcagccaucacuuucacgaacuugugaugaaggaugguaggguccugguggugccuugucgaaaccaggacgagcucaucggccgugcgagaauuucccagggggccggauggagucugaaagaaacugcuugcuugggcaagucuuaugcccagauguggaccuuaauguacuuccaucgccgggaucugaggcucgcagcuaacgccaucuguagcgcagucccaucccacuggguuccgacgucaagaacaaccuggaguauucaugccaaacacgaguggaugacuacagaggacaugcuugcgguguggaaucgcguauggauccaagaaaaccccuggauggaggacaagaccccuguggaaucuugggaggaagucccauaucuggguaagcgggaggaucaguggugcgggagccuaauaggacugacuuccagggcuaccugggccaaaaauauccagacagcaauuaaccaggugcgaucacucaucggcaaugaggaauacacggacuacaugcccagcaugaagagauuucggaaagaggaagagaaggccggcguuuugugguga

SEQ ID NO: 14674 - RNA, 9876 nt, Artificial Sequence
  derived and/or modified CDS sequence (opt3) from DENV-2__EU569714__SS-prME
accgccggcgugaucauuaugcugauaccaacagcuauggcauuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauucccaagaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgucauccuccugguggccguguccuuugucacucuaauuacaggaaauaugucuuuccgggaccugggccguguuauggugaugguaggggcuaccaugacggaugacaucggaaugggcgugacuuaucucgcacugcuugccgcuuuuaaggucagacccaccuucgccgcagguuugcuguuaaggaaacucacaagcaaggagcugaugauggcgaccauugggaucgcccuucugucacagaguacuauaccugaaacaauccuagagcucaccgaugcucuggccuugggaaugauggugcugaaaauuguucgcaacauggaaaaguaccaguuagcagugacaaucauggcuauuuccugcguccccaaugccgugauccuccaaaacgcauggaagguuucuuguacuauacuggccguggucagcguauccccacuucuguugaccucaagccagcagaaagcugacuggauuccucucgcgcugacgaucaagggccuaaaucccacagccaucuuucugaccacucuuagucggaccucuaaaaagagauccuggccacucaacgaggcagugauggcuguuggcauggugagcauucuggccucgucauugcugaaaaaugacauaccgaugacagggccuuuagucgccggaggucuccugacugugugcuauguacuuaccggcaggucugcugaucuggaauuggagcgagcagccgacgugaagugggaggaucaggcggaaaucaguggguccagccccauucucucuaucacgauuagcgaggacggauccaugucaaucaaaaacgaagaggaggaacaaacacugaccauacuaauccgcacuggccugcuugucauuagugguguuuucccagugagcauccccauuacagcugccgcaugguaccucugggaggugaagaagcagcgggccgggguccugugggaugugccuucuccacccccuguuggaaaagcugaauuggaggacggcgcauauagaaucaagcagaggggcauauuuggguacucccagauuggagccgguguauauaaagaaggcaccuuccacacuauguggcaugugacacguggggcggucuuaaugcaccgcggaaagcggaucgagccgucaugggcugaugugaaaaaggaccugaucaguuacggcgguggguggaagcucgagggagaauggaaagagggcgaagagguucaagugcuggcccuugaaccaggcaagaaucccagagcaguccagaccaaaccugggcuguuuaagacgaacacuggaaccauuggugccgugagcuuggauuucuccccaggcacaucugggucgcccaucguagacaggaaaggaaaggucgugggccuauacgguaaugggguugugacccgaagcggagcuuaugucucagccauagcacagacagagaaguccauugaggauaacccugaaaucgaggacgauauuuuccggaaaaagcgccugacuaucauggaccuccauccgggcgcuggcaaaaccaagagauaccugcccgccauagugagggaagcgauuaaacgggggcuucgaacguuaauccuggccccaacaagaguuguggcagcugagauggaagaggcccuccgcggauugccuaucagguaucagacucccgcuauucgugcagagcacaccggucgggaaaucgucgaccugaugugucaugccacauuuaccaugagacuccugaguccagugaggguaccuaacuacaaucuuauuauaauggaugaggcccacuucacugaccccgcuucuaucgcggcacgcggcuauauuagcacccgaguggaaaugggggaggccgcuggaaucuuuaugacagccacgccaccgggcuccagagauccuuucccccaaucaaacgcaccaaucauggacgaggaacgggagauucccgaaaggucuuggaauagcggucacgaguggguuacugauuuuaaggggaagaccgucugguucgugccuaguauaaaagccggaaacgacaucgcugcgugccugcgcaagaauggcaaaaaggugauucaguugucccguaaaacauuugauagcgaauacgucaagaccagagccaacgacugggauuucguagugacuacagacaucucugagaugggcgcaaauuuucgggcugagaggguuauugauccacgccgauguaugaagcccgugauccuaaccgacggggaagagagagucauacuggccggaccuaugccggugacgcauucauccgcagcccagcggaggggucgcaucggcagaaaccccaaaaaugaaaacgaccaauauauuuacaugggggagccccucgaaaaugaugaggacugcgcucacuggaaggaggccaaaauguuacuggauaacaucaauacuccugaaggaauuauccccaguauguucgagccagaaagggagaagguugacgcgauagauggcgaauaccggcuucguggugaggcacgcaaaacauuuguggaccugaugcgaagaggggaucucccugucugguuggccuauaggguggcugccgagggcauuaacuacgcugaccggcgcugguguuucgauggaaucaagaauaaccagauucuggaagagaacguagaaguggagaucuggaccaaagagggcgaaagaaagaagcucaaacccagguggcuggacgcacggauauauagcgauccacuugcccuaaaggaguucaaagaauuugcugccgggcgaaagucgcugaccuugaauuuaaucacugagaugggaagacugccuacauucaugacccagaaagcacgcgacgcgcucgauaaccuggccguucuucauacagcugaagucgguggcagggccuacaaucacgcacugucugagcucccggagacuuuggaaacgcugcuacugcucacccuucuggcugccgugacagggggaauauuuuuauucuugauguccggcaaggguaucgggaagaugacucugggcaugugcugcauuaucaccgcaagcauacuccugugguaugcccagauucaaccccacuggaucgcugcgucaaucauucuugaguuuuuccugaucgugcucuugauaccagaaccugagaaacagcggacaccccaggacaaccagcugaccuacgucguuauugccaucuuaacugugguagcagcuacgauggccaaugaaaugggauuucuagagaagaccaaaaaggaccugggccucgggaguauuaucacacaagagucugaauccaacauacuugauaucgaccugcguccagccagcgcauggacuuuguaugcuguggccaccacauucgucaccccuaugcugagacauucaauugagaauaguagcgugaacguuucccucacugcgaucgcuaaucaggccacagugcugaugggacuugguaggggcuggccccucucuaaaauggauauuggggucccgcuguuggcaaucggauguuacagccagguaaacccaauuacgcugaccgccgcuuuacuacugcucguggcacacuacgccaucauaggcccuggucuucaggcgaaggcuacucgcgaagcccaaaagcgggcagccgcugggauuaugaaaaaucccacaguugacggcaucaccgugaucgaucuggagccaauucccuaugacccuaaguuugaaaaacaguugggacaggucaugcugcucgugcugugcgucacccaggugcuuaugaugcgaacaacuugggccuuaugugaggcacugacgcucgcuaccggcccgauauccacauugugggaggggaaccccggaagauucuggaauacuaccaucgccguuucaauggcgaacauuuuuaggggcucuuaccuggccggugcagggcuacuguucaguaucaugaagaauacaaccaacacucgccggggaacgggcaauauuggugaaacacucggcgagaaauggaagucgagacuuaacgcucugggaaagagcgaauuucaaaucuauaaaaaguccggaauacaggagguggaucguaccuuggccaaagagggcaucaagagaggggaaacugaccaucacgcaguaucucggggaucagcuaaacugcgcugguucguggagcgaaacauggucaccccagaaggcaagguuguggaucucgguugcgggagaggaggcuggagcuacuauugugguggccugaaaaaugucagggaggugaagggguuaacaaagggaggcccugggcaugaagaaccaauuccuauguccacuuacggauggaaccuuguacggcugcagaguggcguggacguuuucuuuaccccacccgagaaaugcgauacacuccuaugugacaucggugaaucuagcccuaauccaacgauugaggccgggcgcacccugagaguguugaaccuggucgaaaauuggcucaacaauaacacucaauucugcaucaaggugcuuaaucccuauaugccgucagucauagagaaaauggaaacacugcagaggaaguacggaggcgccuuggugcgaaacccucugucccggaauaguacccacgagauguacuggguuagcaacgcgacuggcaauauuguaucuuccgugaacaugaucucacguaugcucaucaauagauuuacaaugaaacacaagaaggcuaccuaugagccagaugucgacuuagggagcggaacgcgcaacauugguauagaaaacgagauccccaaucuggacauuaucggcaaaaggauugaaaagaucaaacaggagcaugaaaccucguggcacuacgaucaggaccauccuuauaagacaugggcauaccacgggucuuaugagacuaaacaaaccggaagugccuccagcauggugaacggcguugugcggcuucugacaaagccaugggaugucgugcccaugguaacucagauggcuaugaccgacacaaccccguucggucagcagagaguguuuaaggagaaaguugauacucgcacgcaagaaccuaaggaggggaccaaaaagcuaaugaggauaacagccgaauggcucuggaaagagcugggaaagaagaaaacuccccgaauguguacccgggaggaguucacaagaaaggucaggucaaaugcagccuugggcgcuaucuuuacggacgagaacaaauggaaguccgcgcgcgaagccguggaggauucucguuucugggaacugguggaccgggagagaaaucuccaccuugagggcaaaugcgaaaccugugucuacaacaugauggggaagagggagaaaaagcugggagaauuugguaaggcaaaaggcagccgcgcuauuugguauaugugguuaggggcccgauuccuggaguuugaagcauugggauuccucaaugaggaucauugguuuagucggggcaacucccugagcgguguugagggggaaggacuacacaaacuuggcuacauccugagagacgugucuaaaaaggagggcggggccauguacgcugaugacacugccggaugggacacaaggauuacccucgaagaucugaaaaaugaggaaaugguaacuaaccauaugaagggugagcacaagaaauuggcggaggcaaucuucaagcugacauaucagaauaaagugguccgcgugcagagaccaaccccucggggcacaguuauggacauuauaucaaggaaggaucagcgugggaguggacaagugggcacuuacggucucaacaccuucacgaauauggaagcccagcuuauccgacagauggagggggaaggaauuuuuaaauccauccaacaucugaccgucacagaggagaucgcugugcagaacugguuagcccgcguaggcagagaacggcugagcaggauggcaauuucuggcgacgauugcguugugaagcccuuggacgaucgcuucgcuucggcccucacugcucugaaugacauggggaaggucagaaaagauauacagcagugggagccaucacggggauggaacgacuggacccaagugcccuuuugcagccaccacuuccaugagcuagugaugaaggaugguaggguccuuguugugccuugucgaaaccaggacgagcugaucggccgugccagaauuucccagggggcaggauggagucucaaagaaacagcgugccugggcaagucuuaugcccagauguggacuuugauguacuuucaccgccgggauuuaaggcuggcugccaaugcaaucuguagcgcuguaccaucccauugggugccgaccucaagaacgacauggaguauucacgccaaacacgaguggaugaccacugaggacaugcucgcagucuggaaccgcguguggauccaagaaaaucccuggauggaggacaagacaccuguugaaucuugggaggaagugccauaucuugguaagcgggaggaucaguggugcgggagccugauaggacuaaccuccagggccacuugggcgaaaaacauccagaccgcuauuaaucagguccgaucacugaucggcaacgaggaauacacagacuauaugcccagcaugaagagauuccggaaagaggaagaggaagccggcgugcucugguga

SEQ ID NO: 14675 - RNA, 9876 nt, Artificial Sequence
  derived and/or modified CDS sequence (opt3) from DENV-2__EU569715__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauuccaaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcucuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacacacacugaccauacuaauccgcacuggccugcuuguaauuagugguguguucccagucagcauccccauuacagcagccgcuugguaccucugggagguuaagaagcaacgggcaggggugcugugggaugugccuucuccacccccugucggaaaagccgaauuggaggacggcgcguauagaaucaagcagaggggcauauuuggguacucccagauuggagcugguguguauaaagaaggcaccuuccauacuauguggcacguuacacguggggccguauuaaugcaucgcggaaagcggaucgagccgucaugggcagaugugaaaaaggaccugaucaguuacggcgguggguggaagcucgagggagaauggaaagagggcgaagagguccaggugcuggcccuugaaccaggcaagaaucccagagcuguucaaaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccacccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcauaccggucgggaaaucguugaccugaugugucacgcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccagucaaacgcuccaaucauggacgaggaacgggagauucccgaaaggucuuggaauagcggucaugaguggguaacugauuuuaaggggaagaccgugugguucguuccuaguauaaaagcgggaaacgacaucgccgcaugccugcgcaagaauggcaaaaaggucauucaauugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcacucauccgcugcccagcggaggggucgcaucggcagaaacccaaaaaaugaaaacgaccaguauauuuacaugggggagccccucgaaaaugaugaggacugcgcgcauuggaaggaggcaaaaauguuacuggauaacaucaauacuccugaaggaauuauccccaguauguucgagccagaaagggagaaggucgacgccauagauggcgaauaccggcuucguggugaggcucgcaaaacauuuguggaccugaugcgaagaggggaucucccuguuugguuggccuauaggguggcugcagagggcauuaacuacgccgaccggcgcugguguuucgauggaaucaagaauaaccaaauucuggaagagaacgucgaaguggagaucuggaccaaagagggcgaaagaaagaagcucaaacccagguggcuggacgcucggauauauagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucacacagcagaaguggguggcagggcuuacaaucacgcccugucugagcucccggagacuuuggaaacgcugcuacugcucacccuucuggcaacaguuacugggggaauuuuuuuauucuugauguccggcaaggguaucgggaagaugacccugggcaugugcugcauuaucacagccagcauacuccugugguaugcucagauucagccccauuggaucgcggccucaaucauucuugaguuuuuccugaucguccucuugauaccagaaccugagaaacaacggaccccccaggacaaccagcugacuuacguggugauugcaaucuuaacggucguugcugccaccauggccaaugaaaugggauuucuagagaagacaaaaaaggaccugggccucgggaguauuacuacccaggagucugaauccaacauccuugauauagaccugcguccagcaagcgcuuggacauuguaugccguggcgaccacuuucguaacaccuaugcugagacacucaaucgagaauaguagcgugaacgucucccucacggcuauugccaaucaagcaaccgugcugaugggacuugguaggggcuggccccucucuaaaauggauaucgggguuccgcuguuggccauuggauguuacagccaggugaacccaaucacucugacagcugcauuacuacugcucgucgcccauuacgcgauuaucggcccuggucuucaggcuaaggccacccgcgaagcacagaagcgggccgcugccgggauaaugaaaaaucccaccguagacggcauuacagugaucgaucuggagccaauccccuaugacccuaaguuugaaaaacaauugggacagguuaugcugcucgugcugugcgucacucaggugcuuaugaugcgaacgaccugggcauuaugugaggcucugacacucgccacuggcccgauuuccaccuugugggaggggaaccccggaagauucuggaauacaaccauagcggucucaauggccaacaucuuuaggggcucuuaccuggcaggugcugggcuacuguucaguauuaugaagaauacuacgaacacacgccggggaaccggcaauaucggugaaacucucggcgagaaauggaagucgagacuuaacgcccuggggaagagcgaauuucagauuuauaaaaaguccggaauccaagagguggaucguaccuuggcaaaagagggcauaaagaggggggaaacagaccaccaugcuguuucucggggaucagccaaacugcgcugguucguggagcgaaacaugguaacuccagaaggcaagguggucgaucucgguugcgggagaggaggcuggagcuacuauugugguggccugaaaaauguuagggaggugaagggguuaaccaagggaggcccugggcacgaagagcccaucccuauguccacauacggauggaaccuuguccggcugcagaguggcguggacguauucuuuacgccacccgagaaaugcgauacccuccuaugugacauuggugaaucuagcccuaauccaacuaucgaggccgggcgcacacugagaguguugaaccugguugaaaauuggcucaacaauaacacccaguucugcauuaaggugcuuaaucccuauaugccgucagucaucgagaaaauggaaacucugcaaaggaaguacggaggcgcguuggugcgaaacccucugucccggaauaguacacacgagauguacugggucagcaacgcuaccggcaauauagugucuuccguuaacaugauuucacguaugcucaucaauagauuuacgaugaaacauaagaaggcaaccuaugagccagauguagacuuagggagcggaacacgcaacaucgguauugaaaacgagauacccaaucuggacaucauuggcaaaaggaucgaaaagauuaaacaggagcacgaaacuucguggcauuacgaucaggaccacccuuauaagaccugggccuaccacgggucuuaugagacaaaacagacuggaagugcuuccagcauggugaacggcgucgugaagcuucugaccaagccaugggauguugugcccauggucacacaaauggccaugaccgacacuacgccguucggucagcagcggguguuuaaagagaagguagauacaagaacccaggaaccuaaagaggggacuaagaaacuaaugcgcaucaccgcagaauggcucuggaaggagcugggaaagaaaaagacacccaggauguguacgcgagaggaauucacccggaaagugagaucaaaugccgcuuugggcgcgauauuuacugacgagaacaaguggaaauccgccagggaagcaguugaggauucucgcuucugggaacuggucgaccgugagcggaaucuccaucuugagggcaagugcgaaacauguguguacaacaugauggggaaaagagagaagaagcugggagaauuugguaaagcuaagggcagcagggccaucugguauaugugguuaggggcacgcuuccuggaguuugaagccuugggauuccucaaugaggaucacugguuuagucgaggcaacucccugagcgguguggagggggaaggacuacauaaacuuggcuacauucugcgggacgucucuaagaaagagggcggggcuauguacgccgaugacaccgcgggaugggacacuagaaucacacucgaagaucugaagaaugaggaaaugguuaccaaccacaugaagggugagcauaaaaaguuggcagaggccauuuucaaacugacauaucaaaauaaggugguaagggugcagcgcccaacuccuggcgggaccgucauggacaucauuucaagaaaagaucagcggggaaguggccagguggguacguacgggcucaacaccuucacaaauauggaagcucaacuuauaaggcagauggagggagaaggcaucuuuaaguccauucagcgucugacuguuaccgaggagaucgccgugcaaaacugguuagcacgagucggccgcgaaagacugagccggauggcuaucucuggggacgauugcgugguaaagcccuuggacgauagguucgccucggcucucacagcccugaaugacaugggaaaaguucgcaaggauauucagcagugggagccaucaagagguuggaacgacuggacucaggugcccuuuugcagccaccacuuccaugaacuagucaugaaagauggccgggugcuuguggucccuuguaggaaccaagacgagcugauagggcgagcacguaucucccagggagcgggcuggagucucaaggaaaccgccugccuggguaaaucuuaugcucagauguggacguugauguacuuucacagacgcgauuuacggcuggccgcaaaugcuauuuguagcgccguuccaucccauugggugccgacaucaaggaccacuuggaguauccacgcaaagcacgaguggaugacaaccgaggacaugcucgccguauggaacagaguguggauucaggaaaaucccuggauggaggacaagacuccugucgaaucuugggaggaagugccauaucuugggaaacgcgaggaucaauggugcggaagccugaucggccuaaccucccgggcgacaugggcuaagaacauacagacggccaucaaucagguuaggucacugauuggcaacgaggaauacaccgacuauaugcccagcaugaaacgauucagaaaggaggaagaggaagcaggggugcucugguga

SEQ ID NO: 14676 - RNA, 9876 nt, Artificial Sequence
  derived and/or modified CDS sequence (opt3) from DENV-2__EU569716__SS-prME
accgccggcgugauaauuaugcugauaccaacugcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagacccggacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggauuauucggcaagggcgggauuguaaccugcgccauguuuauaugcaaaaagaauauggaaggaaaaguggugcucccugagaaccuggaauacacaaucgucauuaccccacacagcggugaggagcaugcuguuggcaaugacacugggaagcacggaaaagaaaucaagauaacgccgcaguccucaauuacagaggccgaacuuaccggcuaugguacugugaccauggaguguagucccaggacagggcuggauuucaacgaaaugguauugcuccagauggaggacaaagcauggcuggugcaccggcaaugguuuuuagaucugccucucccauggcuucccggcgcugacacccagggaagcaauuggauccagaaggagacucuggucacauucaagaacccucaugccaaaaagcaggacgugguuguguugggcucucaagaaggggcgaugcacacggcccugaccggagcaacugagauccagauguccucagguaaucugcucuuuacaggccaucugaaaugccgucuucgcauggauaagcugcaguugaaagggaugagcuacaguauguguaccggaaaguucaagauugucaaagaaaucgcugagacacaacacggcacuauugugauaagaguacaguaugagggugacgggucuccaugcaagauccccuucgaaauuauggaucucgagaaaagguacguucugggccgguuaaucaccgugaacccgaucgucacggaaaaggacuccccugugaacauugaggccgaacccccauuuggagauagcuacauaaucauuggcgucgagccugggcagcugaaacuaaauugguucaagaagggaucgucuaucggucagauguuugagaccacaaugcgaggcgcuaaacgcauggccauucucggggacacugcaugggauuucggaucccugggcgguguguuuaccucaaucgggaaggcccuucaucaaguuuucggcgcuauauauggagcggcauuuaguggcgugagcuggacaaugaaaaucuugauugggguaaucauuacuuggaucggaaugaacuccagaucuaccagccugucagucagucucgugcugguuggcguggucacgcuuuaccugggugugaugguacaggccgacuccgggugugugguuagcuggaagaauaaagaauugaagugcggaucuggcauauucauuacagauaacguccacaccuggacugagcaguauaaguuucagcccgaaucaccaaguaaacucgcuagcgccauccaaaaggcacacgaggaagguauuuguggcaucagguccgugacacggcuggagaauuuaauguggaaacagauaacccccgagcugaaccauauccuaucugaaaaugaggugaagcucacuauuaugaccggggacaucaaaggaauuaugcaggccggcaagcgcucgcugagaccucagccaacagaacuuaaauacagcuggaagacgugggggaaggcuaaaauguuguccaccgagucacacaaccaaacuuuccugaucgauggaccggaaacagccgagugccccaauaccaacagggcauggaauagucucgaggucgaagacuauggcuuugguguuuucucuacaaacauauggcugaaguuacgugagaaacaggacguguuuugugauagcaagcugauguccgcggcuauuaaagacaaucgggccgugcaugcagauaugggguacuggaucgaaucagcccuuaacgacacuuggaagauggagaaggcuagcuucaucgagguaaaaucuugccacuggccuaagucccacaccuuguggaguaauggaguccucgaaagcgagaugauuauccccaaaaauuucgccggccccgugucucagcauaacuaucgaccugguuaccacacgcagacagcaggcccauggcaucuggggaagcuagaaauggauuuugacuucugugagggaaccacuguuguggucaccgaagauugcggcaauagagggcccucccugaggacaacuaccgcuucaggaaaacucauuacagaguggugcugucgcaguugcacgcugccgccucuucgguacagaggcgaggacgguuguugguaugggauggaaauaaggccauugaaggagaaggaagagaaccuggugaauagcuuaguuaccgccggacacggccaaaucgauaacuuuucgcucggugugcugggcauggcgcuuuuccuggaagagauguugcgcacucgaguagggacaaaacaugccauucuccuggucgcuguguccuuugugacccuaaucacuggaaauaugucuuuccgggaccugggccgugucaugguuauggugggggcaacaaugaccgaugacauuggaaugggcguaacguaccucgcccugcuugcugccuuuaaggugagacccacuuucgcagcggguuugcuguuaaggaaacucaccagcaaggagcugaugauggccacaaucgggauagcacuucugucacagaguaccaucccugaaacuauucuagagcucacagaugcccuggcauugggaaugaugguccugaaaaucgugcgcaacauggaaaaguaucaguuagcuguuaccauuauggccauccucugcgugcccaaugcagucauacugcaaaacgccuggaagguguccuguacaauucuugcugcgguuucugugagcccacuguugcucacuuccucacagcagaaagccgacuggaucccucuggcacuaaccaucaagggccugaaucccacggcuauuuuucuuacaacccucagccggacaaguaaaaagagaucuuggccacugaacgaggccgucauggccguaggcaugguguccauauuggcuagcucgcugcucaaaaaugacaucccgaugaccgggccucuaguugcaggaggucugcuuacagugugcuacguccugacuggcaggucagccgauuuggaacucgagcgagcggcugacgugaagugggaggaucaggccgaaauuucugggaguucccccauccugagcauuaccaucucugaggacggaagcauguccaucaaaaacgaagaggaggaacaaacgcuaacaauccugauucgcaccggccuucucguaaucucagguguguucccagucaguauucccaucacugcagccgcuugguaucugugggagguuaagaagcagcgggcagggguguugugggaugugccuagcccacccccugucggaaaagccgaauuagaggacggcgcguacagaauaaagcagaggggcauuuuuggguauucucagaucggagcugguguguacaaagaaggcacauuccacaccauguggcacguuacucguggggccguacugaugcaucgcggaaagcggaucgagccguccugggcagaugugaaaaaggaccucauuucauacggcgguggguggaagcuggagggagaauggaaagagggcgaagagguccaagugcuugcccuggaaccaggcaagaaucccagagcuguucagacaaaaccuggguuguuuaagaccaacacgggaacuaucggugccgugagucuagauuucagcccaggcaccuccgggucucccauagucgacaggaaaggaaaggugguaggccuguaugguaauggggucgugacacgaucgggagcauacguuagcgcuauugcccagaccgagaagucaaucgaggauaacccugaaauugaggacgauaucuuccggaaaaagcgccucacaauaauggaccugcacccgggcgcgggcaaaacuaagagauaucuucccgccauugugagggaagcaaucaaacggggguuacgaacccugauccucgcuccaacgagagucguggccgcugagauggaagaggcauugcgcggacugccuauuagguaccagacacccgccauccgugccgagcauacuggucgggaaauuguugaccucaugugucacgcuaccuuuacaaugagacugcuuuccccagugagggucccuaacuauaaucugauaaucauggaugaggcgcauuucaccgaccccgcaaguauugccgcucgcggcuacaucucuacucgaguggaaaugggggaggccgcaggaaucuuuaugaccgccacaccaccgggcagcagagauccuuucccccaauccaacgcuccaauuauggacgaggaacgggagauacccgaaaggucauggaacucuggucacgaguggguaacggauuuuaaggggaagacugugugguucguuccuagcaucaaagcgggaaacgacauugccgcaugcuugcgcaagaauggcaaaaaggucauccagcuaagucguaaaaccuuugauuccgaauaugugaagacaagagcuaacgacugggauuucguggucaccacugacauuagcgagaugggcgccaauuuucgggcagagaggguaaucgauccacgccgauguaugaagcccgugauacugacagacggggaagagagaguuauccucgccggaccuaugccggugacccacucuucagcugcccagcggaggggucgcauuggcagaaaccccaaaaaugaaaacgaccaauacaucuacaugggggagcccuuagaaaaugaugaggacugcgcgcauuggaaggaggcaaaaaugcugcuugauaacauuaauacgccugaaggaaucauacccuccauguucgagccagaaagggagaaggucgacgccauugauggcgaauaucggcugcguggugaggcucgcaaaacuuuuguggaccucaugcgaagaggggauuugccuguuuggcuggccuacaggguggcugcagagggcaucaacuaugccgaccggcgcugguguuucgauggaauuaagaauaaccagauccucgaagagaacgucgaaguggagauauggacaaaagagggcgaaagaaagaagcugaaacccagguggcuugacgcucggaucuacagugauccacuagcccugaaggaguucaaagaauuugcagcggggcgaaagagcuugaccuuaaaucugauuaccgagaugggaagacucccuacuuucaugacacagaaagcccgcgacgcucuggauaaccuugccguacugcacaccgcagaaguggguggcagggcuuauaaucaugcccucucggaguugccggagacacuggaaacucuacugcuccuuacgcuguuagcaaccguuacagggggaaucuuuuuguuccugaugucuggcaaggguauugggaagaugacucucggcaugugcugcaucauaaccgccuccauucugcuuugguacgcucagauccaaccccacuggaucgcggccagcauuauccuggaguuuuuccucauagucuugcugauuccagaaccugagaaacagcggacaccccaggacaaccaguuaaccuauguggugaucgcaauucuaacugucguugcugccacgauggccaaugaaaugggauuucuggagaagaccaaaaaggaccucggccuugggucaaucauaacacaagagagugaaucuaacauccuggauauugacuugcguccagcauccgcuuggacucuguacgccguggcgaccacauucguaaccccuaugcucagacacagcaucgaaaauucaagugugaacgucagccugacugcuauugccaaucaggcaacagugcuuaugggacucgguaggggcuggccccuguccaaaauggauaucgggguuccguugcuggccauuggauguuacucucaggugaacccaaucacguuaaccgcugcacuacugcuccuugucgcccauuaugcgauaauuggcccuggucugcaggcuaaggccacucgcgaagcacaaaagcgggccgcugccgggaucaugaaaaaucccacaguagacggcaucaccgugauugauuuggagccaauacccuacgacccuaaguuugaaaaacagcugggacagguuaugcuccuggugcuuugcgucacccagguguuaaugaugcgaacaacuugggcacugugugaggcucucacguuggccaccggcccgaucagcacacugugggaggggaaccccggaagauucuggaauacuaccauugcggucuccauggccaacaucuuuaggggcucauaucuagcuggugcugggcuacucuucucuauuaugaagaauacaaccaacacucgccggggaacgggcaauaucggugaaacacuuggcgagaaauggaagaguagacugaacgccuuggggaagucggaauuucaaauauacaaaaagagcggaauccaggagguggaucguacccuggcaaaagagggcauuaagagaggggaaacugaccaccaugcuguuucccggggaucugccaaacuccgcugguucguggagcgaaacaugguaaccccagaaggcaagguggucgaucuggguugcgggagaggaggcuggucauauuacugugguggccuuaaaaauguuagggaggugaaggggcuaacaaagggaggcccugggcacgaggaaccaaucccuaugagcacuuauggauggaaccugguccggcuccaguccggcguggacguauucuuuaccccacccgagaaaugcgauacacuacugugugacauuggugaaaguucuccuaauccaacgaucgaggccgggcgcaccuugagagugcugaaccucguugaaaauuggcuuaacaauaacacucaauucugcauaaaggugcugaaucccuacaugccgagcgucauugagaaaauggaaacauugcagaggaaguacggaggcgcgcuggugcgaaacccucucucaagaaauuccacccaugagauguauugggucaguaacgcuacuggcaauaucgugagcucuguuaacaugaucucccguauguuaauuaauagauuuacaaugaaacacaagaaggcaaccuacgagccagauguagaccuggggucaggaacgcgcaacauagguaucgaaaacgagauucccaaucuugacaucauuggcaaaaggaucgaaaagauaaaacaggagcacgaaaccagcuggcauuaugaucaggaccacccuuacaagacaugggccuaucaugggucguacgagacuaaacaaaccggaucugcuaguuccauggugaacggcgucgugcggcugcuaacaaagccaugggauguugugcccauggucacucagauggccaugaccgacacaaccccguucggucagcagagaguguuuaaggagaaaguagauacucgcacgcaagaaccuaaggaggggaccaaaaagcucaugaggaucacagcagaauggcuguggaaagaguugggaaagaagaaaacuccccgaauguguacccgggaggaguucacaagaaaggugaggagcaaugccgcucugggcgcgauuuuuacggacgagaacaaauggaagucagcccgcgaagcaguugaggauucccguuucugggaacucgucgaccgggagagaaaucuucaccuggagggcaaaugcgaaaccuguguguauaacaugauggggaagagggagaaaaaguuaggagaauuugguaaggcuaaaggcucucgcgccaucugguacauguggcugggggcacgauucuuggaguuugaagcccucggauuccugaaugaggaucacugguuuagccggggcaacagucuauccgguguggagggggaaggacuucauaagcugggcuacauucucagagacgucagcaaaaaggagggcggggcuauguaugccgaugacacugcgggaugggacacaaggaucacccuggaagauuugaaaaaugaggaaaugguuacuaaccacaugaagggugagcauaagaaacuggcagaggccauuuucaagcucacauaccagaauaaagugguacgcgugcagagaccaaccccucggggcacagucauggacauaaucucuaggaaggaucagcgugggucaggacaagugggcacuuauggucuuaacaccuucacgaauauggaagcucagcugauucgacagauggagggggaaggaaucuuuaaaaguauccaacacuuaaccguuacagaggagauugccgugcagaacuggcuggcacgcgucggcagagaacgguuguccaggauggcuauaagcggcgacgauugcgugguaaagccccucgacgaucgcuucgccucugcucugacugcccuaaaugacauggggaagguuagaaaagauauccagcagugggagccaucgcggggauggaacgacuggacccaagugcccuuuugcucacaucacuuccacgaacuugucaugaaggaugguagggugcugguggucccuugucgaagccaggacgagcucauuggccgugcaagaaucucccagggggcgggauggagucugaaagaaacagccugcuugggcaagucuuacgcucagauguggacuuuaauguauuuucaucgccgggaucugaggcucgccgcaaacgcuauuuguagcgccguuccaucccacugggugccgaccucaagaacgacauggaguauccaugcaaaacacgaguggaugaccacugaggacaugcuugccguauggaaucgcguguggauacaagaaaaccccuggauggaggacaagacaccugucgaaucuugggaggaagugccauaccuggguaagcgggaggaucaguggugcgggagccuaaucggacugaccuccagggcgacuugggcuaaaaauauucagaccgccaucaaccagguucgaucacucauuggcaaugaggaauauacagacuacaugcccagcaugaagagauuccggaaagaggaagaggaagcaggcguguugugguga

SEQ ID NO: 14677 - RNA, 9876 nt, Artificial Sequence
  derived and/or modified CDS sequence (opt3) from DENV-2__EU569717__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauuccaaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcucuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacacacacugaccauacuaauccgcacuggccugcuuguaauuagugguguguucccagucagcauccccauuacagcagccgcuugguaccucugggagguuaagaagcaacgggcaggggugcugugggaugugccuucuccacccccugucggaaaagccgaauuggaggacggcgcguauagaaucaagcagaggggcauauuuggguacucccagauuggagcugguguguauaaagaaggcaccuuccauacuauguggcacguuacacguggggccguauuaaugcaucgcggaaagcggaucgagccgucaugggcagaugugaaaaaggaccugaucaguuacggcgguggguggaagcucgagggagaauggaaagagggcgaagagguccaggugcuggcccuugaaccaggcaagaaucccagagcuguucaaaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccacccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcauaccggucgggaaaucguugaccugaugugucacgcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccagucaaacgcuccaaucauggacgaggaacgggagauucccgaaaggucuuggaauagcggucaugaguggguaacugauuuuaaggggaagaccgugugguucguuccuaguauaaaagcgggaaacgacaucgccgcaugccugcgcaagaauggcaaaaaggucauucaauugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcacucauccgcugcccagcggaggggucgcaucggcagaaacccaaaaaaugaaaacgaccaguauauuuacaugggggagccccucgaaaaugaugaggacugcgcgcauuggaaggaggcaaaaauguuacuggauaacaucaauacuccugaaggaauuauccccaguauguucgagccagaaagggagaaggucgacgccauagauggcgaauaccggcuucguggugaggcucgcaaaacauuuguggaccugaugcgaagaggggaucucccuguuugguuggccuauaggguggcugcagagggcauuaacuacgccgaccggcgcugguguuucgauggaaucaagaauaaccaaauucuggaagagaacgucgaaguggagaucuggaccaaagagggcgaaagaaagaagcucaaacccagguggcuggacgcucggauauauagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucacacagcagaaguggguggcagggcuuacaaucacgcccugucugagcucccggagacuuuggaaacgcugcuacugcucacccuucuggcaacaguuacugggggaauuuuuuuauucuugauguccggcaaggguaucgggaagaugacccugggcaugugcugcauuaucacagccagcauacuccugugguaugcucagauucagccccauuggaucgcggccucaaucauucuugaguuuuuccugaucguccucuugauaccagaaccugagaaacaacggaccccccaggacaaccagcugacuuacguggugauugcaaucuuaacggucguugcugccaccauggccaaugaaaugggauuucuagagaagacaaaaaaggaccugggccucgggaguauuacuacccaggagucugaauccaacauccuugauauagaccugcguccagcaagcgcuuggacauuguaugccguggcgaccacuuucguaacaccuaugcugagacacucaaucgagaauaguagcgugaacgucucccucacggcuauugccaaucaagcaaccgugcugaugggacuugguaggggcuggccccucucuaaaauggauaucgggguuccgcuguuggccauuggauguuacagccaggugaacccaaucacucugacagcugcauuacuacugcucgucgcccauuacgcgauuaucggcccuggucuucaggcuaaggccacccgcgaagcacagaagcgggccgcugccgggauaaugaaaaaucccaccguagacggcauuacagugaucgaucuggagccaauccccuaugacccuaaguuugaaaaacaauugggacagguuaugcugcucgugcugugcgucacucaggugcuuaugaugcgaacgaccugggcauuaugugaggcucugacacucgccacuggcccgauuuccaccuugugggaggggaaccccggaagauucuggaauacaaccauagcggucucaauggccaacaucuuuaggggcucuuaccuggcaggugcugggcuacuguucaguauuaugaagaauacuacgaacacacgccggggaaccggcaauaucggugaaacucucggcgagaaauggaagucgagacuuaacgcccuggggaagagcgaauuucagauuuauaaaaaguccggaauccaagagguggaucguaccuuggcaaaagagggcauaaagaggggggaaacagaccaccaugcuguuucucggggaucagccaaacugcgcugguucguggagcgaaacaugguaacuccagaaggcaagguggucgaucucgguugcgggagaggaggcuggagcuacuauugugguggccugaaaaauguuagggaggugaagggguuaaccaagggaggcccugggcacgaagagcccaucccuauguccacauacggauggaaccuuguccggcugcagaguggcguggacguauucuuuacgccacccgagaaaugcgauacccuccuaugugacauuggugaaucuagcccuaauccaacuaucgaggccgggcgcacacugagaguguugaaccugguugaaaauuggcucaacaauaacacccaguucugcauuaaggugcuuaaucccuauaugccgucagucaucgagaaaauggaaacucugcaaaggaaguacggaggcgcguuggugcgaaacccucugucccggaauaguacacacgagauguacugggucagcaacgcuaccggcaauauagugucuuccguuaacaugauuucacguaugcucguaaauagauuuacgaugaaacauaagaaggcaaccuaugagccagauguggacuuagggagcggaacacgcaacaucgguaucgaaaacgagauucccaaucuggacauaaucggcaaaaggauugaaaagaucaaacaggagcacgaaacuucguggcauuacgaucaggaccacccuuauaagaccugggccuaccacgggucuuaugagacaaaacagacuggaagugcuuccagcauggucaacggcgugguucggcuucugaccaagccaugggaugugguccccauggugacacaaauggccaugaccgacacuacgccguucggucagcagagaguauuuaaggagaaaguggauacacgcacccaggaaccuaaggaggggacuaaaaagcuaaugaggauuaccgcagaauggcucuggaaagagcugggaaagaagaaaacaccccgaauguguacgcgggaggaauucaccagaaagguuaggucaaaugccgcuuugggcgcgaucuuuacugacgagaacaaauggaaguccgcccgcgaagcagucgaggauucucguuucugggaacugguggaccgggagagaaaucuccaucuugagggcaaaugcgaaacauguguguacaacaugauggggaagagggagaaaaagcugggagaauuugguaaggcuaaaggcagccgcgccauaugguauaugugguuaggggcacgauuccuggaguuugaagccuugggauuccucaaugaggaucacugguuuagucggggcaacucccugagcggugucgagggggaaggacuacauaagcuuggcuacauccugagagacguuucuaaaaaggagggcggggcuauguacgccgaugacaccgcgggaugggacacuaggauuacacucgaagaucugaaaaaugaggaaauggugaccaaccacaugaagggugagcauaagaaauuggcagaggccaucuucaagcugacauaucaaaauaaaguagugcgcguccagagaccaacuccucggggcaccgugauggacauuaucucaaggaaggaucagcgugggaguggacagguuggcacguacggucucaacaccuucacaaauauggaagcucaacuuauucgacagauggagggggaaggaauauuuaaauccauccagcgccugacugugaccgaggagauugccguccaaaacugguuagcaagagugggccgggaaaggcugagccgcauggcuaucucuggcgacgauugcguaguuaagcccuuggacgauagauucgccucggcucucacagcccugaaugacauggggaaggugcggaaagauauccagcagugggagccaucaaggggauggaacgacuggacucagguccccuuuugcagccaccacuuccaugaacuagugaugaaggauggucgagugcuugucguuccuugucguaaccaagacgagcugauuggcagagcacgcauaucccagggggcgggauggagucucaaagaaaccgccugccugggcaagucuuaugcucagauguggacguugauguacuuucaccggagggauuuaagacuggccgcaaaugcuaucuguagcgccgugccaucccauuggguaccgacaucacgcaccacuuggaguauucacgcaaaacacgaguggaugacaaccgaggacaugcucgccguguggaaccgggucuggauccaggaaaaucccuggauggaggacaagacuccuguggaaucuugggaggaaguuccauaucuugguaagagggaggaucaauggugcgggagccugauuggacuaaccucccgagcgacaugggcuaaaaacauccagacggccauaaaucaggugagaucacugaucggcaacgaggaauacaccgacuauaugcccagcaugaagcgguucaggaaagaggaagaggaagcaggcguccucugguga

SEQ ID NO: 14678 - RNA, 9876 nt, Artificial Sequence
  derived and/or modified CDS sequence (opt3) from DENV-2__EU569718__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggaguaugcuguuggcaaugacacggggaagcauggaaaagaaauuaagaucacaccgcaguccucaauaaccgaggccgaacuuacuggcuacgguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucacgccaaaaagcaggacgugguuguguugggcucucaagaaggggcgaugcauaccgcccuaacuggagcaacagagauccagauguccucagguaaucugcucuuuaccggccaccugaaaugccgucuucgcauggauaagcugcaguugaaagggaugagcuauaguauguguacaggaaaguucaagaucgucaaagaaauugcugagacucaacauggcaccaucgugauuagaguacaguacgagggugacgggucuccaugcaagauacccuucgaaaucauggaucucgagaaaaggcacguucugggccgguuaauuacggugaacccgaucgucaccgaaaaggacuccccugugaacgucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaucaaguguucggcgcuauuuauggagcggcauuuaguggcguaagcuggacuaugaaaaucuugauaggggucaucauuaccuggaucggaaugaacuccagaucuacgagccugucagugagucucguucuggugggcgucgugacacuuuaccuggguguaauggugcaggccgacuccggguguguugucagcuggaagaauaaagaauugaagugcggaucuggcauuuucaucaccgauaacgugcacacuuggacagagcaguauaaguuucagcccgaaucaccaaguaaacucgcuagcgccauacaaaaggcacacgaggaagguauuuguggcaucagguccgugacccggcuggagaauuuaauguggaaacagauuacucccgagcugaaccauauccuaucugaaaaugaggucaagcucaccauaaugacaggggacaucaaaggaauuaugcaggccggcaagcgcucgcugagaccucagccaacggaacuuaaauacagcuggaagaccugggggaaggcuaaaauguuguccacugagucacacaaccaaacauuccugaucgauggaccggaaaccgccgagugccccaauacaaacagggcauggaauagucucgagguugaagacuauggcuuugguguguucucuacuaacauuuggcugaaguuacgugagaaacaggacguguuuugugauagcaagcugauguccgcggcuaucaaagacaaucgggccguacaugcagauaugggguacuggauagaaucagcccuuaacgacaccuggaagauggagaaggcuagcuucauugaggucaaaucuugccacuggccuaagucccacacguuguggaguaauggagugcucgaaagcgagaugaucaucccaaaaaacuucgccggccccguuucucagcauaacuaucgaccugguuaccacacacagaccgcaggcccauggcaucuggggaagcuagaaauggauuuugacuucugugagggaacuaccguggucgugacagaagauugcggcaauagagggcccucccugaggacuaccacagcuucaggaaaacucauuacggaguggugcugucgcaguugcacccugccgccucuucgguacagaggcgaggacgguuguugguaugggauggaaaucaggccauugaaggagaaggaagagaaccugguuaauagcuuagugacugccggacacggccaaauugauaacuuuucgcucgguguacugggcauggcgcuuuuccuggaagagauguugcgcacacgagucgggaccaaacaugccauacuccugguggcuguguccuuugucacucuaaucacaggaaauaugucuuuccgggaccugggccguguuauggugaugguaggggcaaccaugacggaugacauuggaaugggcgugacuuaccucgcccugcuugcugccuuuaaggucagacccaccuucgcagcggguuugcuguuaaggaaacucacaagcaaggagcugaugauggccaccaucgggauugcucuucugucacagaguacuaucccugaaacaauacuagagcucaccgaugcccuggcauugggaaugauggugcugaaaaucguucgcaacauggaaaaguaucaguuagcugugacaauuauggccaucuccugcguccccaaugcagugauucuccaaaacgccuggaagguuucuuguacuauccuggcugcggugagcgucuccccacuucuguugaccucaagccagcagaaagccgacuggauaccucucgcacugacgauuaagggccuaaaucccacagcuaucuuucugaccacucuuagucggaccucuaaaaagagauccuggccacucaacgaggccguaauggccgugggcaugguuagcauccuggcuucgucauugcugaaaaaugacauuccgaugacagggccuuuaguggcaggaggucuccugacugucugcuacgugcuuaccggcaggucugccgaucuggaauuggagcgagcggcugacguaaagugggaggaucaggccgaaauaaguggguccagccccauccucucuauuacgaucagcgaggacggauccaugucaauuaaaaacgaagaggaggaacaaacacugaccauccuaauacgcacuggccugcuugugaucaguggugucuucccaguuagcauucccaucacagcagccgcuugguaucucugggaggugaagaagcagcgggcaggggugcugugggaugucccuucuccacccccugugggaaaagccgaauuggaggacggcgcguacagaauuaagcagaggggcaucuuuggguauucccagauaggagcugguguuuacaaagaaggcaccuuccacacuauguggcacguaacacguggggccguguuaaugcaucgcggaaagcggauugagccgucaugggcagaugucaaaaaggaccugaucaguuacggcgguggguggaagcucgagggagaauggaaagagggcgaagaggugcaaguucuggcccuugaaccaggcaagaaucccagagcugugcagaccaaaccugggcuguuuaagacgaacacuggaaccaucggugccgucagcuuggauuucuccccaggcacaucugggucgcccauuguggacaggaaaggaaagguagucggccuauaugguaauggggugguuacccgaagcggagcauacgugucagcuaucgcccagacagagaaguccauagaggauaacccugaaauugaggacgauaucuuccggaaaaagcgccugacuauuauggaccuccacccgggcgcgggcaaaaccaagagauaucugcccgccaucgucagggaagcaauaaaacgggggcuucgaacguuaauucuggcuccaacaagagugguugccgcugagauggaagaggcacuccgcggauugccuaucagguaccagacucccgccauccgugccgagcauaccggucgggaaauuguggaccugaugugucacgcuacauuuaccaugagacuccugaguccagucagggugccuaacuauaaucuuaucauuauggaugaggcgcauuucacugaccccgcaucuauagccgcucgcggcuacaucagcacccgaguagaaaugggggaggccgcaggaauuuuuaugacagccacgccaccgggcuccagagauccuuucccccaaucaaacgcuccaaucauggacgaggaacgggagauccccgaaaggucuuggaauagcggucacgagugggugacugauuuuaaggggaagaccguuugguucgucccuaguauuaaagcgggaaacgacauagccgcaugccugcgcaagaauggcaaaaaggugauccaguugucccguaaaacauuugauagcgaauaugugaagaccagagcuaacgacugggauuucgucguaacuacagacauuucugagaugggcgccaauuuucgggcagagagggugaucgauccacgccgauguaugaagcccguuauucuaaccgacggggaagagagagugauccuggccggaccuaugccggucacgcacucauccgcugcccagcggaggggucgcauaggcagaaacccaaaaaaugaaaacgaccaauacaucuacaugggggagccccucgaaaaugaugaggacugcgcgcauuggaaggaggcaaaaauguuacuggauaacauuaauacuccugaaggaaucauucccaguauguucgagccagaaagggagaagguggacgccaucgauggcgaauaucggcuucguggugaggcucgcaaaacauuuguugaccugaugcgaagaggggaucucccugugugguuggccuacagggucgcugcagagggcauaaacuaugccgaccggcgcugguguuucgauggaauuaagaauaaccagauccuggaagagaacguggaaguagagauuuggaccaaagagggcgaaagaaagaagcucaaacccagguggcuggacgcucggaucuacagcgauccacuugcccuaaaggaguucaaagaauuugcagcggggcgaaagucgcugaccuugaauuuaauaacugagaugggaagacugccuacauucaugacccagaaagcccgcgacgcucucgauaaccuggccgugcuucacacagcagaaguugguggcaaggcuuauaaucaugcccugucugagcucccggagacuuuggaaacgcugcuacugcucacccuucuggcaacagucacugggggaaucuuuuuauucuugauguccggcaaggguauugggaaaaugacccugggcaugugcugcaucauuacagccagcauccuccugugguacgcucagauacaaccccacuggauugcggccucaaucauccuugaguuuuuccugauugugcucuugaucccagaaccugagaagcagaggaccccccaggacaaccagcugacuuauguggucauagcaauuuuaacgguuguggcugccaccauggccaaugaaaugggauuucuagagaaaacaaagaaagaccugggccucgggaguaucacuacccaagagucugaauccaacauucuugauaucgaccugcggccagcaagcgcuuggacauuguacgccguagcgaccacuuucgugacaccuaugcugcgucacucaauagagaauaguagcgucaacgugucccucacggcuaucgccaaucaggcaaccguucugaugggacuugguagaggcuggccccucucuaagauggauauuggggugccgcuguuggccaucggauguuacagccaggucaacccaauuacucugacagcugcauuacuacugcucguagcccauuaugcgaucauuggcccuggucuucaggcuaaggccaccagggaagcacaaaaacgcgccgcugccgggaucaugaagaaucccaccguggacggcauaacaguuauugaucuggagccaauccccuacgacccuaaauuugaaaagcaguugggacaggugaugcugcucguccugugcgugacucagguccuuaugaugcggacgaccugggcauuaugugaggcucugacacucgccacuggcccgaucuccaccuugugggaggggaaccccggacgauucuggaauacaaccauugcggugucaauggccaacauauuuagaggcucuuaucuggcaggugcugggcuacuguucaguaucaugaaaaauacuacgaacacaaggcgcggaaccggcaauauuggugaaacucucggcgagaaguggaagucgcggcuuaacgcccuggggaaaagcgaauuucaaaucuacaagaaauccggaauucaggagguugauagaaccuuggcaaaggagggcaucaaacguggggaaacagaccaccaugcugugucuaggggaucagccaagcugcggugguucguagagcgcaacauggugacuccagaaggcaaagucguugaucucgguugcgggcgaggaggcuggagcuauuacugugguggccugaagaaugugagagaggucaagggguuaaccaaaggaggcccugggcacgaagagcccauaccuauguccacauauggauggaaccuugugaggcugcagaguggcguagacguguucuuuacgccacccgagaagugcgauacccuccuaugugacaucggugaaucuagcccuaauccaacuauugaggccgggcggacacugcgcguuuugaaccugguggaaaauuggcucaacaauaacacccaauucugcaucaaaguccuuaaucccuacaugccgucagugauugagaagauggaaacucugcagagaaaauacggaggcgcguuggucaggaacccucugucccgaaauaguacacaugagauguauugggugagcaacgcuaccggcaauaucguuucuuccguaaacaugauaucacggaugcucauuaaucguuuuacgaugaagcacaagaaagcaaccuacgagccagauguggacuuagggagcggaacaagaaacaucgguaucgaaaacgagauucccaaucuggacauaaucggcaagcgcauugaaaaaaucaagcaggagcacgaaacuucguggcauuaugaucaggaccacccuuacaaaaccugggccuaucaugggucuuacgagacaaagcaaacuggaagugcuuccagcauggucaacggcgugguuaggcuucugaccaagccaugggaugugguccccauggugacacagauggccaugaccgacacuacgccguucggucagcagcggguauuuaaagagaagguggauacaagaacccaagaaccuaaagaggggacuaagaaacuaaugcgcauuaccgcagaauggcucuggaaggagcugggaaagaaaaagacacccaggauguguacgcgagaggaauucacccggaaaguuagaucaaaugccgcuuugggcgcgaucuuuacugacgagaacaaguggaaauccgccagggaagcagucgaggauucucgcuucugggaacugguggaccgugagcggaaucuccaccuugagggcaagugcgaaacauguguguauaacaugauggggaaaagagagaagaagcugggagaauuugguaaagcuaagggcagcagggccauaugguacaugugguuaggggcacgcuuccuggaguuugaagccuugggauuccucaaugaggaucacugguuuagucgaggcaacucccugagcggugucgagggggaaggacuacauaaacuuggcuacauccugcgggacguuucuaagaaagagggcggggcuauguaugccgaugacaccgcgggaugggacacuagaauuacacucgaagaucugaagaaugaggaaauggugaccaaccacaugaagggugagcauaaaaaguuggcagaggccaucuucaaacugacauaccagaauaagguagugaggguccagcgcccaacuccuagaggcaccgugauggacauuaucucacggaaagaucagagggggaguggacaaguuggcacguauggucucaacaccuucacaaauauggaagcucagcuuauucgucagauggagggggaaggaauauuuaaguccauccaacgacugacugugaccgaggagauugccguccagaacugguuagcacgcgugggcagagaacggcugagcaggauggcuaucucuggcgacgauugcguaguuaagcccuuggacgaucgcuucgccucggcucucacagcccugaaugacauggggaaagugagaaaggauauccagcagugggagccaucacggggauggaacgacuggacucaaguccccuuuugcagccaccauuuccacgaacuagugaugaaagaugguagggugcuugucguuccuugucgaaaccaggacgagcugauuggccgugcaagaauaucccagggggcgggauggagucucaaggaaaccgccugccugggcaaaucuuacgcucagauguggacguugauguauuuucaccgccgggauuuaaggcuggccgcaaaugcuaucuguagcgccgugccaucccauuggguaccgacaucaagaaccacuuggaguauucacgcaaagcaugaguggaugacaaccgaggacaugcucgccguguggaaccgcgucuggauccaagaaaaucccuggauggaggacaagacuccuguggaaucuugggaggaaguuccauaccuugguaaacgggaggaucaguggugcgggagccugauuggacuaaccuccagggcgacaugggcuaagaacauccagacggccauaaaucaggugcgaucacugaucggcaacgaggaauauaccgacuacaugcccagcaugaaaagauuccggaaggaggaagaggaagcaggcguccucugguga

SEQ ID NO: 14679 - RNA, 9876 nt, Artificial Sequence
  derived and/or modified CDS sequence (opt3) from DENV-2__EU596488__SS-prME
accgccggcgugaucauuaugcugauacccacagucauggcuuuccaccucacuacgagaaacggggagccucauaugaucguuggaaggcaggaaaaggguaaaagccuucuguuuaagaccgaggacggcgugaauaugugcacauugauggcaauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcccuggucccccauguggguauggggcuugagaccagaacagaaacuuggaugaguagcgagggagcguggaaacacguucagaggaucgagaccuggauacugcggcauccuggcuucacaaucauggcugccauuuuggcauacaccaucggcacgacucacuuucagcgcgcccucauuuucauccugcugacagcuguggcaccauccaugaccaugagaugcauagggauuucuaacagggauuuugucgaaggagugucggguggcucauggguagacaucguucucgagcacgggagcugugugacuacaauggccaagaauaagcccaccuuagauuucgaacugauuaaaacggaggcuaagcagccugccacccuucggaaauauugcaucgaagcgaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggauugugaccugcgcaauguuuacaugcaaaaagaauauggaaggaaaagugguccucccugagaaccuggaauacaccauaguuaucacuccacacagcggugaggagcaugccgugggcaaugacacggggaagcacggaaaagaaauuaagaucacaccgcaguccucaauaaccgaggcugaacuuacuggcuaugguaccguaacaauggaguguagucccaggaccgggcuggauuucaacgaaaugguguugcuccagauggaggacaaagccuggcugguccaccggcaaugguuuuuagaucugccucucccauggcuucccggcgcagacacucagggaagcaauuggauucagaaggagacacuggugacguucaagaacccucaugcuaaaaagcaggacguuguggucuugggcucucaagaaggggccaugcacaccgcgcuaacuggagccacagagauccagauguccucagguaaucugcucuuuaccggccaucugaaaugccgucuucgcauggauaagcugcaguugaaagggaugagcuacaguauguguacaggaaaguucaagaucgugaaagaaauugcagagacucaacacggcaccaucguaauuagaguucaguaugagggugacgggucuccaugcaagauacccuucgaaaucauggaucucgagaaaaggcaugugcugggccgguuaauuacggucaacccgaucgugaccgaaaaggacuccccugucaacaucgaggcugaacccccauuuggagauagcuacauuauaaucggcguggagccugggcagcugaaacuaaauugguucaagaagggaucgucuauuggucagauguuugagacaacuaugcgaggcgccaaacgcauggcuauccucggggacaccgccugggauuucggaucccugggcgguguuuuuacaucaauugggaaggcacuucaccaaguguucggcgccaucuacggagcugcguuuaguggcguaagcuggacuaugaaaauauugaucggggucauuaucaccuggauuggaaugaacuccagaucuacgagccugucagugagucucguucuggugggcgucgugacacuuuaucuggguguaauggugcaggcagacaccggguguguugucuccuggaagaauaaagaauugaagugcggaagcggcaucuucauaacugauaacgugcacacauggaccgagcaguacaaguuucagcccgaaucuccaucaaaacucgccagugcuauucaaaaggcccaugaggaagguaucuguggcauuaggagcgugacucggcuggagaauuuaauguggaaacagaucacccccgagcugaaccacauacuauccgaaaaugaggucaagcucacaaucaugacgggggacauuaaaggaaucaugcaggcaggcaagcgcucucugagaccucagccaaccgaacuuaaauauucguggaagacuugggggaaggccaaaauguugagcacagagucccauaaccaaaccuuccugauugauggaccggaaacagcugagugccccaauacuaacagggccuggaauucacucgagguugaagacuacggcuuugguguguucaguaccaacaucuggcugaaguuacgugagaaacaggacguguuuugugauucuaagcugaugagcgcagcgauaaaagacaaucgggcuguacacgccgauaugggguauuggauugaauccgcacuuaacgacacguggaagauggagaaggccucauucaucgagaucaaaagcugccacuggccuaagucucauacauugugguccaauggaguccucgaaagugagaugauuaucccaaaaaacuucgcuggccccgugagccagcacaacuaccgaccugguuaucauacccagacugccggcccauggcaccuggggaagcuagaaauggauuuugacuucugugagggaaccacaguuguggucacugaagauugcggcaauagagggcccucucugaggaccacaacggcauccggaaaacucauuaccgaguggugcugucgcucaugcacucugccgccucuucgguacagaggcgaggacgguuguugguacgggauggaaauaaggccauugaaggagaaggaagagaaccuggugaauaguuuaguuacagcuggacauggccaaaucgauaacuuuagccucggugugcugggcauggcccuuuuccuggaagagauguugcgcacccgaguagggacuaaacacgcgauucuccuggucgccgugucguuugugacacuaaucaccggaaauauguccuuccgggaccugggccgugucaugguuauggugggggcuacgaugacugaugacauuggaaugggcguaaccuaucucgcacugcuugccgcuuuuaaggugagacccacauucgccgcagguuugcuguuaaggaaacucaccucuaaggagcugaugauggcgacuaucgggauagcccuucugagccagucaacaaucccugaaaccauucuagagcucacagaugcucuggccuugggaaugaugguccugaaaaucgugcgcaacauggaaaaguaccaguuagcaguuacuauuauggcuaucaguugcgugcccaaugccgucauacuccaaaacgcauggaagguguccuguaccauucuggccgcuguuucugugagcccacuucuguugacguccucacagcagaaagcggacuggaucccucucgcccugacaaucaagggccuaaaucccaccgcaauuuuucugacuacccuuagccggacaaguaaaaagagaucuuggccacucaacgaggcugucauggccguaggcaugguguccauacuggccagcucguugcugaaaaaugacaucccgaugacugggccuuuaguugcuggaggucuccugaccgugugcuauguccuuacgggcaggucagcagaucuggaauuggagcgagccgcggacgugaagugggaggaucaggcugaaauuucugggaguucccccauccucagcauuacaaucucugaggacggaagcauguccauaaaaaacgaagaggaggaacacacccugacuauccuaauucgcacaggccugcuuguaaucucagguguguucccagucaguauucccaucaccgccgcagccugguaccucugggagguuaagaagcaacgggcuggggugcugugggaugugccuagcccacccccugucggaaaagcagaauuggaggacggcgccuauagaauaaagcagaggggcauuuuuggguacucucagaucggagcggguguguauaaagaaggcacuuuccauacaauguggcacguuacccguggggcuguauuaaugcaucgcggaaagcggaucgagccguccugggccgaugugaaaaaggaccugauuucauacggcgguggguggaagcucgagggagaauggaaagagggcgaagagguccaggugcuggcacuugaaccaggcaagaaucccagagccguucaaacgaaaccugggcuguuuaagacuaacaccggaacaaucggugcugugaguuuggauuucagcccaggcaccuccgggucucccauagucgacaggaaaggaaaggugguaggccuauacgguaauggggucgugacacgaucgggagccuauguuagcgcaauugcucagacugagaagucaaucgaggauaacccugaaauugaggacgauaucuuccggaaaaagcgccugaccauaauggaccuccacccgggcgccggcaaaacgaagagauaccugcccgcgauugugagggaagccaucaaacgggggcuucgaacauuaauccuggcaccaacuagagucguggcugccgagauggaagaggcucuccgcggauugccuauuagguaucagacccccgcaauccgugccgagcauacaggucgggaaauuguugaccugaugugucacgccaccuuuacuaugagacuccuguccccagugagggucccuaacuacaaucuuauaaucauggaugaggcucacuucaccgaccccgcgaguauugcagcccgcggcuauaucucuacacgaguggaaaugggggaggcugccggaaucuuuaugacggcaacuccaccgggcagcagagauccuuucccccaguccaacgccccaauuauggacgaggaacgggagauacccgaaaggucauggaauucuggucaugaguggguaaccgauuuuaaggggaagacagugugguucguuccuagcaucaaagcuggaaacgacauugcggccugccugcgcaagaauggcaaaaaggucauccaauugagucguaaaaccuuugauuccgaauacgugaagacuagagcaaacgacugggauuucguggucacaaccgacauuagcgagaugggcgcuaauuuucgggccgagaggguaaucgauccacgccgauguaugaagcccgugauacuaacggacggggaagagagaguuauccuggcaggaccuaugccggugacucacucuucagccgcucagcggaggggucgcauuggcagaaacccaaaaaaugaaaacgaccaguauaucuacaugggggagccccucgaaaaugaugaggacugcgcccauuggaaggaggcgaaaauguuacuggauaacauuaauacaccugaaggaaucauacccuccauguucgagccagaaagggagaaggucgacgcaauugauggcgaauaccggcuucguggugaggcccgcaaaaccuuuguggaccugaugcgaagaggggaucucccuguuugguuggcuuauaggguggccgcugagggcaucaacuacgcagaccggcgcugguguuucgauggaauuaagaauaaccaaauccuggaagagaacgucgaaguggagauauggaccaaagagggcgaaagaaagaagcucaaacccagguggcuggacgcccggaucuauagugauccacuugcucuaaaggaguucaaagaauuugccgcagggcgaaagagccugacuuugaauuuaauuacagagaugggaagacugccuaccuucaugacacagaaagcgcgcgacgcccucgauaaccuggcuguacuucacacugccgaaguggguggcagggcauacaaucacgcucugucggagcucccggagacguuggaaacccugcuacugcucacacuucuggccacuguuaccgggggaaucuuuuuauucuugaugucuggcaaggguauugggaagaugacacugggcaugugcugcaucauaaccgcauccauucuccugugguaugcccagauccagccccauuggaucgcugcgagcauuauccuugaguuuuuccugauaguccucuugauuccagaaccugagaaacaacggacuccccaggacaaccagcugacguacguggugaucgccauuuuaaccgucguugcagcuacaauggccaaugaaaugggauuucuagagaagacuaaaaaggaccugggccucgggucaaucaccacacaggagagugaaucuaacauacuugauaucgaccugcguccagccuccgcauggaccuuguaugcuguggccacuacauucguaacgccuaugcugagacacagcauugagaauucaagugugaacgucagccucaccgcgaucgcuaaucaagccacugugcugaugggacuugguaggggcuggccccucuccaaaauggauauugggguuccgcuguuggcaaucggauguuacucucaggugaacccaauuacacugaccgccgcuuuacuacugcucgucgcacauuacgccaucauaggcccuggucuucaggcgaaggcuacccgcgaagcccagaagcggacagcagccgggauuaugaaaaaucccacuguagacggcaucacggugaucgaucuggagccaauucccuaugacccuaaguuugaaaaacaauugggacagguuaugcugcucgugcugugcgucacccaggugcuuaugaugcgaacaacuugggcuuuaugugaggcccugacccucgcaacaggcccgauaagcaccuugugggaggggaaccccggaagauucuggaauacuacgaucgcugucuccauggccaacauuuuuaggggcucauaccuggcgggugccgggcuacuguucucuaucaugaagaauacaauuaacacccgccggggaacuggcaauaucggugaaacccucggcgagaaauggaagaguagacuuaacgcacuggggaagucggaauuucagauauauaaaaagagcggaauccaagagguggaucguacauuggcuaaagagggcauuaagaggggggaaacugaccaccaugccguuucccggggaucugcaaaacugcgcugguucguggagcgaaacaugguaaccccagaaggcaagguggucgaucucgguugcgggagaggaggcuggucauacuauugugguggccugaaaaauguuagggaggugaagggguuaacaaagggaggcccugggcacgaagagcccaucccuaugagcacguacggauggaaccuuguccggcugcaguccggcguggacguauucuuuaccccacccgagaaaugcgauacucuccuaugugacauuggugaaaguucuccuaauccaacaaucgaggcugggcgcacccugagaguguugaaccugguugaaaauuggcucaacaauaacacucaguucugcgugaagguccuuaaucccuauaugccgagcgugauagagaaaauggaaacacugcaaaggaaguacggaggcgccuugguccgaaacccucugucacggaauuccacccacgagauguacugggugaguaacgccacgggcaauauuguuagcucuguaaacaugaucucccguaugcucaucaauagauuuaccaugaaacauaagaaggcgacauaugagccagauguggacuuagggucaggaacucgcaacauugguauagaaaacgagauccccaaucuggacauuaucggcaaaaggauugaaaagaucaaacaggagcacgaaaccagcuggcauuacgaucaggaccacccuuauaagacaugggcuuaccacgggucguaugagacuaaacagaccggaucugcaaguuccauggucaacggcgugguuaagcuucugacaaagccaugggaugugguccccauggugacccaaauggccaugacugacacgacaccguucggucagcagcggguauuuaaagagaagguggauaccagaacucaggaaccuaaagaggggaccaagaaacuaaugcgcauaacagcugaauggcucuggaaggagcugggaaagaaaaagacgcccaggauguguacccgagaggaauucacucggaaaguuagaagcaaugccgcauugggcgccaucuuuacagacgagaacaaguggaaaucagcuagggaagcggucgaggauucccgcuucugggaacugguggaccgugagcggaaucuccaucuugagggcaagugcgaaaccuguguguacaacaugauggggaaaagagagaagaagcugggagaauuugguaaagccaagggcucuagggcaauuugguauaugugguuaggggcucgcuuccuggaguuugaagccuugggauuccucaaugaggaucacugguuuagccgaggcaacagucuguccggugucgagggggaaggacuacauaaacuuggcuacauccugcgggacguuagcaagaaagagggcggggcaauguacgccgaugacacugcuggaugggacacaagaauuacccucgaagaucugaagaaugaggaaauggugacaaaccacaugaagggugagcauaaaaaguuggccgaggcgaucuucaaacugacuuaucaaaauaagguagugaggguccagcgcccaaccccuagaggcacggugauggacauuauaucucggaaagaucagagggggucaggacagguuggcaccuacggucucaacacauucacuaauauggaagcacaacuuauccgucagauggagggggaaggaauuuuuaagaguauccagcgacugaccgugacagaggagaucgccguccaaaacugguuagcucgcgugggcagagaacggcuguccaggauggccauuagcggcgacgauugcguaguuaagcccuuggacgaucgcuucgcaucugcucucacugcccugaaugacauggggaaagugagaaaggauauacagcagugggagccaucgcggggauggaacgacuggacccagguccccuuuugcucacaccacuuccaugaacuagugaugaaagaugguagggugcuugucguuccuugucgaaaccaagacgagcugaucggccgugcuagaauuagccagggggccggauggucccucaaggaaacggcaugccugggcaaaaguuaugcgcagauguggacauugauguacuuucaccgccgggauuuaaggcuggccgcuaaugccaucuguucugcagugccaagccauuggguaccgaccuccagaacuacauggucaauucacgcuaagcacgaguggaugaccacugaggacaugcucgccguguggaaccgcgucuggauccaggaaaaucccuggauggaggacaagaccccuguggaaaguugggaggaaguuccauaucuugguaaacgggaggaucaauggugcgggucucugauaggacuaacaagcagggcaacgugggccaagaacauccagaccgcgauuaaucaggugcgaucccugaucggcaacgaggaauacacugacuauaugcccucaaugaaaagauuccggaaggaggaagaggaagcuggcguccucugguga

SEQ ID NO: 14680 - RNA, 9876 nt, Artificial Sequence
  derived and/or modified CDS sequence (opt3) from DENV-2__EU596489__SS-prME
accgccggcgugaucauuaugcugauacccacagcuauggcuuuccaccucacuacgcgaaauggggaaccucauaugaucguaggaaggcaggaaaaggguaaaagccuucuguuuaagaccgaggacggcguuaauaugugcacauugauggccauugauuuaggggaacugugugaggacacuaucaccuacaaaugcccacuacuccggcaaaaugaaccggaggauauugacuguuggugcaauuccacaucuaccugggugacuuauggaacauguaccacgacuggcgagcaccgccgagaaaagcguucaguggcgcuggugccccaugucgguauggggcuugagaccaggacagaaacuuggaugaguagcgagggagcuuggaaacacgugcagaggaucgagaccuggauacugcggcauccuggcuucacaaccauggccgcaaucuuggccuacacgauuggcacuacacacuuucagcgcgcucucaucuucauucugcugaccgcaguugccccauccaugacuaugagaugcaucgggauaucuaacagggauuuuguggaaggagucucggguggcucauggguggacauuguacucgagcacgggagcuguguuacaaccauggcuaagaauaagcccacguuagauuucgaacugaucaaaaccgaggccaagcagccugcgacacuucggaaauauugcauugaagcaaaguugacuaacaccacaacugagagucgcuguccaacccaaggagagcccucccugaaugaagaacaggacaaacgauuuaucugcaagcauucuaugguggauagaggcugggguaacggguguggacuauucggcaagggcgggaucgucacaugcgccauguuuaccugcaaaaagaauauggaaggaaaaguggugcucccugagaaccuggaauacacuauugucauaacgccacacagcggugaggagcaugcuguuggcaaugacacagggaagcacggaaaagaaaucaagauuaccccgcaguccucaaucacugaggccgaacuuaccggcuaugguacagugaccauggaguguagucccaggacugggcuggauuucaacgaaaugguauugcuccagauggaggacaaagcauggcuggugcaccggcaaugguuuuuagaucugccucucccauggcuucccggcgcugacacacagggaagcaauuggauacagaaggagacgcuggucaccuucaagaacccucaugccaaaaagcaggacgugguuguguugggcucucaagaaggggcgaugcacacugcccuaacaggagcaaccgagauucagauguccucagguaaucugcucuuuacaggccaucugaaaugccgucuucgcauggauaagcugcaguugaaagggaugagcuacaguauguguacuggaaaguucaagaucgucaaagaaaucgcugagacccaacacggcacgauugugaucagaguacaguaugagggugacgggucuccaugcaagauucccuucgaaauaauggaucucgagaaaaggcauguucugggccgguuaaucaccgugaacccgauugucacagaaaaggacuccccugugaacaucgaggccgaacccccauuuggagauagcuacaucauuauaggcgucgagccugggcagcugaaacuaaauugguucaagaagggaucgucuaucggucagauguuugagacuaccaugcgaggcgcuaaacgcauggccauucucggggacacagcaugggauuucggaucccugggcgguguguuuacuucaaucgggaaggcccuucaccaaguuuucggcgcuauuuacggagcggcauuuaguggcgugagcuggaccaugaaaaucuugauagggguaaucauuacguggaucggaaugaacuccagaucuacaagccugucagucagucucgugcugguuggcauugugacccuuuaucugggugucauggugcaggccgacacuggguguguaguguccuggaagaauaaagaauugaagugcggaagcggcaucuucauaacagauaacguucacaccuggacugagcaguacaaguuucagcccgaguucccaucuaaacucgcuucagccauuaagaaagcacaugaggaagguaucuguggcauuaggagugucacccggcuggagaauuuaauguggaagcaaaucacacccgagcugaaccacauacuaagcgaaaaugaggugaaacucacgaucaugaccggggacauuaagggaaucaugcaggccggcaaacgcucccugagaccucagccaacugaacuuaaguauucuuggaagacaugggggaaagcuaagauguugucgaccgagagccauaaccagacauuucugauugauggaccggaaacugccgagugccccaauaccaacagggcauggaacucccucgagguggaagacuacggcuucggugucuuuucaacgaacaucuggcugaaauuacgugagaagcaagacguuuucugugauaguaaacugaugucugcggcuauaaaggacaaucgggccgugcacgcagauaugggguauuggauugaaagcgcccuuaacgacacauggaagauggagaaggcuuccuucaucgagaucaagucaugccacuggccuaaaagccauaccuuguggucuaauggagugcucgaauccgagaugauuaucccaaagaacuuugccggccccguaagucagcacaacuaccgaccugguuaucauacucagaccgcaggcccauggcaccuggggaaacuagaaauggauuucgacuuuugugagggaacaacugucgugguuaccgaagauugcggcaauagagggcccagccugaggacaacgaccgcuucuggaaagcucauuacugaguggugcugucgcuccugcacacugccgccucuucgguacagaggcgaggacgguuguugguacgggauggaaauaaggccauugaaggagaaagaagagaaccugguaaauucauuagucaccgccggacauggccagaucgauaacuucagucucggugugcugggcauggcgcuuuuucuggaagagauguugcgcacucgaguugggacaaagcacgccauucuccugguggcugucagcuucgucacccuaaucacgggaaauaugucguuucgggaccugggccgugugauggugauggucggggcaacuaugaccgaugacauuggaaugggcguuacauaucucgcccugcuugcugccuucaaagugagacccaccuuugcagcggguuugcuguuaaggaagcucacuuccaaagagcugaugauggccacaaucgggauagcacuucugucucaaagcaccaucccugaaacaauucuagagcucacugaugcccuggcauugggaaugaugguacugaagaucgugcgcaacauggaaaaguaccaguuagcugucaccauuauggccaucucaugcgugcccaaugcaguuauacuccagaacgccuggaaagugaguuguacgauucuggcugcggucuccgugucuccacuucuguugacaagcucccaacagaaggccgacuggaucccucucgcacugaccaucaaaggccuaaaucccacugcuauuuuccugaccacacuuucacggacuagcaagaaaagaaguuggccacucaacgaggccguuauggccgugggcauggucucuauacuggcuuccagcuugcugaagaaugacaucccgaugaccgggccuuuaguagcaggaggucuccugacggugugcuauguucuuacaggcaggucggccgaucuggaauuggagaaagcggcugacgugaagugggaggaucaggccgaaauuucagggucuagucccauccucuccauuaccaucagcgaggacggaucuaugagcauaaagaacgaagaggaggaacacacucugacaauccuaauucgaaccggccugcuugucaucuccgguguguuuccaguaucaauucccaucacugcagccgcuugguaccucugggaggugaaaaagcagcgcgcagggguccugugggauguuccuaguccacccccugugggaaaagccgaauuggaggacggcgcguaucggauaaagcaaagaggcauuuucggguacagccagaucggagcugguguguauaaagaaggcacauuucauaccauguggcacgucacgagaggggccguguuaaugcaucguggaaagcgcaucgagccgucuugggcagauguuaagaaagaccugauuuccuacggcgguggguggaagcucgagggagaauggaaagagggcgaagagguacaggugcuggcccuugaaccaggcaagaauccccgggcuguccagacuaaaccugggcuguucaagaccaacacaggaaccaucggugccgugucauuggauuucaguccaggcacaagcgggucccccauaguugacagaaagggaaaaguggucggccuauacgguaauggggugguaacuaggucuggagcauaugucucggcuauugcccaaaccgagaaaagcaucgaagauaacccugaaauugaggacgauaucuuucggaaaaagagacugacgauaauggaccuccacccgggcgcgggcaaaacaaagcgcuaccugcccgccauugugagagaagcaaucaagagggggcuucggacuuuaauccuggcuccaacccgaguuguggccgcugagauggaagaggcacucagaggauugccuauucgcuaucagacacccgccaucagggccgagcauaccggucgugaaauugucgaccugaugugucacgcuacuuucaccaugcggcuccugucaccagugagaguuccuaacuacaaucuuauaaucauggaugaggcgcacuuuacagaccccgcauccauugccgcuaggggcuauaucaguacgcgcguggaaaugggggaggccgcaggaaucuucaugacugccaccccaccgggcucucgagauccuuuuccccagagcaacgcuccaauuauggacgaggaaagagagauacccgaacgguccuggaacucaggucaugagugggucacagauuucaaagggaagaccgugugguuuguaccuucuaucaaagcgggaaacgacauugccgcaugccugaggaagaauggcaaaaaggugauccaguugagccgcaagacuuucgauagugaauacguuaaaacacgugcuaacgacugggauuuugucgugaccacggacauuuccgagaugggcgccaauuucagagcagagcgggugaucgauccaaggcgcuguaugaagcccgucauacuaacugacggggaagaacgaguaauccuggccggaccuaugccggugacacacagcucugcugcccaaagacgggguaggauuggccgcaaccccaaaaaugaaaacgaccaguauaucuacaugggggagccccucgaaaaugaugaggacugcgcgcauuggaaggaggcaaaaauguuacuggauaacauuaauaccccugaaggaaucauacccucaauguuugagccagaaagagagaagguugacgccauugauggcgaauacaggcuucggggugaggcucguaaaaccuucguggaccugaugcgccgaggggaucucccugucugguuggccuauagaguggcugcagagggcaucaacuacgccgacaggcggugguguuucgauggaauuaagaauaaccagauccuggaagagaacguugaaguggagauauggacuaaggagggcgaacgcaaaaagcucaaacccagauggcuggacgcuaggaucuauuccgauccacuugcccuaaaggaguuuaaagaguucgcagcggggcggaagagucugacauugaauuuaauuaccgagaugggacgacugccuacauuuaugacucaaaaggccagagacgcucucgauaaccuggccguccuucacacggcagaaguggguggccgcgcuuacaaucacgcccugagcgagcucccggagaccuuggaaacacugcuacugcucacucuucuggcaaccguaacagggggaaucuucuuauuuuugaugucgggcaaagguauugggaagaugacccugggcaugugcugcaucauaacugccucuauucuccugugguaugcucagauccagccccauuggaucgcggccuccauuauccuugaguucuuucugauagugcucuugauuccagaaccugagaaacagaggacgccccaagacaaccagcugaccuacguugucaucgcaauuuuaacagugguggcugccacuauggccaaugaaaugggauuccuagagaagaccaaaaaggaccugggccucgggagcaucacaacccaggagucagaaaguaacauacuugauaucgaccugcggccagcaucugcuuggacuuuguaugccgucgcgacaacguuuguuaccccuaugcugcgucacuccauugagaauagcucagugaacguaagucucacugcuaucgccaaucaggcaacagugcugaugggacuugguagaggcuggccccucagcaagauggauauuggggucccgcuguuggccaucggauguuacucccaagugaacccaauuacccugaccgcugcauuacuacugcucguugcccauuacgcgaucauaggcccuggucuucaggcuaaagccacaagggaagcacagaagcgcacugccgcugggauuaugaaaaaucccacgguggacggcaucaccgucaucgaucuggagccaauucccuaugacccuaaguucgaaaaacaguugggacaaguaaugcugcucgugcugugcguuacacaggugcuuaugaugcggacuaccugggccuuaugugaggcacugacacucgcuaccggcccgauaucuacuuugugggaggggaaccccggacgauuuuggaauacgacaaucgccgucagcauggcgaacauuuucagaggcuccuaccuggccggugcagggcuacuguuuucaaucaugaagaauaccacuaacaccaggcgcggaacaggcaauauuggugaaacucucggcgagaaguggaaaucucggcuuaacgcucuggggaagagugaguuccagaucuauaaaaagucgggaauacaggagguggauagaaccuuggccaaagagggcaucaagcguggggaaacagaccaccaugcagucagcaggggauccgcuaaacugcggugguucguggagcgcaacaugguuacgccagaaggcaaggugguagaucucgguugcgggcgaggaggcuggucuuacuauugugguggccugaagaaugugagagaggucaaaggguuaaccaagggaggcccugggcacgaagaaccaauuccuaugucaacuuacggauggaaccuuguuaggcugcaaagcggcguggacgucuuuuucacaccacccgagaaaugcgauacccuccuaugugacaucggugaauccaguccuaauccaacuauugaggccgggcggacacugcgcguguugaaccugguagaaaauuggcucaacaauaacacccaguuuugcgugaagguucuuaaucccuauaugccgucugugaucgagaaaauggaaacgcugcagagaaaguacggaggcgccuuggucaggaacccucugagccgaaauucaacccacgagauguacuggguguccaacgcgacaggcaauauagucaguagcgugaacaugauuucucggaugcucaucaaucguuucacuaugaagcauaaaaaggcuaccuaugagccagauguugacuuaggguccggaacaagaaacaucgguauugaaaacgagauacccaaucuggacaucauuggcaaacgcaucgaaaagauuaaacaagagcacgaaacuucauggcauuacgaucaggaccacccuuauaagaccugggcauaccacgggagcuaugagacaaagcagaccggaucggccucuaguaugguaaacggcguggucaaacuucugacuaagccaugggaugugguucccauggugacgcagauggcuaugacagacaccacuccguuuggucaacagagggucuucaaagagaagguggauacccggacacaggaaccuaaagaggggacgaagaagcuaaugagaaucaccgccgaauggcucuggaaagagcugggaaagaaaaagacuccccgcauguguacaagggaggaauuuacccgaaaaguacgguccaaugcagccuugggcgcuauauucacugacgagaacaaguggaaaagcgcgagagaagccguggaggauucaagguuuugggaacugguugaccgcgagcguaaucuccaucuugagggcaagugcgaaacaugugucuacaacaugauggggaagcgggagaaaaagcugggagaguucgguaaagcaaagggcuccagagcuaucugguauaugugguuaggggccagguuucuggaguucgaagcauugggauuucucaaugaggaucacugguucucucgcggcaacagccugagugguguggagggggaaggacuacauaaacuuggcuacauucugcgagacguguccaagaaggagggcggggccauguacgcugaugacaccgccggaugggacacacggaucacucucgaagaucugaaaaaugaggaaauggucaccaaccacaugaagggugagcauaaaaaguuggcggaggcaauuuucaaacugacguaucagaauaagguugugagaguacaaaggccaaccccucgcggcacagugauggacaucauuagcagaaaggaucagcgggggucuggacaggucggcacuuacggucucaacaccuuuacaaauauggaagcccagcuuauaaggcaaauggagggggaaggaaucuucaaaucaauucagcgucugacugugaccgaggagaucgcuguucagaacugguuagcccgagugggccgcgaaagacugagucggauggcaaucuccggcgacgauugcgucgugaagcccuuggacgauagguuugcuagcgcccucacggcucugaaugacauggggaaaguacgcaaggauauucaacagugggagccaucuagaggauggaacgacuggacacagguucccuucugcucgcaccacuuucaugagcuagugaugaaagauggucggaugcuugucgugccuuguaggaaccaggacgagcugauaggccgagcccguaucucacaaggggcaggauggagccucaaggaaaccgcgugccugggcaaguccuaugcccagauguggacuuugauguacuuccacagacgcgauuuacggcuggcugccaaugcaauuuguagugcugugccaucucauugggucccgacaagcaggaccacuugguccauccacgccaaacacgaguggaugaccacagaggacaugcucgcaguuuggaacagaguguggauucaggaaaaucccuggauggaggacaagacgccuguagaaucaugggaggaagugccauaucuugguaaacgcgaggaucaguggugcgggagucugaucggacuaaccucucgggccacuugggcgaagaacauacaaacagcuaucaaucaggucaggagccugauuggcaacgaggaauacaccgacuauaugcccuccaugaaacgauuuagaaaggaggaagaggaagccggcgugcucugguga

SEQ ID NO: 14681 - RNA, 9876 nt, Artificial Sequence
  derived and/or modified CDS sequence (opt3) from DENV-2__EU596490__SS-prME
accgccggcgugaucauuaugcugauacccacagucauggcuuuccaccucacuacgagaaacggggagccucauaugaucguuggaaggcaggaaaaggguaaaagccuucuguuuaagaccgaggacggcgugaauaugugcacauugauggcaauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcccuggucccccauguggguauggggcuugagaccagaacagaaacuuggaugaguagcgagggagcguggaaacacguucagaggaucgagaccuggauacugcggcauccuggcuucacaaucauggcugccauuuuggcauacaccaucggcacgacucacuuucagcgcgcccucauuuucauccugcugacagcuguggcaccauccaugaccaugagaugcauagggauuucuaacagggauuuugucgaaggagugucggguggcucauggguagacaucguucucgagcacgggagcugugugacuacaauggccaagaauaagcccaccuuagauuucgaacugauuaaaacggaggcuaagcagccugccacccuucggaaauauugcaucgaagcgaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggauugugaccugcgcaauguuuacaugcaaaaagaauauggaaggaaaagugguccucccugagaaccuggaauacaccauaguuaucacuccacacagcggugaggagcaugccgugggcaaugacacggggaagcacggaaaagaaauuaagaucacaccgcaguccucaauaaccgaggcugaacuuacuggcuaugguaccguaacaauggaguguagucccaggaccgggcuggauuucaacgaaaugguguugcuccagauggaggacaaagccuggcugguccaccggcaaugguuuuuagaucugccucucccauggcuucccggcgcagacacucagggaagcaauuggauucagaaggagacacuggugacguucaagaacccucaugcuaaaaagcaggacguuguggucuugggcucucaagaaggggccaugcacaccgcgcuaacuggagccacagagauccagauguccucagguaaucugcucuuuaccggccaucugaaaugccgucuucgcauggauaagcugcaguugaaagggaugagcuacaguauguguacaggaaaguucaagaucgugaaagaaauugcagagacucaacacggcaccaucguaauuagaguucaguaugagggugacgggucuccaugcaagauacccuucgaaaucauggaucucgagaaaaggcaugugcugggccgguuaauuacggucaacccgaucgugaccgaaaaggacuccccugucaacaucgaggcugaacccccauuuggagauagcuacauuauaaucggcguggagccugggcagcugaaacuaaauugguucaagaagggaucgucuauuggucagauguuugagacaacuaugcgaggcgccaaacgcauggcuauccucggggacaccgccugggauuucggaucccugggcgguguuuuuacaucaauugggaaggcacuucaccaaguguucggcgccaucuacggagcugcguuuaguggcguaagcuggacuaugaaaauauugaucggggucauuaucaccuggauuggaaugaacuccagaucuacgagccugucagugagucucguucuggugggcgucgugacacuuuaucuggguguaauggugcaggcagacaccggguguguugucuccuggaagaauaaagaauugaagugcggaagcggcaucuucauaacugauaacgugcacacauggaccgagcaguacaaguuucagcccgaaucuccaucaaaacucgccagugcuauucaaaaggcccaugaggaagguaucuguggcauuaggagcgugacucggcuggagaauuuaauguggaaacagaucacccccgagcugaaccacauacuauccgaaaaugaggucaagcucacaaucaugacgggggacauuaaaggaaucaugcaggcaggcaagcgcucucugagaccucagccaaccgaacuuaaauauucguggaagacuugggggaaggccaaaauguugagcacagagucccauaaccaaaccuuccugauugauggaccggaaacagcugagugccccaauacuaacagggccuggaauucacucgagguugaagacuacggcuuugguguguucaguaccaacaucuggcugaaguuacgugagaaacaggacguguuuugugauucuaagcugaugagcgcagcgauaaaagacaaucgggcuguacacgccgauaugggguauuggauugaauccgcacuuaacgacacguggaagauggagaaggccucauucaucgagaucaaaagcugccacuggccuaagucucauacauugugguccaauggaguccucgaaagugagaugauuaucccaaaaaacuucgcuggccccgugagccagcacaacuaccgaccugguuaucauacccagacugccggcccauggcaccuggggaagcuagaaauggauuuugacuucugugagggaaccacaguuguggucacugaagauugcggcaauagagggcccucucugaggaccacaacggcauccggaaaacucauuaccgaguggugcugucgcucaugcacucugccgccucuucgguacagaggcgaggacgguuguugguacgggauggaaauaaggccauugaaggagaaggaagagaaccuggugaauaguuuaguuacagcuggacauggccaaaucgauaacuuuagccucggugugcugggcauggcccuuuuccuggaagagauguugcgcacccgaguagggacuaaacacgcgauucuccuggucgccgugucguuugugacacuaaucaccggaaauauguccuuccgggaccugggccgugucaugguuauggugggggcuacgaugacugaugacauuggaaugggcguaaccuaucucgcacugcuugccgcuuuuaaggugagacccacauucgccgcagguuugcuguuaaggaaacucaccucuaaggagcugaugauggcgacuaucgggauagcccuucugagccagucaacaaucccugaaaccauucuagagcucacagaugcucuggccuugggaaugaugguccugaaaaucgugcgcaacauggaaaaguaccaguuagcaguuacuauuauggcuaucaguugcgugcccaaugccgucauacuccaaaacgcauggaagguguccuguaccauucuggccgcuguuucugugagcccacuucuguugacguccucacagcagaaagcggacuggaucccucucgcccugacaaucaagggccuaaaucccaccgcaauuuuucugacuacccuuagccggacaaguaaaaagagaucuuggccacucaacgaggcugucauggccguaggcaugguguccauacuggccagcucguugcugaaaaaugacaucccgaugacugggccuuuaguugcuggaggucuccugaccgugugcuauguccuuacgggcaggucagcagaucuggaauuggagcgagccgcggacgugaagugggaggaucaggcugaaauuucugggaguucccccauccucagcauuacaaucucugaggacggaagcauguccauaaaaaacgaagaggaggaacacacccugacuauccuaauucgcacaggccugcuuguaaucucagguguguucccagucaguauucccaucaccgccgcagccugguaccucugggagguuaagaagcaacgggcuggggugcugugggaugugccuagcccacccccugucggaaaagcagaauuggaggacggcgccuauagaauaaagcagaggggcauuuuuggguacucucagaucggagcggguguguauaaagaaggcacuuuccauacaauguggcacguuacccguggggcuguauuaaugcaucgcggaaagcggaucgagccguccugggccgaugugaaaaaggaccugauuucauacggcgguggguggaagcucgagggagaauggaaagagggcgaagagguccaggugcuggcacuugaaccaggcaagaaucccagagccguucaaacgaaaccugggcuguuuaagacuaacaccggaacaaucggugcugugaguuuggauuucagcccaggcaccuccgggucucccauagucgacaggaaaggaaaggugguaggccuauacgguaauggggucgugacacgaucgggagccuauguuagcgcaauugcucagacugagaagucaaucgaggauaacccugaaauugaggacgauaucuuccggaaaaagcgccugaccauaauggaccuccacccgggcgccggcaaaacgaagagauaccugcccgcgauugugagggaagccaucaaacgggggcuucgaacauuaauccuggcaccaacuagagucguggcugccgagauggaagaggcucuccgcggauugccuauuagguaucagacccccgcaauccgugccgagcauacaggucgggaaauuguugaccugaugugucacgccaccuuuacuaugagacuccuguccccagugagggucccuaacuacaaucuuauaaucauggaugaggcucacuucaccgaccccgcgaguauugcagcccgcggcuauaucucuacacgaguggaaaugggggaggcugccggaaucuuuaugacggcaacuccaccgggcagcagagauccuuucccccaguccaacgccccaauuauggacgaggaacgggagauacccgaaaggucauggaauucuggucaugaguggguaaccgauuuuaaggggaagacagugugguucguuccuagcaucaaagcuggaaacgacauugcggccugccugcgcaagaauggcaaaaaggucauccaauugagucguaaaaccuuugauuccgaauacgugaagacuagagcaaacgacugggauuucguggucacaaccgacauuagcgagaugggcgcuaauuuucgggccgagaggguaaucgauccacgccgauguaugaagcccgugauacuaacggacggggaagagagaguuauccuggcaggaccuaugccggugacucacucuucagccgcucagcggaggggucgcauuggcagaaacccaaaaaaugaaaacgaccaguauaucuacaugggggagccccucgaaaaugaugaggacugcgcccauuggaaggaggcgaaaauguuacuggauaacauuaauacaccugaaggaaucauacccuccauguucgagccagaaagggagaaggucgacgcaauugauggcgaauaccggcuucguggugaggcccgcaaaaccuuuguggaccugaugcgaagaggggaucucccuguuugguuggcuuauaggguggccgcugagggcaucaacuacgcagaccggcgcugguguuucgauggaauuaagaauaaccaaauccuggaagagaacgucgaaguggagauauggaccaaagagggcgaaagaaagaagcucaaacccagguggcuggacgcccggaucuauagugauccacuugcucuaaaggaguucaaagaauuugccgcagggcgaaagagccugacuuugaauuuaauuacagagaugggaagacugccuaccuucaugacacagaaagcgcgcgacgcccucgauaaccuggcuguacuucacacugccgaaguggguggcagggcauacaaucacgcucugucggagcucccggagacguuggaaacccugcuacugcucacacuucuggccacuguuaccgggggaaucuuuuuauucuugaugucuggcaaggguauugggaagaugacacugggcaugugcugcaucauaaccgcauccauucuccugugguaugcccagauccagccccauuggaucgcugcgagcauuauccuugaguuuuuccugauaguccucuugauuccagaaccugagaaacaacggacuccccaggacaaccagcugacguacguggugaucgccauuuuaaccgucguugcagcuacaauggccaaugaaaugggauuucuagagaagacuaaaaaggaccugggccucgggucaaucaccacacaggagagugaaucuaacauacuugauaucgaccugcguccagccuccgcauggaccuuguaugcuguggccacuacauucguaacgccuaugcugagacacagcauugagaauucaagugugaacgucagccucaccgcgaucgcuaaucaagccacugugcugaugggacuugguaggggcuggccccucuccaaaauggauguuggggugccgcuguuggcaauuggauguuacucucaggucaacccaaucacacugaccgccgcuuuacuacugcucguagcacauuacgccauuaucggcccuggucuucaggcgaaggcuacccgcgaagcccagaagcggacagcagccgggauaaugaaaaaucccacuguggacggcauuacgguuaucgaucuggagccaauccccuaugacccuaaguuugaaaaacaauugggacaggugaugcugcucguccugugcgugacccagguccuuaugaugcgaacaacuugggcuuuaugugaggcccugacccucgcaacaggcccgauuagcaccuugugggaggggaaccccggaagauucuggaauacuacgauagcuguguccauggccaacaucuuuaggggcucauaccuggcgggugccgggcuacuguucucuauuaugaagaauacaaccaacacucgccggggaaccggcaauaucggugaaacacucggcgagaaauggaagaguagacuuaacgcacuggggaagucggaauuucagauuuauaaaaagagcggaauccaagagguugaucguacuuuggcuaaagagggcauaaagaggggggaaaccgaccaccaugccgugucccggggaucugcaaaacugcgcugguucguagagcgaaacauggugacaccagaaggcaaggucguugaucucgguugcgggagaggaggcuggucauacuauugugguggccugaaaaaugugagggaggucaagggguuaacgaagggaggcccugggcacgaagagcccaucccuaugagcaccuacggauggaaccuugugcggcugcaguccggcguagacguguucuuuacuccacccgagaaaugcgauacacuccuaugugacauuggugaaaguucuccuaauccaaccaucgaggcugggcgcacucugagaguuuugaaccugguggaaaauuggcucaacaauaacacacaguucugcgucaaggugcuuaaucccuauaugccgagcgucauugagaaaauggaaacccugcaaaggaaguacggaggcgccuuggugcgaaacccucugucacggaauuccacgcacgagauguacuggguuaguaacgccaccggcaauaucguaagcucugugaacaugauaucccguaugcucauuaauagauuuacaaugaaacauaagaaggcgacuuaugagccagaugucgacuuagggucaggaacccgcaacaucgguaucgaaaacgagauucccaaucuggacauaaucggcaaaaggauugaaaagaucaaacaggagcacgaaacaagcuggcauuacgaucaggaccacccuuauaagacuugggcuuaccacgggucguaugagaccaaacagacaggaucugcaaguuccauggugaacggcguugugaagcuucugaccaagccaugggaugucgugcccaugguaacucaaauggccaugacggacacaaccccguucggucagcagcggguguuuaaagagaagguugauacuagaacccaggaaccuaaagaggggacaaagaaacuaaugcgcauuacggcugaauggcucuggaaggagcugggaaagaaaaagacccccaggauguguacucgagaggaauucacacggaaagucagaagcaaugccgcauugggcgccaucuuuaccgacgagaacaaguggaaaucagcuagggaagcgguggaggauucccgcuucugggaacugguggaccgugagcggaaucuccaucuugagggcaagugcgaaacuugugucuacaacaugauggggaaaagagagaagaagcugggagaauuugguaaagccaagggcucuagggcaauaugguauaugugguuaggggcucgcuuccuggaguuugaagccuugggauuccucaaugaggaucacugguuuagccgaggcaacagucuguccgguguugagggggaaggacuacauaaacuuggcuacauccugcgggacgugagcaagaaagagggcggggcaauguacgccgaugacacagcuggaugggacaccagaauuacacucgaagaucugaagaaugaggaaaugguaacuaaccacaugaagggugagcauaaaaaguuggccgaggcgaucuucaaacugaccuaucaaaauaagguggucagggugcagcgcccaacgccuagaggcaccguuauggacauuaucucucggaaagaucagagggggucaggacaggugggcacauacggucucaacacuuucaccaauauggaagcacaacuuauucgucagauggagggggaaggaauauuuaagaguauccagcgacugacagucacugaggagauugccgugcaaaacugguuagcucgcguaggcagagaacggcuguccaggauggccaucagcggcgacgauugcguugugaagcccuuggacgaucgcuucgcaucugcucucaccgcccugaaugacauggggaaagucagaaaggauauccagcagugggagccaucgcggggauggaacgacuggacgcaggugcccuuuugcucacaccacuuccaugaacuagugaugaaagaugguaggguccuuguugugccuugucgaaaccaagacgagcugauuggccgugcuagaauaagccagggggccggauggucccucaaggaaacagcaugccugggcaaaaguuaugcgcagauguggaccuugauguacuuucaccgccgggauuuaaggcuggccgcuaaugccaucuguucugcaguaccaagccauugggugccgacuuccagaacaaccuggucaauucacgcuaagcacgaguggaugacuaccgaggacaugcucgccgucuggaaccgcguguggauccaggaaaaucccuggauggaggacaagacaccuguugaaaguugggaggaagugccauaucuugguaaacgggaggaucaauggugcgggucucugauuggacuaacgagcagggcaaccugggccaagaacauccagacugcgauaaaucagguccgaucccugaucggcaacgaggaauacacagacuauaugcccucaaugaaaagauuccggaaggaggaagaggaagcuggcgugcucugguga

SEQ ID NO: 14682 - RNA, 9876 nt, Artificial Sequence
  derived and/or modified CDS sequence (opt3) from DENV-2__EU596491__SS-prME
accgccggagugaucauuaugcugauacccacuguaauggcuuuccaccucacuacgagaaacggggagccucauaugaucguuggaaggcaggaaaaggguaaaagccuucuguuuaagaccgaggacggcgugaauaugugcacauugauggcaauugauuuaggggaacugugugaggacacuaucaccuacaaaugcccauuacuccggcaaaacgaaccggaggauauugacuguuggugcaauuccacaucuaccuggguaacuuauggaacauguaccacgacuggcgagcaccgccgagaaaagcguucaguggcccuggucccccauguggguauggggcuugagaccagaacagaaacuuggaugaguagcgagggagcguggaaacacguucagaggaucgagaccuggauacugcggcauccuggcuucacaaucauggcugccauuuuggcauacaccaucggcacgacucacuuucagcgcgcccucauuuucauccugcugacagcuguggcaccauccaugaccaugagaugcauagggauuucuaacagggauuuugucgaaggagugucggguggcucauggguagacaucguucucgagcacgggagcugugugacuacaauggccaagaauaagcccaccuuagauuucgaacugauuaaaacggaggcuaagcagccugccacccuucggaaauauugcaucgaagcgaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggauugugaccugcgcaauguuuacaugcaaaaagaauauggaaggaaaaauagugcagccugagaaccucgaauacaccaucgucauuacuccacacagcggugaggagcaugccguuggcaaugacacggggaagcacggaaaagaaaucaagauaacaccgcaguccucaaccacugaggcugaacugaccggcuaugguacagugaccauggaguguagucccaggacugggcuugauuucaacgaaaugguacuguugcaaauggaggacaaagccuggcucgugcaccggcagugguuucuggauuuaccucugccauggcuccccggcgcagacacacagggaagcaauuggauucagaaggagacgcuugucaccuucaagaacccucaugcuaaaaagcaagacgugguugugcugggcucucaggaaggggccaugcacacugcguugacaggagccaccgagauccagauguccucagguaaucuacuguuuacaggccaucucaaaugccgucugcgcauggauaaacuucaacugaaagggaugagcuacaguauguguacuggaaaguucaagaucgucaaagaaauugcagagacccagcacggcacgaucgugauuagaguacaguaugagggugacgggucuccaugcaagauacccuucgaaaucaccgauuuggagaaaaggcauguucucggccggcugauuacagugaacccgaucgucacugaaaaggacgcuccugugaacaucgaggccgaacccccauuuggagauuccuacauuauagucggcguggagccugggcaguuaaaacugaauugguucaagaagggaagcucgaucggucaaauguuugagaccacaaugcgaggcgcuaaacgcauggccauucuaggggacacugcaugggauuucggaucucucggcgguguuuuuaccuccaucgggaaggcccugcaccagguguucggcgcuauuuacggagcggcauuuucaggcguaaguuggacgaugaaaauccuuauaggggucaucauuacauggaucggaaugaacagcagauccaccucuuugagcgugucacugguucucgugggcgucgugacucuguaucuuggugccguagugcaggcugacaguggguguguugucuccuggaagaauaaagaacugaagugcggaagcggcauuuucaucacagauaacgugcacaccuggacugagcaguacaaguuucaacccgaaucuccaucaaaauuggccagugcaauacagaaggcccaugaggaagguauuuguggcaucaggagcgugacccggcucgagaaucugauguggaaacagauuacacccgaguuaaaccacauccuguccgaaaaugaggucaagcuaacgauaaugaccggggacaucaaaggaauuaugcaggcuggcaagcgcucucucagaccucaaccaacugaacugaaauauucguggaagacaugggggaaggccaaaaugcuuagcaccgagucccauaaccagacauucuugaucgauggaccggaaacugcagagugccccaauaccaacagggcguggaacucacuggagguugaagacuacggcuuugguguguucacgacaaacauuuggcucaagcugcgugagaaacaggacguguuuugugauaguaaguuaaugucugcugccaucaaagacaaucgggcaguacacgccgauaugggguauuggauagaaagcgcucugaacgacaccuggaagauggagaaggccuccuucauugaggucaaaucaugccacuggccuaagagccauacucuuuggucuaauggaguguuggaauccgagaugaucauccccaagaauuucgcaggccccguuagucagcacaacuaccgaccugguuaucauacccaaacagcuggcccauggcaccucgggaagcuggaaauggauuuugacuucugugagggaacuaccguggucgugacagaagauugcggcaauagagggcccagccuaaggacgaccacugccucuggaaaacugauuacagaguggugcugucgcuccugcacccucccgccucugcgguacagaggcgaggacgguuguugguacgggauggaaaucaggccacuuaaggagaaggaagagaacuugguuaauucacuggugacugcgggacauggccagauugauaacuuuaguuuagguguacucggcauggcccuguuccuugaagagaugcugcgcacacgagucgggaccaaacacgcuacguugcucguggcacugagcuuugugacucuaauaaccggaaauaugucguuccgggaccugggccgugucaugguuauggugggggccacaaugaccgaugacaucggaaugggcguaacuuaucucgcucugcuugccgcauuuaaggugagacccacauucgcggccgguuugcuguuaaggaaacucaccuccaaggagcugaugauggcuacaauugggaucgcccuucugucucagagcacucuaccugaaaccauucucgagcugacggaugcauuggcucugggaaugauggucuuaaaaaucgugcgcaacauggaaaaguaccaacucgccguuacaauaauggcaaucucaugcgugcccaaugccgucauucugcagaacgcuuggaaggugaguuguaccauccuugcggccguuuccgugucuccacuguugcucacuagcucccagcagaaagcagacuggauuccucuggcucuaaccaucaagggccugaaucccacagccauauuucuuacuacccucucacggacgagcaaaaagagaaguuggccacugaacgaggccauuauggcugucggcaugguaucuaucuuggcauccagccugcuaaagaaugacaucccgaugacagggccucucguggccggaggucugcuuaccguuugcuaugugcugacuggcaggucggcggauuuggaacucgagcgagcugccgacgucaagugggaggaucaagcagaaauuucagggucuagucccauacuguccaucacaauuagcgaggacggaucuaugagcaucaaaaacgaagaggaggaacagacccuaacuauucugauccgcacaggccuucucgugauauccgguguauucccagugucaauccccauuaccgccgcugcaugguaccugugggaggucaagaagcagcgggccgggguuuugugggaugugccuaguccacccccugugggaaaagcggaauuagaggacggcgcuuauagaaucaagcagaggggcauucugggguacagccaaaucggagccggugucuauaaagaaggcacguuucacacuauguggcaugugacccguggggcaguucucaugcaccgcggaaagcggauagagccgucuugggccgaugucaaaaaggaccugauuuccuacggcgguggguggaaacuugagggagaauggaaagagggcgaagaggugcagguccuggcuuuggaaccaggcaagaaucccagagccgugcagacaaaaccugggaucuucaagaccaacacaggaacuaucggugcaguuucacuagauuuuaguccaggcaccagcgggucccccauuguggacaggaaaggaaaggucgugggccuguacgguaaugggguagucacgcgaucuggagcuuaugugucggccaucgcgcagacagaaaagagcauagaggauaacccugaaauugaggacgauaucuuccggaaaaagcgccucacuauuauggaccugcauccgggcgccggcaaaaccaagagauaccuucccgcaaucguuagggaagcuauaaaacggggguuacgaacacugauucucgccccaaccagaguggucgcugcagagauggaagaggccuugcgcggacugccuaucagguaucaaacucccgccauccgugcugagcacaccggucgggaaauuguggaccucaugugucaugcgacauucacgaugagacugcuuucaccaguuagggugccuaacuacaaucugaucauuauggaugaggcacacuuuacugaccccgccuccauagcugcccgcggcuauaucaguacccgagucgaaaugggggaggcagccggaauuuucaugacagcuaccccaccgggcucuagagauccuuuuccccagagcaacgcgccaaucaucgacgaggaacgggagauucccgaaagguccuggaacucaggucacgagugggugacugauuucaaggggaagacaguaugguuugugccuucuauaaaagccggaaacgacaucgcagcuugcuugcgcaagaauggcaaaaagguuauucagcuaagccguaaaaccuucgauagugaauacgucaagacgagagccaacgacugggauuuuguggugacuacagacaucuccgagaugggcgcaaauuucaaggccgagcgggucauugauccaaggcgcuguaugaaacccguaauccugaccgacggggaagaacgagugauacucgcuggaccuaugccgguuacccauagcucugccgcgcaaagacgggguaggaucggccgcaacccaaagaaugaaaacgaccaguauauuuacaugggggagcccuuagaaaaugaugaggacugcgcacacuggaaagaggccaagaugcugcuugauaacaucaauacuccugaaggaauuauccccucaauguuugagccagaaagagagaaaguggacgcugucgauggcgaauacaggcugcggggugaggcccguaagacauucguggaccucaugcgccgaggggauuugccuguuuggcuggcuuauaaaguggcagccgagggcauaaacuacgcugacagaaagugguguuuugauggaauuaagaauaaccagauccucgaagagaacgucgaaguggagauuuggaccaaagagggcgaaaggaagaaacugaagccccgguggcuugacgcccgcaucuauuccgauccacuagcacugaaagaguucaaggaguucgcggccgggagaaagaguuugacauuaaaucugauaacugagaugggaaggcucccuacguuuaugacccagaaagcucggaacgcccuggacaaucuugcaguacugcauacagcugaaguggguggccgagcccacaaccacgcacucagcgaguugccggagacucuggaaacccuacugcuccuuacacuguuagccaccguuacugggggaaucuucuuguuucugaugucgggcaaggguauugggaaaaugacgcucggcaugugcugcaucauuaccgcuucuauccugcuuugguacgcgcaaauacagccccauuggauugccgcauccaucauccuggaguucuuucucauugucuugcugaucccagaaccugagaagcagagaacaccccaggauaaucaauuaacuuauguggugauagcuauucuaaccgucguugccgccacaauggcaaacgaaaugggauuccuggagaaaaccaagaaggaccucggcuuugggagcaucacuacacaggagucagaaaguaauauucuugacaucgaucugcgcccagcuucugccuggacguuguacgcgguggcuaccacuuucguaacaccuaugcugaggcacuccauagagaacagcucagugaaugucagucucaccgccaucgcaaaccaggccaccgugcugaugggacuugguaaaggcuggccccucagcaagauggacauugggguuccgcuguuggcuaucggauguuauucccaggugaauccaauuacacugacugcagccuuacuacugcucgucgcgcauuacgcuaucauuggcccuggucuucaagccaaagcaacgcgggaagcccagaagcgugcugccgcagggaucaugaaaaaccccaccguagauggcauaacagugauugaccuggagccaauccccuacgauccuaaguuugaaaagcaguugggacagguuaugcugcucauccugugcgugacucaaguccuuaugaugagaaccacaugggcuuuaugugaggcccugacccucgcgacuggcccgauuucuacguugugggaggggaaucccggaagguucuggaacacaaccauagccgugagcauggcaaauaucuuucgcggcuccuaucuggcuggugccgggcuacuguucucaauuaugaaaaacacuaccaauacacggcgaggaacuggcaacgucggugaaacccucggcgagaaguggaaaucuagacuuaacgcacuggggaagagugaauuucagaucuacaaaaagucgggcauucaggagguggacaggacauuggcuaaagagggcaucaagcgcggggaaacggaucaccaugccguuagccggggauccgccaagcugagaugguucguggagcguaauaugguaaccccagaaggcaaaguggucgaccucgguugcgggaggggaggcuggucuuauuacugugguggccugaagaacguucgggaggugaaaggguuaacuaagggaggcccugggcacgaggaaccaauaccuaugucaacauauggauggaaucuuguccgccugcaaagcggcguggauguauucuuuaccccacccgagaaaugcgacacucuccuaugugauaucggugaauccaguccuaacccaacaauugaggcggggcgaacccugagaguguugaaucugguugaaaacuggcucaauaacaauacgcaguucugcaucaaggugcuuaaccccuacaugccgucugucauugagaagauggaaacccugcagaggaaauauggaggcgcuuuggugcggaauccucugagccgcaacucaacacacgagauguacugggucuccaaugcaacuggcaacaucgugaguagcguuaauaugauaucuagaaugcucauuaacagguuuaccaugaagcauaaaaaggccacauacgagccagacguagauuuaggguccggaacucgaaacaucgguaucgaaucagagauucccaaucuggacauaaucggcaaacggauugaaaagaucaagcaggagcacgaaaccagcuggcauuaugaccaagaucacccuuacaaaacaugggcuuaucacgggucguacgagaccaagcagacuggaucugccaguuccauggugaacggcgucgugcgucuucugacgaaaccaugggacguugugcccauggucacacagauggcaaugaccgauacuaccccguucggucagcaaagaguguuuaaggagaaaguagacacacgcacgcaggaaccuaaggaggggaccaagaaacuaaugaagauuacugccgaauggcucuggaaagagcugggaaagaaaaagacacccaggauguguacccgggaggaguucacuagaaaagugcgcagcaaugcugcguugggcgccaucuuuacagaugagaacaaguggaagucagcaagggaagcuguugaggacggccgauucugggaacuggucgaucgggagagaaaucuccaucuugaggggaaaugcgaaaccuguguguauaacaugaugggaaagagggagaaaaagcugggugaauuuggcaaagccaaggggucccgcgcaauaugguacaugugguuaggagcccguuuccuggaguuugaggcuuugggcuuccucaaugaggaccacugguuuucucgggguaacagccugagugggguggagggagaaggccuacauagacuuggcuauauccugagggaggucgggaagaaagaaggaggugccauguacgcggaugacacagcaggcugggauacucgcauuacccucgaggaccugaagaaugaagagaugguuacgaaccacaugaaaggggagcauaagaaauuggccgaagcuaucuucaagcugaccuaccagaauaaggugguacgagugcagcggccaacaccuagaggaacugucauggacauuaucuccaggaaagaucaacgcggcagcggucagguggggaccuauggacucaacacauucacuaauauggaggcccagcuuauuagacaaauggaaggcgagggcauauuuaagucuauccagcaccugaccgcaacggaggaaauugcuguucagaacugguuagcccggguggggagggagcgucugucacgaauggcuaucaguggagacgauugcgucgugaaacccaucgacgaucgcuucgccuccgcauugacagcgcucaaugacauggguaagguaagaaaagauauucagcaaugggaaccaagccggggcuggaacgacuggacccagguucccuuuugcucucaccauuuccacgagcuggugaugaaggaugggaggguccuaguggugccuugucgcaaccaggacgaacuuauaggcagagcacggaucucgcagggagcugguuggucacugaaggagacugccugccucgggaaaagcuacgcacaaauguggacacugauguauuuucauaggcgagauuugcguuuagcugccaaugcaauuuguuccgccgucccaagucacuggguuccgaccucuagaacuaccuggagcauccacgcgaagcaugaguggaugacaacggaagacaugcuggcuguguggaaccgcguauggauucaggagaaucccuggauggaagauaaaaccccuguggaguccugggaagaggucccauaccucggaaagcgggaggaccaguggugcggcucacuuaucggccugacaaguagggccacaugggccaaaaauauacagaccgccaucaaucaagugagaucucuaauugggaacgaagaguauacugacuacaugcccagcaugaagcgcuuccggagggaagaggaagaggcuggaguucugugguga

SEQ ID NO: 14683 - RNA, 9876 nt, Artificial Sequence
  derived and/or modified CDS sequence (opt3) from DENV-2__EU677141__SS-prME
accgccggcgugaucauuaugcugauacccacagcuauggcauuccaccucacuacgcggaacggggaaccucauaugaucgucggaaggcaggaaaaggguaaaagccuucuguuuaagaccgaagacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggauuauucggcaagggcgggauugucacaugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccugacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaagguacguucugggccgguuaauuacggugaacccgaucgucaccggaaaggacuccccugugaacaucgaagccgagcccccauuuggcgauagcuacauuauaaucggggucgaaccuggacagcugaaacuaaauugguucaagaaggguucgucuauuggccagauguuugagacaacuaugcgaggggcuaaacgcauggccauccucggagacaccgcaugggauuucggcucccugggugggguguuuacaucaauuggcaaggcccuucaucaaguuuucggagcuaucuauggcgcggcauuuaguggggugagcuggacuaugaaaauauugaucggaguaauuaucaccuggauuggcaugaacuccagaucuacgagccugucagucagucucgugcugguugguguggucacacuuuaccugggggugaugguacaggccgacuccggaugugugguuagcuggaagaauaaagaguugaagugcggcucugguaucuucauaaccgauaacguccacacuuggacagaacaguauaaguuucagcccgagucaccaaguaaacucgcuagcgccauucaaaaggcacacgaagagggcaucugugggauuagguccgugacccggcuggaaaauuuaauguggaaacagaucacucccgagcugaaccauauacuaucugagaaugaagugaagcucaccaucaugacaggagacauuaaaggcaucaugcaggccgggaagcgcucgcugagaccucagccaacggagcuuaaauacagcuggaagaccuggggaaaggcuaaaauguuguccacugaaucacacaaccaaacauuccugauugauggcccggagaccgccgaaugccccaauacaaacagggcauggaauagucucgaggucgaggacuaugguuuugggguuuucucuacuaacaucuggcugaaguuacgugaaaaacaggacguguuuugugauagcaagcugauguccgcggcuauaaaagacaaucgggccgugcaugcagauaugggauacuggauugagucagcccuuaacgacaccuggaagauggaaaaggcuagcuucaucgagguaaaaucuugccacuggccuaagucccacacguuguggaguaauggcguccucgagagcgaaaugaucauucccaaaaauuucgccggucccgugucucagcauaacuaucgaccuggcuaccacacacagaccgcagggccauggcaucugggaaagcuagagauggauuuugacuucugugaaggcacuaccguuguggucacagaggauugcgggaauagaggacccucccugaggacuaccacagcuucaggcaaacucaucacggaauggugcugucgcaguugcacccugccgccucuucgguacagaggugaggacggguguugguauggaauggagauuaggccauugaaggaaaaggaggaaaaccuggugaauagcuuaguuacugccggccacggucaaauagauaacuuuucgcucggcgugcuggggauggcgcuuuuccuggaggaaauguugcgcacacgaguaggaaccaaacaugccauccuccuggucgcuguguccuuugugacucuaauuacaggcaauaugucuuuccgggaccuggggcgugucaugguuauggugggagcaaccaugacggaugacaucggcauggguguaacuuaccucgcccugcuugcugccuuuaaggugagacccaccuucgcagcgggguugcuguuaaggaaacucacaagcaaggagcugaugauggccaccauuggaaucgcacuucugucacagaguacuauaccugagacaauccuagaacucaccgaugcccuggcauugggcaugaugguccugaaaauugugcgcaacauggagaaguaucaguuagcuguuacaaucauggccauucucugcgugcccaaugcagucauccugcaaaacgccuggaagguguccuguacuauacuugcugcgguuucugugagcccacuguugcucaccuccucacagcagaaagccgacuggauuccucuggcacuaacgaucaagggccugaaucccacagcuaucuuucuuaccacucucagccggaccaguaaaaagagaucuuggccacugaacgaagccgucauggccguagggaugguguccauuuuggcuagcucgcugcucaaaaaugacauaccgaugacaggaccucuaguugcugguggccugcuuacugugugcuacguccugaccgggaggucagccgauuuggagcucgaacgagcggcugacgugaagugggaggaucaggccgagaucucuggaaguucccccauucugagcaucacgauuucugaagacggcagcauguccaucaaaaacgaggaagaggagcaaacacuaaccauacugauccgcacuggucuucucguaauuucagggguguucccagucaguauccccauuacagcagccgcuugguaucugugggaaguuaagaagcagcgggcaggaguguugugggaugugccuagcccacccccugucggcaaagccgaguuagaagacggcgcguacagaaucaagcagagggggauauuuggauauucucagauuggugcuggcguguacaaagaggggaccuuccacacuauguggcacguuacacguggagccguacugaugcaucgcggcaagcggaucgaaccguccugggcagaugugaaaaaggaccucaucucauacggugggggauggaagcuggagggcgaguggaaagaaggcgaggaaguccaagugcuugcccuggagccagggaagaaucccagagcuguucagaccaaaccuggauuguuuaagacgaacacugguaccauuggcgccgugagucuagauuucagcccagggacauccggaucucccaucgucgacaggaaaggcaaggugguaggucuguaugggaauggagucgugacccgaucgggcgcauacguuagcgcuauagcccagacagaaaagucaauugaggauaacccugagaucgaagacgauauuuuccggaaaaagcgccucacuaucauggaccugcacccgggcgcggggaaaaccaagagauaucuucccgccauagugagggaggcaauuaaacggggauuacgaacgcugauccucgcuccaacaagagucguggccgcugaaauggaggaagcauugcgcggucugccuaucagguaccagacucccgccauucgugccgagcauaccggccgggagaucguugaccucaugugucacgcuacauuuaccaugagacugcuuuccccagugagggucccuaacuauaaucugauuauaauggaugaagcgcauuucacugaccccgcaaguaucgccgcucgcggguacauuucuacccgaguggagaugggagaagccgcaggcaucuuuaugacagccacgccaccggguagcagagauccuuucccccaauccaacgcuccaaucauggacgaggagcgggaaauucccgagaggucauggaacucugggcacgaauggguaacugauuuuaagggaaagaccgugugguucguuccuagcauaaaagcgggcaacgacaucgccgcaugcuugcgcaagaauggcaaaaaggucauucagcuaagucguaaaacauuugauuccgaguaugugaagaccagagcuaacgacugggauuucguggucacuacagacaucagcgaaaugggggccaauuuucgggcagagaggguaauugauccacgccgauguaugaagcccgugauccugaccgacggagaggaaagaguuauacucgccgguccuaugccggugacgcacucuucagcugcccagcggaggggccgcaucgggagaaaccccaaaaaugagaacgaccaauacauuuacaugggagaacccuuagagaaugaugaagacugcgcgcauuggaaggaggcaaaaaugcugcuugauaacaucaauacuccugagggcauuauccccuccauguucgaaccagagagggaaaaggucgacgccauagauggugaguaucggcugcguggggaagcucgcaaaacauuuguggaccucaugcgaagaggcgauuugccuguuuggcuggccuacaggguggcugcagagggaauuaacuaugccgaccggcgcugguguuucgauggcaucaagaauaaccagauucucgaggaaaacgucgagguggaaaucuggaccaaagagggggagagaaagaagcugaaacccagguggcuugacgcucggauauacagugauccacuagcccugaaggaguucaaagaguuugcagcgggacgaaagagcuugaccuuaaaucugaucacugaaauggguagacucccuacauucaugacccagaaagcccgcgacgcucuggauaaccuugccguacugcacacagcagaggugggcgggagggcuuauaaucaugcccucucggaauugccggagacucuggagacgcuacugcuccuuacccuguuagcaacaguuacuggaggcauauuuuuguuccugaugucugguaaggggaucggcaagaugacccucggaaugugcugcauuaucacagccuccauacugcuuugguacgcucagauucaaccccacuggaucgcggccagcaucauucuggaauuuuuccucaucgucuugcugauaccagagccugaaaaacagcggaccccacaggacaaccaguuaacuuauguggugauugcaauccuaacggucguugcugccaccauggccaaugagaugggcuuucuggaaaagaccaaaaaggaccucgggcuuggaucaauuaucacucaagagagugagucuaacauacuggauaucgacuugcguccagcauccgcuuggacccuguacgccguggcgacaaccuucguaacuccuaugcucagacacagcauugaaaauucaagugugaacgucagccugacagcuaucgccaaucaggcaacggugcuuaugggucucggcaggggguggccccuguccaaaauggauauuggaguuccguugcuggccaucggcuguuacucucaggugaacccaauuaccuuaacugcugcacuacugcuccuugucgcccauuaugcgaucauagguccugggcugcaggcuaaggccacacgcgaggcacaaaagcgggccgcugccggcauuaugaaaaaucccaccguagacggaaucaccgugaucgauuuggaaccaauucccuacgacccuaaguuugagaaacagcugggccagguuaugcuccuggugcuuugcgucacacagguguuaaugaugcgaacuacgugggcacugugugaagcucucaccuuggccacagggccgauaagcacucugugggagggaaaccccggcagauucuggaauaccacaaucgcggucuccauggccaacauuuuuagggguucauaucuagcaggggcuggacuacucuucucuaucaugaagaauaccacuaacacgcgccggggcacagguaauauuggcgagacccuuggggaaaaauggaagaguagacugaacgccuugggaaagucggaguuucaaaucuacaaaaagagcggcauacaggaaguggaucguacucuggcaaaagaggggaucaagaggggagagaccgaccaccaugcuguuucccggggcucugccaaacuccgcugguucguggaacgaaacaugguaacaccagaggguaagguggucgaucuggggugcggaagaggcgguuggucauauuacuguggcgggcuuaaaaauguuagggaagugaagggacuaacuaagggcgggccuggacacgaggaacccauuccuaugagcaccuauggcuggaaccugguccggcuccaguccgguguggacguauucuuuacaccacccgagaaaugcgauacgcuacugugugacaucggggagaguucuccuaauccaaccauugaagccggacgcacuuugagagugcugaaccucguugagaauuggcuuaacaauaacacacaauucugcaucaaggugcugaaucccuacaugccgagcgucauagagaaaauggagaccuugcagaggaaguacggcggcgcgcuggugcgaaacccucucucaagaaauuccacucaugaaauguauugggucaguaacgcuacagggaauauugugagcucuguuaacaugaucucccguauguuaaucaauagauuuaccaugaaacacaagaaggcaacguacgagccagauguagaccugggaucagguacccgcaacauuggcauagagaacgaaauccccaaucuugacauuaucgggaaaaggauugagaagaucaaacaggaacacgagacaagcuggcauuaugaucaggaccacccuuacaagacuugggccuaucauggaucguacgaaaccaaacaaacaggcucugcuaguuccauggugaacggugucgugcggcugcuaacuaagccaugggauguugugcccauggucacccagauggccaugacagacaccacuccguucgggcagcagagaguguuuaaggagaaaguagauacgcgcacacaagagccuaaggaaggaaccaaaaagcucaugaggauaacugcagaguggcuguggaaagaauugggcaagaagaaaaccccacgaauguguacacgggaggaguucacgagaaaggugaggagcaaugccgcucugggcgcgaucuuuaccgacgaaaacaaauggaagucagcccgcgaggcaguugaagauucccguuucugggagcucgucgaccgggaaagaaaucuucaccuggaggggaaaugcgagacuuguguguauaacaugaugggaaagagggagaaaaaguuaggugaguuuggcaaggcuaaagggucucgcgccauuugguacauguggcugggagcacgauucuuggaauuugaggcccucggcuuccugaaugaagaucacugguuuagccgggguaacagucuauccgggguggagggagagggccuucauaagcugggcuacauccucagagacgucagcaaaaaggaagggggagcuauguaugccgaugacacagcggguugggacaccaggauuacucuggaggauuugaaaaaugaagagaugguuacaaaccacaugaagggcgaacauaagaaacuggcagaggccaucuucaagcucaccuaccagaauaaagugguacgcgugcagagaccaacaccucgggggacugucauggacauuauaucuaggaaggaucagcguggaucaggccaaguggguaccuaugggcuuaacacguucaccaauauggaggcucagcugauccgacagauggaaggagagggcauuuuuaaaaguauccaacacuuaacaguuacugaagagaucgccgugcagaacuggcuggcacgcgucggcagagagcgguuguccaggauggcuauuagcggggacgauugcgugguaaagccccucgacgaucgcuucgccucugcucugaccgcccuaaaugacaugggaaagguuagaaaagauauacagcagugggaaccaucgcgggguuggaacgacuggacacaagugcccuuuugcucacaucacuuccacgagcuugucaugaaggauggcagggugcugguggucccuugucgaaaccaggacgaacucaucgggcgugcaagaauuagccagggagcgggcuggucccugaaagagacugccugcuuggguaagaguuacgcucagauguggaccuuaauguauuuucaucgccgggaucugaggcucgccgcaaaugcuaucuguucugccguuccaagccacugggugccgacguccagaacaaccuggucaauucaugcaaaacacgaauggaugacuacagaggacaugcuugccguauggaaccgcguguggauccaagagaaucccuggauggaagacaagaccccugucgagaguugggaagaggugccauaccuggggaagcgggaagaucaguggugcggaucucuaauaggccugacuagcagggcgaccugggcuaaaaacauccagacagccauuaaucagguucgaucccucaucggcaacgaggaguauacggacuacaugcccucaaugaagagauuccggaaagaagaggaagaggcagggguguugugguga

SEQ ID NO: 14684 - RNA, 9876 nt, Artificial Sequence
  derived and/or modified CDS sequence (opt3) from DENV-2__EU677144__SS-prME
accgccggcaugaucauuaugcugauacccacagcuauggcauuccaccucacuacgagaaacggggagccucauaugaucgugggaaggcaggaaaaggguaaaagccuucuguuuaagaccgaggacggcgucaauaugugcacauugauggccauugauuuaggggaacugugugaggacacuaucaccuacaaaugcccacuacuccggcaaaacgaaccggaggauauugacuguuggugcaauuccacaucuaccuggguuacuuauggaacauguaccacgacuggcgagcaccgccgagaaaagcguucaguggcgcugguaccccauguggguauggggcuugagaccagaacagaaacuuggaugaguagcgagggagcuuggaaacacguccagaggaucgagaccuggauacugcggcauccuggcuucacaaucauggccgcaauuuuggccuacaccaucggcacgacucacuuucagcgcgcucucauuuucauccugcugacagcaguggccccauccaugaccaugagaugcauagggauuucuaacagggauuuuguugaaggagugucggguggcucaugggucgacaucgugcucgagcacgggagcuguguaacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguugauagaggcugggguaacggguguggacuauucggcaagggcgggauugugaccugcgccauguuuacaugcaaaaagaauauggaaggaaaagucgugcucccugagaaccuggaauacaccauagugaucacuccacacagcggugaggagcaugcugucggcaaugacacggggaagcacggaaaagaaauuaagaucacaccgcaguccucaauaaccgaggccgaacuuacuggcuaugguaccguuacaauggaguguagucccaggaccgggcuggauuucaacgaaaugguguugcuccagauggaggacaaagcauggcugguacaccggcaaugguuuuuagaucugccucucccauggcuucccggcgcugacacucagggacugaauuggauucagaaggagacauuggugacguucaagaacccucaugccaaaaagcaggacgucgugguucuaggcagccaagaaggggcgaugcacaccgcccugacuggagcaacagagauccagaugucuuccgguaaucuccuguuuaccggccaucuuaaaugccgucugcgcauggauaaguugcagcucaaagggaugucauacagcauguguacaggaaaguucaagaucgugaaagaaauugcugagacucaacacggcaccaucgucauuagagugcaguaugagggugacgggaguccaugcaagauacccuucgaaaucauggaucuggagaaaagguacguauuaggccggcugauuacgguuaacccgaucgugaccgaaaaggacucuccugucaacaucgaggccgaacccccauuuggagauuccuacauuauaaucggcguggagccugggcagcuaaaacucaauugguucaagaagggaagcucgauuggucagauguuugagacaacuaugcgaggcgcuaaacgcauggccauccugggggacaccgcaugggauuucggaucucuuggcggugucuuuacauccauugggaaggccuugcaucaaguguucggcgcuaucuauggagcggcauuuucaggcguuaguuggacuaugaaaauacugaucggggugauuaucaccuggauuggaaugaacagcagauccacgucucucagcguaucacugguccuugugggcguugugacacuguacuugggugucauggugcaggccgacaguggguguguaguguccuggaagaauaaagaacucaagugcggaagcggcaucuucauaaccgauaacguucacacuuggacagagcaguauaaguuucagcccgaaucuccaucaaaacuggcuagugccauucaaaaggcacacgaggaagguaucuguggcauuaggagcgucacccgguuagagaaucugauguggaaacagaucacucccgagcuaaaccauauacucuccgaaaaugaggugaagcugaccaucaugacaggggacauuaaaggaaucaugcaggccggcaagcgcucucuuagaccucagccaacggaauugaaauacucguggaagaccugggggaaggcuaaaaugcugagcacugagucccacaaccaaacauuccucauugauggaccggaaaccgccgagugccccaauacaaacagggcauggaauucacuggagguggaagacuauggcuuuggugucuucaguacuaacaucugguuaaagcugcgugagaaacaggacguuuuuugugauucuaagcuuaugagcgcggcuauaaaagacaaucgggccgugcaugcagauaugggguacuggauugaauccgccuugaacgacaccuggaagauggagaaggcuucauucaucgaggugaaaagcugccacuggccuaagucucacacgcucugguccaauggaguacuggaaagugagaugaucauuccaaaaaacuucgccggccccgucagccagcauaacuaucgaccugguuaccacacacagaccgcaggcccauggcaucuagggaagcuggaaauggauuuugacuucugugagggaacuaccgugguugugacagaagauugcggcaauagagggcccucucucaggacuaccacagcuuccggaaaacugaucacggaguggugcugucgcucaugcacccuuccgccuuugcgguacagaggcgaggacgguuguugguaugggauggaaauuaggccacugaaggagaaggaagagaacuuagucaauagucucgugacugccggacacggccaaauagauaacuuuagccuggguguucuuggcauggcgcuguucuuggaagagaugcuccgcacacgaguggggaccaaacaugccauccugcuaguagcugucucguuugugacucugauuacaggaaauauguccuuccgggaccucggccgugugauggucaugguuggggcaaccaugacggaugacaucggaaugggcgugacuuaccuggcccuuuuggcugccuuuaagguaagacccaccuucgcagcgggucuguuacucaggaaacugacaucuaaggagcuuaugauggccaccauugggaucgcucugcuaagccagucaacuauaccugaaacaauccucgagcugaccgaugccuuggcacugggaaugaugguguuaaaaauuguccgcaacauggaaaaguaucagcucgcugugacaaucauggccauucugugcguucccaaugcagugauccuucaaaacgccuggaaggucaguuguacuauacuggcugcgguguccguuucuccauugcuccugaccagcucccagcagaaagccgacuggauuccucuagcacugacgaucaagggccuuaaucccacagcuaucuuucucaccacucugucacggaccagcaaaaagagaaguuggccauugaacgaggccgugauggccgucggcaugguaucuauucuggcuuccagcuuacucaaaaaugacauaccgaugacagggccucugguggcaggaggucuucugacuguuugcuacguguugaccggcaggucggccgaucucgaacuggagcgagcggcugacgucaagugggaggaucaggccgaaaucucagggucuagucccauucuauccaucacgauuagcgaggacggaucuaugagcaucaaaaacgaagaggaggaacaaacacugaccauacuuauccgcacuggccuccuggugauuuccgguguauucccagugucaauccccauuacagcagccgcuugguauuugugggaggucaagaagcagcgggcagggguuuuaugggaugugccuaguccacccccuauggaaaaagccgagcuggaagacggagcguacagaaucaagcagaggggcauauuuggcuauagccagauuggggcuggaguguacaaagaggguaccuuccacacuauguggcacgucacacguggcgccgugcucaugcaucgcgggaagcggaucgagccgucuugggcagauguuaaaaaggaccugaucuccuacggaggcgguuggaagcuugaaggggaguggaaagaaggagaggaaguacaagugcuggccuuggagccaggcaagaaucccagagcuguccagaccaaaccuggccuauuuaagacgaacacugggaccauuggagccgugucacuggauuucaguccagguacaagcggcucccccaucguugacaggaaagggaagguggucggacucuauggcaauggugugguaacccgaucuggggcauacgucucggcuauagcccagacagagaagagcauugaagauaacccugagaucgaagacgauauuuuccggaaaaagcgccugacuaucauggaccuucacccgggagcgggcaaaaccaagagauauuuacccgccauagugagggaggcaauuaaacggggccugcgaacgcucaucuuggcuccaacaagaguuguggccgcugaaauggaggaggcacugcgcgggcucccuaucagguaccagacucccgccauucgugccgaacauaccggacgggagaucgucgaccugaugugucacgcuacauuuaccaugagacuucugucaccagugaggguuccuaacuauaauuugauuauaauggaugaagcgcauuucacugaccccgcauccaucgccgcucgcgguuacauuaguacccgaguggagaugggcgaggccgcagggaucuuuaugacagccacgccaccgggaucuagagauccuuucccccaaagcaacgcuccaaucauggacgaagagcgggaaauucccgagagguccuggaauucaggccacgaaugggucacugauuuuaaggguaagaccgugugguucguaccuucuauaaaagcggggaacgacaucgccgcaugccuacgcaagaauggaaaaaaggugauucagcugagccguaaaacauuugauagugaguauguuaagaccagagcuaacgacugggauuucgucgugacuacagacaucuccgagaugggcgccaauuuucgggcagaaagggugauugauccacgccgauguaugaagcccgucauccucaccgacggcgaggaaagaguaauauuagccgggccuaugccggugacgcacagcucugcugcccagcggaggggacgcaucgguagaaacccaaaaaaugagaacgaccaauacauuuacaugggcgaaccccuggagaaugaugaggacugcgcgcauuggaaggaagcaaaaaugcuucuggauaacaucaauacuccugaggggauuauccccucaauguucgaaccagagagggaaaagguugacgccauagauggagaguaucggcuccguggcgaggcucgcaaaacauuuguggacuugaugcgaagaggugaucugccugucuggcucgccuacaggguggcugcagaagggauuaacuaugccgaccggcgcugguguuucgauggcaucaagaauaaccagauucuggaggaaaacguugagguggagaucuggaccaaagaaggagagagaaagaagcuuaaacccagguggcuagacgcucggauauacuccgauccacuggccuugaaggaauucaaagaguuugcagcgggccgaaagaguuuaacccugaaucucaucacugaaauggggagacugccuacauucaugacccagaaagcccgcgacgcucuugauaaccuggccguccuccacacagcagaggugggagguagggcuuauaaucaugccuugagcgagcugccggaaacucuagagacgcugcuccuucugaccuuauuggcaacaguaacuggcgggauuuuucuguuccucaugucgggaaagggcaucgguaagaugacccuggggaugugcugcauuaucacagccucuauacuucugugguacgcucagauucaaccccacuggaucgcggccuccaucauucucgaauuuuucuugaucgugcuguuaauaccagagccugaaaaacagcggaccccccaggacaaccagcuaacuuauguugucauugcaauccugacggugguggcugccaccauggccaaugagaugggcuuucucgagaagacaaaaaaggaccuuggacugggcagcauuaucacucaagaaucagagaguaacauauuggauaucgaccugcguccagcaucugcuuggacccucuacgccgucgcgacaaccuucguuacuccuaugcugagacacuccauugaaaauagcucagugaacguaagucuuacagcuaucgccaaucaggcaacggugcucauggggcugggaagggguuggcccuugagcaaaauggauauuggcgucccgcuguuagccaucggguguuacucccaggugaacccaauuacccuaacugcugcacugcuccuucugguugcccauuaugcgaucauaggaccuggcuugcaggcuaaggccacacgcgaggcacaaaagcgggccgcugccgguauuaugaaaaaucccaccguggacgggaucaccgucaucgaucuggaaccaauucccuacgacccuaaguuugagaaacagcucggccagguaaugcugcuuguguuaugcguuacacaggugcugaugaugcgaacuacgugggcacucugugaggcuuugacccuggccacaggaccgauaucuacucuaugggaaggcaaccccgggagauucuggaauaccacaaucgcggucagcauggccaacauuuuuaggggauccuaucuggcaggcgcuggucuccuuuucucaaucaugaagaauaccacuaacacgcgccgggggacaggaaauauuggcgagacccugggugaaaaauggaagucuagauugaacgcccugggcaagagugaguuucaaaucuacaaaaagucggggauacaggagguggaucguacucucgcaaaagaaggaaucaagaggggcgagaccgaccaccaugcugucagccggggguccgccaaacugcgcugguucguggaacgaaacaugguuacaccagagggaaaggugguagauuuaggcugcgguagagggggauggucuuauuacuguggcggucuuaaaaaugugagggaagucaagggccugacuaaggggggaccuggccacgaggagcccauuccuaugucaaccuauggguggaaccucguucggcuacagagcggaguggacgucuucuuuacaccacccgaaaaaugcgauacgcuguugugugacaucggcgaguccaguccuaauccaaccauugaagccggucgcacucugagagugcucaaccuuguagagaauuggcugaacaauaacacacaauucugcaucaagguguugaaucccuacaugccgucuguuauagaaaaaauggagacccugcagaggaaguacgggggagcgcucgugcgaaacccuuuaagccggaauucaacucaugagauguauugggucuccaacgcuacaggcaauauugugaguagcgucaacaugaucucucguaugcugaucaauagauuuaccaugaaacacaagaaggcaacguacgaaccagauguggaccuuggcuccgggacccgcaacauuggaauagagaacgaaauccccaaucuggacauuaucgguaaaaggauugagaagaucaaacaggaacacgagacaucauggcauuaugaucaggaccacccuuacaagacuugggccuaucauggcagcuacgagaccaaacaaacagggucggcuucuaguaugguuaacggaguagugcggcuacucacuaagccaugggaugucgugcccaugguuacccagauggccaugacagacaccacuccguucggccagcagagaguguuuaaggaaaaagucgauacgcgcacacaagagccuaaggaagguaccaaaaagcugaugaggauaacugcagagugguuguggaaagagcuggggaagaagaaaaccccccgaauguguacacgggaagaguucacgagaaaggugagguccaaugccgcucucggagcgaucuuuaccgacgaaaacaaauggaagagcgcccgcgaggcaguagaagauucacguuucugggagcuuguggaccgggagagaaaucugcacuuagaaggcaaaugcgagacuuguguuuauaacaugaugggcaagagggaaaaaaagcugggggaguuuggaaaggcuaaagguucccgcgccauuugguacaugugguugggcgcacgauuccucgaauuugaggcccugggguuccuaaaugaggaucacugguuuucucggggaaacagccuuaguggcgucgaaggugaggggcugcauaagcucggauacauccugagagacguguccaaaaaggaaggcggcgcuauguaugccgaugacacagcggggugggacaccaggauuacuuuggaggaucugaaaaaugaagagauggugacaaaccacaugaagggagagcauaagaaacucgcagaagccaucuucaagcuuaccuaccagaauaaagucguucgcgugcagagaccaacaccucgggguacuguaauggacauuauaagcaggaaggaucagcguggcucugggcaagugggaaccuauggccugaacacguucaccaauauggaggcucaguuaauccgacagauggaaggugaggggauuuuuaaaucaauccaacaccugacagucacugaggaaaucgccgugcgcaacugguuggcaagaguuggacgggagaggcucagucgcauggcuauuuccggcgacgauugcguggucaagccccuggacgauagauucgccagcgcucuaaccgcccuuaaugacaugggcaaggugcggaaagauauacagcagugggaaccaucuaggggguggaacgacuggacacagguacccuuuugcucgcaucacuuccacgagcugguuaugaaggauggacgagugcucgucgugccuugucguaaccaagacgaacugaucgguagagcacgcauuucacagggcgcgggguggagcuugaaagagacugccugcuuaggaaaguccuacgcucagauguggacccugauguauuuucaucggagggaucucagacuugccgcaaaugcuaucuguagugccgugccaucucacugggucccgacgagccgcacaaccugguccauucaugcaaaacacgaguggaugacuacagaagacaugcuggccguuuggaaccggguguggauccaggagaaucccuggauggaagacaagaccccuguagagucaugggaagaggugccauaccuaggcaagagggaggaucaauggugcgguagucugauagggcucacuucucgagcgaccugggcuaaaaacauccagacagccauuaaucaggucagaagcuugaucggaaacgaagaguauacggacuacaugcccuccaugaagcgguucaggaaagaagaggaagaggcaggcgugcugugguga

SEQ ID NO: 14685 - RNA, 9876 nt, Artificial Sequence
  derived and/or modified CDS sequence (opt3) from DENV-2__EU677145__SS-prME
acagccggagugaucgucaugcugauucccacagcuauggcauuccaccucacuacgcggaacggggaaccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccguacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauuaucacagaaaaggacuccccugugaacaucgaggccgaacccccauuuggagauagcuacauuauaaucggcgucgagccugggcaguuaaaacugaauugguucaagaagggaucgucuauuggucaaauguuugagacuaccaugcgaggcgcuaaacgcauggccauccuaggggacacagcaugggauuucggaucccucggcgguguguuuacuucaauugggaaggcccugcaccagguuuucggcgcuaucuacggagcggcauuuaguggcgugagcuggaccaugaaaauacuuaucgggguaauuaucacguggauuggaaugaacuccagaucuaccagcuugucagucagucuggugcucguuggcguggucacccuguaucuuggugccauggugcaggcugacuccggguguguagugagcuggaagaauaaagaacugaagugcggaucuggcaucuucauaacugauaacguucacacauggaccgagcaguacaaguuucaacccgaaucaccaaguaaauuggccagcgcaauucagaaggcccaugaggaagguaucuguggcauuagguccgucacucggcucgagaaucugauguggaaacagaucacccccgaguuaaaccacauacugucugaaaaugaggugaagcuaacaaucaugacgggggacauuaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguauuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauuccaaagagcuucgcaggccccgucucucagcacaacuaccgaccugguuaucauacucaaaccgcuggcccauggcaccucgggaagcuggaaauggauuuugacuucugugagggaacaacugugguugugaccgaagauugcggcaacagagggcccucccuaaggacaacgaccgccucaggaaaacugaucacugaguggugcugucgcaguugcacacucccgccucugcgguacagaggcgaggacgguuguugguacgggauggaaauuaggccacuuaaggagaaggaagagaauuuggucaacagccuggugaccgcgggacauggccagauagauaauuuuucguuagguguucucggcauggcccuguuccuugaagagaugcugcgcacucgaguggggacaaaacacgcuaucuugcucguagcagucuccuuugugacccugauuacgggaaacaugucuuuccgggaccuaggccgugugauggucaugguuggggccacuaugaccgaugacaucggaaugggcgugacauaucuggcucuccuggccgcauuuaagguaagacccaccuucgcggccggucuuuugcugaggaaauuaacuagcaaggagcucaugauggcuacaauugggaucgcccugcuuucacagaguaccaugccugaaacaauacuggagcuaacugaugcacucgcucugggaaugaugguguugaaaaucguccgcaauauggaaaaguaccaacuggccgugaccauuauggcaaucuccugcguucccaacgccgugauuuuacagaaugcuuggaaggucucuuguacgauccucgcgacagugagcguuuccccacugcuucugaccucaagccagcagaaagccgacuggauaccuuuggcacucacuauuaagggccugaaccccaccgcuaucuuucuaacaacucugagucggaccucuaaaaagagauccuggccacuuaaugaggccaucauggccgugggcauggucagcauucucgcuucgucacuguugaaaaacgacauaccgaugacggggccucugguagcaggagguuuacucacagugugcuauguucugaccggcaggucugccgaucuugaacuggagcgagcggcugacgugaagugggaggaucaagccgaaaucaguggguccagccccauuuugucuaucacuauuagcgaggacggauccaugucaaucaaaaaugaagaggaggaacagacacucaccauacugauccgcacuggccuacuggucauuagugguguguucccaguaagcauccccauuacagcagccgcuugguaccuuugggaggugaagaagcagcgggcagggguccucugggauguuccuucuccacccccugugggaaaagccgaacuggaggacggcgcguauagaaucaagcagaggggcauauugggguacucccaaauuggagcugguguguauaaagaaggcaccuuucacacgauguggcaugucacucguggggccguguuaaugcaccgcggaaagcggaucgagccgucaugggcagauguuaaaaaggaccugaucaguuacggcgguggguggaagcucgagggagaauggaaagagggcgaagagguacaggugcuggcccuugaaccaggcaagaaccccagagcuguccagaccaaaccugggauuuucaagacaaauaccggaacaaucggugccgugagccuggauuuuuccccaggcacuucugggucgcccauaguugacaggaaaggaaagguggucggcuuguacgguaacggggugguaacccgaagcggagcauaugucucagcuauugcccagacggagaaguccaucgaggauaauccugaaauugaggacgauaucuuccggaaaaagcgccuaacaauaauggaccugcauccgggcgcgggcaaaacuaagagauaccuccccgccauugugagggaagcaaucaaacgggggcugcgaacccuuaucuuagcuccaacaagaguuguggccgcugagauggaagaggcacugcgcggacucccuauuagguaucaaacccccgccauccgugccgagcacacuggucgggaaauugucgacuugaugugucaugcuaccuucacaaugagacugcucaguccagugaggguuccuaacuacaaccugauaaucauggaugaggcgcacuuuacggaccccgcaucuauugccgcucgcggcuauaucagcacucgaguggaaaugggggaggccgcaggaaucuucaugaccgccacaccaccgggcuccagagauccuuuuccccagucaaaugcuccaauuauggacgaggaacgggagauacccgaaaggucuuggaacagcggucacgagugggucaccgauuucaaggggaagacugugugguuuguaccuaguaucaaagcgggaaaugacauugccgcaugccuucgcaagaacggcaaaaaggugauccagcugucccguaaaacauucgauagcgaauacguuaagaccagagcuaaugacugggauuuugucgugacgacugacauuucugagaugggcgccaacuucaaggcagagcgggugaucgauccaaggcgcuguaugaaacccgucauauugacagacggggaagaacgaguaauccuagccggaccuaugccggugacccauucauccgcugcccaaagacgggguaggauuggccgcaauccaaagaacgaaaaugaccaguauaucuacaugggggagccccuggaaaacgaugaggacugcgcgcacuggaaagaggcaaagaugcucuuagauaauauuaacaccccugaaggaaucauacccaguauguuugagccagaaagagagaaaguugacgccauugauggcgaauacaggcugcggggugaggcucguaagacuuucguggaccuuaugcgccgaggggaucugccugucuggcucgccuauagaguggcugcagagggcaucaauuacgccgacaggaaaugguguuuugauggaauuaagaacaaucagaucuuggaagagaacguugaaguggagauauggacaaaggagggcgaacggaaaaagcugaaaccccgcuggcucgacgcuagaaucuauagcgauccacuggcccuuaaggaguucaaagaguucgcagcggggaggaagucgcuaacccugaacuugauuacagagaugggacgguuaccuacuuuuaugacgcagaaggcccgaaaugcucuggacaaccucgccguccugcauaccgcagaagcugguggcagagccuacaaucacgcacuuucugagcugccggagacacucgaaacuuugcugcuacugacccuccuugccacagugaccgggggaaucuuccuguuuuuaauguccggcaaagguauugggaagaugacuuugggcaugugcugcaucauaacggcuagcauucugcucugguaugcgcaaauccagccccacuggaucgccgcaucaauuauccuggaguucuuucuuauaguacugcucauuccagaaccugagaaacagcgcacaccccaggauaaccaauugacauacgugguuaucgcuauucugacugucguggccgccaccauggcaaaugaaaugggauucuuagagaagaccaagaaggaccuaggccuggggaguaucaccacucaggagucugaauccaacauacucgacaucgaucuuaggccagcuagcgccuggacacuguaugcgguggcuacgaccuuugucacuccuauguugcggcauucaauugagaauaguagcguuaacgugucccugacagccaucgcaaaucaggccaccguacucaugggacuggguaagggcuggccccuuucuaaaauggacauuggggugccgcuccuggcuaucggauguuacagccaggucaacccaauuaccuugacagcagcccuguuacuacugguggcgcacuacgcuaucauaggcccuggucuccaagccaaggcaacucgugaagcccagaaaagagcugccgcagggauuaugaagaaucccacgguugauggcaucaccgugaucgaccuugagccaauucccuaugauccuaaauucgaaaagcagcugggacaggucauguugcugauacucugcguaacacaagugcugaugaugaggacuaccugggcucuuugugaggccuuaacacuggcgaccggcccgaucuccacucucugggaggggaaccccggacgcuuuuggaauacgacaauugccguuucaauggcaaacaucuuccggggcucuuacuuggcuggugccgggcugcuauuuaguauuaugaagaauaccacuaacacccgaagaggaacaggcaauaucggugaaacucugggcgagaaauggaagucgaggcucaacgcacuugggaaaagcgaguuccagauauauaagaaauccggaauccaggagguggaccgcacccuggcuaaggagggcauuaaaagaggggaaacagaucaucacgccgucucuagaggaucagccaaguugcguugguuuguggagaggaacauggucacgccagaaggcaaggugguugaccuggguugcgggcggggaggcuggagcuacuauugugguggccucaaaaaugugcgcgagguaaaggggcugaccaaaggaggcccugggcaugaagaacccgugccuauguccacuuacggauggaacuuaguccgacuucaaaguggcguugauguguucuucacaccacccgagaagugcgacacccugcucugugauaucggugaaucuagcccuaauccaacuauugaggcggggagaacacuaaggguccugaacuugguggaaaauuggcugaacaauaacacccaguuuugcaucaaaguacucaaucccuauaugccgucagugauagagaagauggaaacgcuucagcggaaguacggaggcgcucugguucgcaacccuuuguccagaaauaguacccacgagauguacugggugagcaacgcaacaggcaauauugucucuuccgugaacaugaucucaaggaugcugaucaaucgauucacuaugaaacacaagaaagccaccuaugagccagacgucgaucucgggagcggaacacggaacauugguauagaaucggagauccccaacuuagacauuaucggcaagcguauugagaaaaucaagcaggagcaugaaacuucuuggcacuacgaccaagaucauccuuauaagaccugggcuuaccacgggaguuaugagacaaaacagaccggauccgccagcucaauggugaauggcguuguaagacugcuuacuaagccaugggacgugguccccauggugacgcagauggcaaugacagauaccacuccguuuggucagcaacgcguuuucaaagagaagguggacaccaggacacaggaaccuaaagaggggacgaagaagcugaugaaaauaaccgccgaauggcuauggaaggagcucggcaaaaagaaaacuccccggauguguacaagagaggaauuuaccaagaaaguccgcuccaacgcugcgcugggcgccaucuucacugaugagaauaaguggaagucugcaagggaagcuguggaggacggccgauuuugggaauugguagaucgggagagaaaccugcaccucgaggggaaaugcgaaacauguguguacaauaugaugggaaagagggagaagaaacuuggugaguucggcaaagccaaagggagccgcgcaauuugguauauguggcugggagccagauuuuuagaguucgaagcucugggcuuuuugaacgaggaccauugguucagucgggguaauucccucagcgggguugagggagaaggccugcacagacuaggcuacauccuuagggaggucgggaagaaagaaggaggugccauguacgcggaugacaccgcaggcugggauacacgcauuacucuggaggaccucaagaacgaagagauggugaccaaucauaugaaaggggagcacaagaaacuggccgaagcuaucuuuaaguugacguaucagaacaaggugguccgaguucagcggccaaccccuagaggaacagugauggacauuauaucuaggcgcgaucaaagaggcucaggucagguagggacuuacggacugaauaccuucacaaacauggaggcccagcucauccggcaaauggaaggcgagggcauuuucaaaaguauccagcaucuuacugcaaccgaggaaaucgcugugcagaauuggcuggccagggucgggcgugagcgauuaucccgcauggcuauuagcggagacgauugcgugguuaagcccauagacgauagauuugccucugcacugacggcguugaacgacauggguaaagugcggaaggauauccagcaaugggaaccaucgaggggcuggaaugacuggacacagguccccuucugcucacaccacuuucaugagcucgugaugaaagaugggcgcguacugguugugccuuguagaaaccaggacgaacuaauuggacgggccaggaucagccagggcgcugguuggucccuuaaggagaccgccugccuggggaagaguuaugcacaaauguggacucucauguacuuccaccgacgugaucugagauuggcugccaacgcaauuuguucugccgucccaagccauugggugccgacaucccgcaccacuuggucaauccacgcgaaacacgaguggaugaccacagaagacauguuagcuguguggaaucgggucuggauacaggagaaccccuggauggaagauaagacgccuguugagaguugggaagaggugccauaucugggaaaaagggaggaccaguggugcggcucucucaucggccuuaccagcagagccacuugggcaaagaauauucagacagccaucaaccaaguacgcucccugauugggaaugaagaguacaccgacuauaugcccucaaugaaacgguuuaggcgagaagaggaagaggcuggagugcuaugguga

SEQ ID NO: 14686 - RNA, 9876 nt, Artificial Sequence
  derived and/or modified CDS sequence (opt3) from DENV-2__EU677146__SS-prME
accgugggcgucaucguuaugcugauucccacagccauggcuuuccaccucacuacgagaaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucagucgcccuggugccccauguugguauggggcuugagaccagaacagaaacuuggaugaguagcgagggagcguggaaacacgugcagaggauugagaccuggauccugcggcauccuggcuucacaauaauggcugccaucuuggcauacaccauuggcacgacucacuuucagcgcgcccucaucuucauucugcugacagcugucgcaccauccaugaccaugagaugcaucgggauaucuaacagggauuuuguggaaggaguaucggguggcucauggguugacauugugcucgagcacgggagcugugucacuacaauggccaagaauaagcccaccuuagauuucgaacugaucaaaacggaggcuaagcagccugccacccuucggaaauauugcauugaagcgaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggaucgugaccugcgcaauguuuacaugcaaaaagaauauggaaggaaaagucguucucccugagaaccuggaauacaccauugugauaacuccacacagcggugaggagcaugccguaggcaaugacacggggaagcacggaaaagaaaucaagauuacaccgcaguccucaaucaccgaggcugaacuuacuggcuaugguaccgugacaauggaguguagucccaggaccgggcuggauuucaacgaaauggucuugcuccagauggaggacaaagccuggcuggugcaccggcaaugguuuuuagaucugccucucccauggcuucccggcgcagacacucagggaagcaauuggauacagaaggagacacugguuacguucaagaacccucaugcuaaaaagcaggacguggucguguugggcucucaagaaggggccaugcacaccgcgcuaacuggagccacagagauucagauguccucagguaaucugcucuuuaccggccaucugaaaugccgucuucgcauggauaagcugcaguugaaagggaugagcuacaguauguguacaggaaaguucaagaucguaaaagaaaucgcagagacucaacacggcaccauuguuaucagagugcaguaugagggugacgggucuccaugcaagauucccuucgaaauaauggaucucgagaaaaggcauguccugggccgguuaaucacggugaacccgauugucaccgaaaaggacuccccugugaacaucgaggcugaacccccauuuggagauagcuacaucauuauaggcguugagccugggcagcugaaacuaaauugguucaagaagggaucgucuaucggucagauguuugagacaacuaugcgaggcgccaaacgcauggcuauucucggggacaccgccugggauuucggaucccugggcgguguguuuacaucaaucgggaaggcacuucaccaaguauucggcgccauuuacggagcugcguuuaguggcgucagcuggacuaugaaaaucuugauaggggugaucauuaccuggaucggaaugaacuccagaucuacgagccugucaguuagucucgugcuggucggcgugguaacacuuuaucugggugugaugguucaggcagacuccgggugugucgugagcuggaagaauaaagaauugaagugcggaucuggcauuuucaucaccgauaacgugcacacuuggacagagcaguacaaguuucagcccgaaucaccaaguaaacucgccagcgcuauacaaaaggcccaugaggaagguauuuguggcaucagguccgucacccggcuggagaauuuaauguggaaacagauuacucccgagcugaaccacauccuaucugaaaaugaggcaaagcucaccauaaugacaggggacaucaaaggaauuaugcaggccggcaagcgcucgcugagaccucagccaacggaacuuaaauauagcuggaagaccugggggaaggcuaaaauguuguccacugagucacauaaccaaacauuccugaucgauggaccggaaaccgccgagugccccaauacaaacagggcauggaauagucucgagguugaagacuacggcuuugguguguucucuacuaacauuuggcugaaguuacgugagaaacaggacguguuuugugauagcaagcugauguccgcggcuaucaaagacaaucgggccguacacgcagauaugggguauuggauagaaucagcccuuaacgacaccuggaagauggagaaggcuagcuucauugagaucaaaucuugccacuggccuaagucccauacguuguggaguaauggaguccucgaaagcgagaugaucauuccaaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcucuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacacacacugaccauacuaauccgcacuggccugcuuguaauuagugguguguucccagucagcauccccauuacagcagccgcuugguaccucugggagguuaagaagcaacgggcaggggugcugugggaugugccuucuccacccccugucggaaaagccgaauuggaggacggcgcguauagaaucaagcagaggggcauauuuggguacucccagauuggagcugguguguauaaagaaggcaccuuccauacuauguggcacguuacacguggggccguauuaaugcaucgcggaaagcggaucgagccgucaugggcagaugugaaaaaggaccugaucaguuacggcgguggguggaagcucgagggagaauggaaagagggcgaagagguccaggugcuggcccuugaaccaggcaagaaucccagagcuguucaaaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccacccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcauaccggucgggaaaucguugaccugaugugucacgcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccagucaaacgcuccaaucauggacgaggaacgggagauucccgaaaggucuuggaauagcggucaugaguggguaacugauuuuaaggggaagaccgugugguucguuccuaguauaaaagcgggaaacgacaucgccgcaugccugcgcaagaauggcaaaaaggucauucaauugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcacucauccgcugcccagcggaggggucgcaucggcagaaacccaaaaaaugaaaacgaccaguauauuuacaugggggagccccucgaaaaugaugaggacugcgcgcauuggaaggaggcaaaaauguuacuggauaacaucaauacuccugaaggaauuauccccaguauguucgagccagaaagggagaaggucgacgccauagauggcgaauaccggcuucguggugaggcucgcaaaacauuuguggaccugaugcgaagaggggaucucccuguuugguuggccuauaggguggcugcagagggcauuaacuacgccgaccggcgcugguguuucgauggaaucaagaauaaccaaauucuggaagagaacgucgaaguggagaucuggaccaaagagggcgaaagaaagaagcucaaacccagguggcuggacgcucggauauauagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucacacagcagaaguggguggcagggcuuacaaucacgcccugucugagcucccggagacuuuggaaacgcugcuacugcucacccuucuggcaacaguuacugggggaauuuuuuuauucuugauguccggcaaggguaucgggaagaugacccugggcaugugcugcauuaucacagccagcauacuccugugguaugcucagauucagccccauuggaucgcggccucaaucauucuugaguuuuuccugaucguccucuugauaccagaaccugagaaacaacggaccccccaggacaaccagcugacuuacguggugauugcaaucuuaacggucguugcugccaccauggccaaugaaaugggauuucuagagaagacaaaaaaggaccugggccucgggaguauuacuacccaggagucugaauccaacauccuugauauagaccugcguccagcaagcgcuuggacauuguaugccguggcgaccacuuucguaacaccuaugcugagacacucaaucgagaauaguagcgugaacgucucccucacggcuauugccaaucaagcaaccgugcugaugggacuugguaggggcuggccccucucuaaaauggauaucgggguuccgcuguuggccauuggauguuacagccaggugaacccaaucacucugacagcugcauuacuacugcucgucgcccauuacgcgauuaucggcccuggucuucaggcuaaggccacccgcgaagcacagaagcggaccgccgcugggauaaugaaaaaucccacaguagacggcauuacugugaucgaucuggagccaauccccuaugacccuaaguuugaaaaacaauugggacagguuaugcugcucgugcugugcgucacgcaggugcuuaugaugcgaaccacaugggccuuaugugaggcacugacucucgcuaccggcccgauuuccacauugugggaggggaaccccggaagauucuggaauaccacuauagccgucucaauggcgaacaucuuuaggggcucuuaccuggccggugcagggcuacuguucaguauuaugaagaauacgacaaacacccgccggggaacuggcaauaucggugaaacccucggcgagaaauggaagucgagacuuaacgcucuggggaagagcgaauuucagauuuauaaaaaguccggaauccaagagguggaucguacauuggccaaagagggcauaaagaggggggaaacugaccaccaugcaguuucucggggaucagcuaaacugcgcugguucguggagcgaaacaugguaaccccagaaggcaagguggucgaucucgguugcgggagaggaggcuggagcuacuauugugguggccugaaaaauguuagggaggugaagggguuaacaaagggaggcccugggcacgaagagcccaucccuauguccacguacggauggaaccuuguccggcugcagaguggcguggacguauucuuuaccccacccgagaaaugcgauacucuccuaugugacauuggugaaucuagcccuaauccaacaaucgaggccgggcgcacccugagaguguugaaccugguugaaaauuggcucaacaauaacacucaguucugcauuaaggugcuuaaucccuauaugccgucagucaucgagaaaauggaaacacugcaaaggaaguacggaggcgccuuggugcgaaacccucugucccggaauaguacccacgagauguacugggucagcaacgcgacgggcaauauagugucuuccguuaacaugauuucacguaugcucaucaauagauuuaccaugaaacauaagaaggcuacauaugagccagauguagacuuagggagcggaacucgcaacaucgguauugaaaacgagauacccaaucuggacaucauuggcaaaaggaucgaaaagauuaaacaggagcacgaaaccucguggcauuacgaucaggaccacccuuauaagacaugggcauaccacgggucuuaugagacuaaacagaccggaagugccuccagcauggugaacggcgucgugaagcuucugacaaagccaugggauguugugcccauggucacccaaauggcuaugacugacacgacaccguucggucagcagcggguguuuaaagagaagguagauaccagaacucaggaaccuaaagaggggaccaagaaacuaaugcgcaucacagccgaauggcucuggaaggagcugggaaagaaaaagacgcccaggauguguacccgagaggaauucacucggaaagugagaucaaaugcagccuugggcgcuauauuuacagacgagaacaaguggaaauccgcgagggaagccguugaggauucucgcuucugggaacuggucgaccgugagcggaaucuccaucuugagggcaagugcgaaaccuguguguacaacaugauggggaaaagagagaagaagcugggagaauuugguaaagcaaagggcagcagggcuaucugguauaugugguuaggggcccgcuuccuggaguuugaagcauugggauuccucaaugaggaucacugguuuagucgaggcaacucccugagcgguguggagggggaaggacuacauaaacuuggcuacauucugcgggacgucucuaagaaagagggcggggccauguacgcugaugacacugccggaugggacacaagaaucacccucgaagaucugaagaaugaggaaaugguuacaaaccacaugaagggugagcauaaaaaguuggcggaggcaauuuucaaacugacuuaucaaaauaaggugguaagggugcagcgcccaaccccuagaggcacggucauggacaucauuucacggaaagaucagagggggaguggacaggugggcaccuacggucucaacacauucacuaauauggaagcccaacuuauacgucagauggagggggaaggaaucuuuaaguccauucagcgacugaccguuacagaggagaucgcugugcaaaacugguuagcccgcgucggcagagaacggcugagcaggauggcaaucucuggcgacgauugcgugguaaagcccuuggacgaucgcuucgcuucggcccucacugcucugaaugacauggggaaaguuagaaaggauauucagcagugggagccaucacggggauggaacgacuggacccaggugcccuuuugcagccaccacuuccaugaacuagucaugaaagaugguagggugcuuguggucccuugucgaaaccaagacgagcugauaggccgugccagaaucucccagggggcaggauggagucucaaggaaacggcgugccugggcaaaucuuaugcccagauguggacauugauguacuuucaccgccgggauuuaaggcuggcugccaaugcaauuuguagcgcuguuccaucccauugggugccgaccucaagaacuacauggaguauccacgccaagcacgaguggaugaccacugaggacaugcucgcaguauggaaccgcguguggauucaggaaaaucccuggauggaggacaagaccccugucgaaucuugggaggaagugccauaucuugguaaacgggaggaucaauggugcgggagccugaucggacuaacauccagggccacgugggcgaagaacauacagaccgcuaucaaucagguucgaucacugauuggcaacgaggaauacacugacuauaugcccagcaugaaaagauuccggaaggaggaagaggaagccggcgugcucugguga

SEQ ID NO: 14687 - RNA, 9876 nt, Artificial Sequence
  derived and/or modified CDS sequence (opt3) from DENV-2__EU687214__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauuaaaggaaucaugcaggccggcaagcgcucucugagaccucagccaaccgaacuuaaauauucguggaagacuugggggaaggcuaaaauguugagcacagagucccauaaccaaaccuuccugauugauggaccggaaacagccgagugccccaauacuaacagggcauggaauucacucgaggucgaagacuacggcuuugguguuuucaguaccaacaucuggcugaaguuacgugagaaacaggacguguuuugugauucuaagcugaugagcgcggcuauaaaagacaaucgggccgugcacgcagauaugggguauuggauugaauccgcccuuaacgacacguggaagauggagaaggcuucauucaucgagaucaaaagcugccacuggccuaagucucauacauugugguccaauggaguacucgaaagugagaugauuaucccaaaaaacuucgccggccccgucagccagcacaacuaccgaccugguuaucauacccagacugcaggcccauggcaccuggggaagcuagaaauggauuuugacuucugugagggaaccacagugguugugacugaagauugcggcaauagagggcccucucugaggaccacaacggcuuccggaaaacucauuaccgaguggugcugucgcucaugcacucugccgccucuucgguacagaggcgaggacgguuguugguacgggauggaaauaaggccauugaaggagaaggaagagaaccuggucaauaguuuagugacagccggacauggccaaaucgauaacuuuagccucgguguucugggcauggcgcuuuuccuggaagagauguugcgcacccgaguggggacuaaacacgccauucuccugguagcugucucguuugugacacuaaucaccggaaauauguccuuccgggaccugggccgugugauggucaugguuggggcaacgaugacugaugacauuggaaugggcgugaccuaucucgcccugcuugcugccuuuaagguaagacccacauucgcagcggguuugcuguuaaggaaacucaccucuaaggagcugaugauggccacuaucgggauagcucuucugagccagucaacaaucccugaaaccauucuagagcucacagaugcccuggcauugggaaugauggugcugaaaaucguccgcaacauggaaaaguaccaguuagcugugacuauuauggccaucaguugcguucccaaugcagugauacuccaaaacgccuggaaggucuccuguaccauucuggcugcggugucuguuagcccacuucuguugacguccucacagcagaaagccgacuggaucccucucgcacugacaaucaagggccuaaaucccaccgcuauuuuucugacuacccuuagccggacaaguaaaaagagaucuuggccacucaacgaggccgugauggccgucggcaugguauccauacuggcuagcucguugcugaaaaaugacaucccgaugacugggccuuuaguggcaggaggucuccugaccguuugcuaugugcuuacgggcaggucagccgaucuggaauuggagcgagcggcugacgucaagugggaggaucaggccgaaauuucugggaguucccccauccucagcauuacaaucucugaggacggaagcauguccauaaaaaacgaagaggaggaacacacccugacuauccuaauucgcacaggccugcuugugaucucagguguauucccagugaguauucccaucaccgcagccgcuugguaccucugggaggucaagaagcaacgggcagggguucugugggaugugccuagcccacccccugugggaaaagccgaauuggaggacggcgcguauagaauaaagcagaggggcauuuuuggguacucucagaucggagcuggugucuauaaagaaggcacuuuccauacaauguggcacgugacccguggggccguuuuaaugcaucgcggaaagcggaucgagccguccugggcagauguaaaaaaggaccugauuucauacggcgguggguggaagcucgagggagaauggaaagagggcgaagaggugcagguccuggcccuugaaccaggcaagaaucccagagcugugcaaacgaaaccugggcuguuuaagacuaacaccggaacaaucggugccguuaguuuggauuucagcccaggcaccuccgggucucccauaguggacaggaaaggaaaggucgugggccuauacgguaaugggguagucacacgaucgggagcauaugugagcgcuauugcccagacugagaagucaaucgaggauaacccugaaauugaggacgauaucuuccggaaaaagcgccugaccauaauggaccuccacccgggcgcgggcaaaacgaagagauaccugcccgccauuguuagggaagcaaucaaacgggggcuucgaacauuaauccuggcuccaacuagaguggucgccgcugagauggaagaggcacuccgcggauugccuauuagguaucagacccccgccauccgugccgagcauacaggucgggaaauuguggaccugaugugucacgcuaccuuuacuaugagacuccuguccccaguuagggugccuaacuacaaucuuauaaucauggaugaggcgcacuucaccgaccccgcaaguauugccgcucgcggcuauaucucuacacgagucgaaaugggggaggccgcaggaaucuuuaugacggccacuccaccgggcagcagagauccuuucccccaguccaacgcuccaauuauggacgaggaacgggagauacccgaaaggucauggaauucuggucaugagugggugaccaacuuuaaggggaagacaguaugguucgugccuagcaucaaagcgggaaaugauauugccgcaugccugcgcaagaacggcaaaaagguuauccaauugagucguaaaaccuuugacuccgaauacgucaagacuagagcuaaugauugggacuucguggugacaaccgauauuagcgagaugggcgccaacuuucgggcagagagggucaucgacccacgccgauguaugaagcccguaauacuaacggauggggaagagagagugauccuggccggaccuaugccgguuacucacucuucagcugcccagcggaggggucgcauuggcagaaauccaaaaaacgaaaaugaccaguauaucuacaugggggagccccucgaaaacgacgaggauugcgcgcauuggaaggaggcaaaaauguuacuggacaauauuaacacaccugaaggaaucauacccuccauguucgagccagaaagggagaagguggaugccauugacggcgaauaccggcuucguggugaggcucgcaaaaccuuugucgaucugaugcgaagaggggaccucccugugugguuggccuauaggguugcugcagagggcaucaauuacgccgaucggcgcugguguuucgacggaauuaagaacaaccaaauccuggaagagaauguggaagucgagauauggaccaaagagggcgaaagaaagaagcucaaacccagguggcuggaugcucggaucuauagugacccacuugcccuaaaggaguucaaagaauuugcagcggggcgaaagagccugacuuugaacuuaauuacagagaugggaagacugccuaccuucaugacacagaaagcccgcgaugcucucgacaaucuggccgugcuucacacugcagaaguagguggcagggcuuacaaccacgcccugucggagcucccggagacguuggaaacccugcuacugcucacacuucuggcaacugugaccgggggaaucuuuuuauucuugaugucuggcaaggguauugggaagaugacacugggcaugugcugcaucauaaccgccuccauucuccugugguaugcucagauccagccccauuggaucgcggccagcauuauccuugaguuuuuccugauaguucucuugauuccagaaccugagaaacaacggacuccccaggauaaucagcugacguacgucgugaucgcaauuuuaaccguggucgcugccacaauggccaacgaaaugggauuucuagagaagacuaaaaaggaccugggccucgggucaaucaccacacaggagagugaaucuaauauacuugacaucgaucugcguccagcauccgcuuggaccuuguaugccguugcgacuacauucgugacgccuaugcugagacacagcauugagaacucaaguguaaaugugagccucaccgcuaucgccaaccaagcaacuguccugaugggacuugguaggggcuggccccucuccaaaauggacauuggggugccgcuguuggccaucggauguuacucucagguuaauccaauuacacugaccgcugcauuacuacugcucguggcccauuacgcgaucauaggcccuggucuucaggcuaaggccacccgcgaagcacagaagcggacagccgcugggauuaugaaaaaccccacugucgauggcaucacgguaaucgaccuggagccaauucccuaugauccuaaguuugaaaaacaauugggacaggugaugcugcucguucugugcgugacccagguccuuaugaugcgaacaacuugggccuuaugugaggcacugacccucgcuacaggcccgauaagcaccuugugggaggggaaucccggaagauucuggaacacuacgaucgccguguccauggcgaauauuuuuaggggcucauaccuggccggugcagggcuacuguucucuaucaugaagaacacaaccaauacucgccggggaaccggcaacauuggugaaacacucggcgagaaauggaagaguagacuuaacgcucuggggaagucggaauuucagaucuauaaaaagagcggaauacaagaggucgaccguacuuuggccaaagagggcaucaagaggggggaaaccgaucaccaugcagugucccggggaucugcuaaacugcgcugguucguugagcgaaauauggugacaccagaaggcaagguaguggaccucgguugcgggagaggaggcuggucauacuauugugguggccugaaaaacgucagggagguuaagggguuaacgaagggaggcccugggcacgaagagcccauuccuaugagcaccuacggauggaaucuugugcggcugcaguccggcgucgauguguucuuuacuccacccgagaaaugcgacacacuccuaugugauaucggugaaaguucuccuaacccaaccauugaggccgggcgcacucugagaguauugaaucugguggaaaacuggcucaauaacaauacacaguucugcguuaaggugcuuaaccccuauaugccgagcgucaucgagaaaauggaaacccugcaaaggaaguacggaggcgccuuggugcgaaauccucugucacggaacuccacgcacgagauguacugggucaguaaugcgaccggcaacauagugagcucuguuaauaugauuucccguaugcucaucaacagauuuacaaugaaacauaagaaggcuacuuaugagccagacguagauuuagggucaggaacccgcaacaucgguauugaaaaugagauacccaaccuggacaucauuggcaaaaggaucgaaaagauuaaacaggagcacgaaacaagcuggcauuacgaccaggaucacccuuauaagacuugggcauaccacgggucguaugagaccaaacagacaggaucugccaguuccauggugaauggcgucgugaagcuucugaccaagccaugggacguugugcccauggucacucaaauggcuaugacggauacaaccccguucggucagcagcggguguuuaaagagaagguagacacuagaacccaggaaccuaaagaggggacaaagaaacuaaugcgcaucacggccgaauggcucuggaaggagcugggaaagaaaaagacccccaggauguguacucgagaggaauucacacggaaagugagaagcaacgcagccuugggcgcuauauuuaccgaugagaauaaguggaaaucagcgagggaagccguugaggacucccgcuucugggaacuggucgaucgugagcggaaccuccaucuugagggcaagugcgaaacuuguguguacaauaugauggggaaaagagagaagaagcugggagaauuugguaaagcaaagggcucuagggcuaucugguauaugugguuaggggcccgcuuccuggaguuugaagcauugggauuccucaacgaggaccacugguuuagccgaggcaauagucuguccgguguggagggggaaggacuacauaaacuuggcuacauucugcgggaugucagcaagaaagagggcggggccauguacgcugacgauacagccggaugggacaccagaaucacacucgaagaccugaagaacgaggaaaugguuacuaaucacaugaagggugagcauaaaaaguuggcggaggcaauuuucaaacugaccuaucaaaacaaggugguaagggugcagcgcccaacgccuagaggcaccgucauggauaucauuucucggaaagaccagagggggucaggacaggugggcacauacggucucaauacuuucaccaacauggaagcccaacuuauacgucagauggagggggaaggaaucuuuaagaguauucagcgacugacaguuacugaggagaucgcugugcaaaauugguuagcccgcgucggcagagaacggcuguccaggauggcaaucagcggcgaugacugcgugguaaagcccuuggaugaccgcuucgcuucugcccucauugcucugaacgauauggggaaaguuagaaaggacauacagcagugggagccaucgcggggauggaacgauuggacccaggugcccuuuugcucacaccacuuccaugaacuagucaugaaagacgguagggugcuuguggucccuugucgaaaucaagaugagcugaucggccgugccagaauuagccagggggcaggauggucccucaaggaaacggcgugccugggcaaaaguuaugcccagauguggacauugauguacuuucaccgccgggacuuaaggcuggcugccaacgcaaucuguucugcuguuccaagccauugggugccgaccuccagaacuacauggucaauucacgccaagcacgaguggaugaccacugaggauaugcucgcaguauggaaucgcguguggauccaggaaaaccccuggauggaggacaagaccccugucgaaaguugggaggaagugccauaucuugguaaacgggaggaccaauggugcgggucucugauaggacuaacaagcagggccacgugggcgaagaauauccagaccgcuauuaaccagguucgaucccugaucggcaaugaggaauacacugauuauaugcccucaaugaaaagauuccggaaggaggaagaggaagccggcgugcucugguga

SEQ ID NO: 14688 - RNA, 9876 nt, Artificial Sequence
  derived and/or modified CDS sequence (opt3) from DENV-2__EU687215__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauuaaaggaaucaugcaggccggcaagcgcucucugagaccucagccaaccgaacuuaaauauucguggaagacuugggggaaggcuaaaauguugagcacagagucccauaaccaaaccuuccugauugauggaccggaaacagccgagugccccaauacuaacagggcauggaauucacucgaggucgaagacuacggcuuugguguuuucaguaccaacaucuggcugaaguuacgugagaaacaggacguguuuugugauucuaagcugaugagcgcggcuauaaaagacaaucgggccgugcacgcagauaugggguauuggauugaauccgcccuuaacgacacguggaagauggagaaggcuucauucaucgagaucaaaagcugccacuggccuaagucucauacauugugguccaauggaguacucgaaagugagaugauuaucccaaaaaacuucgccggccccgucagccagcacaacuaccgaccugguuaucauacccagacugcaggcccauggcaccuggggaagcuagaaauggauuuugacuucugugagggaaccacagugguugugacugaagauugcggcaauagagggcccucucugaggaccacaacggcuuccggaaaacucauuaccgaguggugcugucgcucaugcacucugccgccucuucgguacagaggcgaggacgguuguugguacgggauggaaauaaggccauugaaggagaaggaagagaaccuggucaauaguuuagugacagccggacauggccaaaucgauaacuuuagccucgguguucugggcauggcgcuuuuccuggaagagauguugcgcacccgaguggggacuaaacacgccauucuccugguagcugucucguuugugacacuaaucaccggaaauauguccuuccgggaccugggccgugugauggucaugguuggggcaacgaugacugaugacauuggaaugggcgugaccuaucucgcccugcuugcugccuuuaagguaagacccacauucgcagcggguuugcuguuaaggaaacucaccucuaaggagcugaugauggccacuaucgggauagcucuucugagccagucaacaaucccugaaaccauucuagagcucacagaugcccuggcauugggaaugauggugcugaaaaucguccgcaacauggaaaaguaccaguuagcugugacuauuauggccaucaguugcguucccaaugcagugauacuccaaaacgccuggaaggucuccuguaccauucuggcugcggugucuguuagcccacuucuguugacguccucacagcagaaagccgacuggaucccucucgcacugacaaucaagggccuaaaucccaccgcuauuuuucugacuacccuuagccggacaaguaaaaagagaucuuggccacucaacgaggccgugauggccgucggcaugguauccauacuggcuagcucguugcugaaaaaugacaucccgaugacugggccuuuaguggcaggaggucuccugaccguuugcuaugugcuuacgggcaggucagccgaucuggaauuggagcgagcggcugacgucaagugggaggaucaggccgaaauuucugggaguucccccauccucagcauuacaaucucugaggacggaagcauguccauaaaaaacgaagaggaggaacacacccugacuauccuaauucgcacaggccugcuugugaucucagguguauucccagugaguauucccaucaccgcagccgcuugguaccucugggaggucaagaagcaacgggcagggguucugugggaugugccuagcccacccccugugggaaaagccgaauuggaggacggcgcguauagaauaaagcagaggggcauuuuuggguacucucagaucggagcuggugucuauaaagaaggcacuuuccauacaauguggcacgugacccguggggccguuuuaaugcaucgcggaaagcggaucgagccguccugggcagauguaaaaaaggaccugauuucauacggcgguggguggaagcucgagggagaauggaaagagggcgaagaggugcagguccuggcccuugaaccaggcaagaaucccagagcugugcaaacgaaaccugggcuguuuaagacuaaaaccggaacaaucggugccguuaguuuggauuucagcccaggcaccuccgggucucccauaguggacaggaagggaaaggucgugggccuauacgguaacgggguagucacacgaucgggagcauaugugagcgcuauugcccagacugagaaaucaaucgaggauaauccugaaauugaggacgauaucuuccggaagaaacgccugaccauaauggaccuccacccgggcgcgggcaagacgaaaagauaccugcccgccauuguuagggaagcaaucaagcgggggcuucgaacauuaauccuggcuccaacuagaguggucgccgcugagauggaagaggcacuccgcggauugccuauuagguaucagacccccgccauccgugccgagcauacaggucgggaaauuguggaccugaugugucacgcuaccuuuacuaugagacuccuguccccaguuagggugccuaacuacaaccuuauaaucauggaugaggcgcacuucaccgaccccgcaaguauugccgcucgcggcuauaucucuacacgagucgaaaugggggaggccgcaggaaucuuuaugacggccacuccaccgggcagcagagauccuuucccccaguccaaugcuccaauuauggacgaggaacgggagauacccgaaaggucauggaacucuggucaugagugggugaccgauuuuaaggggaaaacaguaugguucgugccuagcaucaaggcgggaaaugacauugccgcaugccugcgcaaaaacggcaagaaaguuauccaauugagucguaagaccuuugauuccgaauacgucaagacuagagcuaaugacugggauuucguggugacaaccgacauuagcgagaugggcgccaacuuucgggcagagagggucaucgauccacgccgauguaugaaacccguaauacuaacggacggggaagagagagugauccuggccggaccuaugccgguuacucacucuucagcugcccagcggaggggucgcauuggcagaaauccaaagaacgaaaaugaccaguauaucuacaugggggagccccucgaaaacgaugaggacugcgcgcauuggaaagaggcaaagauguuacuggauaauauuaacacaccugaaggaaucauacccuccauguucgagccagaaagggagaaaguggacgccauugauggcgaauaccggcuucguggugaggcucgcaagaccuuugucgaccugaugcgaagaggggaucucccugugugguuggccuauaggguugcugcagagggcaucaauuacgccgaccggcgcugguguuucgauggaauuaaaaacaaucaaauccuggaagagaacguggaagucgagauauggaccaaggagggcgaaagaaagaaacucaagcccagguggcuggacgcucggaucuauagugauccacuugcccuaaaagaguucaaggaauuugcagcggggcgaaaaagccugacuuugaacuuaauuacagagaugggaagacugccuaccuucaugacacagaaggcccgcgacgcucucgauaaucuggccgugcuucacacugcagaaguagguggcagggcuuacaaccacgcccugucggagcucccggagacguuggaaacccugcuacugcucacacuucuggcaacugugaccgggggaaucuuuuuauucuugaugucuggcaaggguauugggaaaaugacacugggcaugugcugcaucauaaccgccuccauucuccugugguaugcucagauccagccccauuggaucgcggccagcauuauccuugaguuuuuccugauaguucucuugauuccagaaccugagaagcaacggacuccccaggacaaucagcugacguacgucgugaucgcaauuuuaaccguggucgcugccacaauggccaacgaaaugggauuucuagagaaaacuaagaaagaccugggccucgggucaaucaccacacaggagagugaaucuaauauacuugauaucgaccugcguccagcauccgcuuggaccuuguaugccguugcgacugcuuucgugacaccuaugcugagacacagcauugagaacucaaguguaaaugugagccucacggccaucgcaaaccaagccaccguccugaugggacuugguaggggcuggccccucuccaagauggauauuggggugccgcuguuggcuaucggauguuacucucagguuaauccaauuacucugacagcagccuuacuacugcucguggcgcauuacgcuaucauaggcccuggucuucaggccaaggcaacccgcgaagcccagaaacggaccgcugccgggauuaugaagaaccccacagucgacggcaucacuguaaucgaucuggagccaauucccuaugacccuaaauuugaaaagcaauugggacaggugaugcugcucguucugugcgugacgcagguccuuaugaugcgaaccacaugggcauuaugugaggcucugacucucgccaccggcccgauaagcacauugugggaggggaaucccggaagauucuggaacaccacuaucgcgguguccauggccaauauuuuuaggggcucauaccuggcaggugcugggcuacuguucucuaucaugaaaaacacgacaaauacccgccggggaacuggcaacauuggugaaacccucggcgagaaguggaagaguagacuuaaugcccuggggaaaucggaauuucagaucuauaagaaaagcggaauacaagaggucgaucguacauuggcaaaggagggcaucaaaaggggggaaacugaccaccaugcugugucccggggaucugccaagcugcgcugguucguugagcgaaacauggugaccccagaaggcaaaguaguggaucucgguugcgggagaggaggcuggucauacuauugugguggccugaagaacgucagggagguuaagggguuaacaaaaggaggcccugggcacgaagagcccauuccuaugagcacguacggauggaaucuugugcggcugcaguccggcgucgacguguucuuuaccccacccgagaagugcgauacucuccuaugugacaucggugaaaguucuccuaacccaacaauugaggccgggcgcacccugagaguauugaaucugguggaaaacuggcucaauaacaauacucaguucugcguuaaagugcuuaaccccuauaugccgagcgucaucgagaagauggaaacacugcaaaggaaauacggaggcgcguuggugcgaaauccucugucacggaacuccacccacgagauguacugggucaguaaugcuacgggcaacauagugagcucuguuaauaugauuucccguaugcucaucaacagauuuaccaugaagcauaagaaagcaacauaugagccagauguagacuuagggucaggaacucgcaauaucgguauugaaaacgagauacccaaccuggacaucauuggcaagaggaucgaaaaaauuaagcaggagcacgaaaccagcuggcauuacgaucaggaccacccuuauaaaacaugggccuaccacgggucguaugagacuaagcagaccggaucugcuaguuccauggugaauggcgucgugaagcuucugacaaaaccaugggauguugugcccauggucacccaaauggccaugacugacacgacaccguucggucagcagcggguguuuaaggagaaaguagauaccagaacucaggaaccuaaggaggggaccaaaaagcuaaugcgcaucacagcagaauggcucuggaaggagcugggaaaaaagaaaacgcccaggauguguacccgagaggaauucacucggaaggugagaagcaacgccgcuuugggcgcgauauuuacagacgagaauaaauggaagucagccagggaagcaguugaggauucccgcuucugggaacuggucgaccgugagcggaaccuccaucuugagggcaaaugcgaaaccuguguguacaauaugauggggaagagagagaagaaacugggagaauuugguaaggcuaaaggcucuagggccaucugguauaugugguuaggggcacgcuuccuggaguuugaagccuugggauuccucaacgaggaucacugguuuagccgaggcaauagucuguccgguguggagggggaaggacuacauaagcuuggcuacauucugcgggacgucagcaaaaaggagggcggggcuauguacgccgaugacacugcgggaugggacacaagaaucacccucgaagaucugaagaacgaggaaaugguuacaaaucacaugaaaggugagcauaagaaauuggcagaggccauuuucaagcugacuuaucaaaacaaagugguaagggugcagcgcccaaccccuagaggcacggucauggacaucauuucucggaaggaucagagggggucaggacaggugggcaccuacggucucaauacauucacuaacauggaagcucaacuuauacgucagauggagggggaaggaaucuuuaagaguauucagcgacugaccguuacagaggagaucgccgugcaaaauugguuagcacgcgucggcagagaacggcuguccaggauggcuaucagcggcgacgauugcgugguaaaacccuuggacgaucgcuucgccucugcucucacugcccugaacgacauggggaagguuagaaaagauauucagcagugggagccaucgcggggauggaaugacuggacccaggugcccuuuugcucacaccacuuccaugaacuagucaugaaggaugguagggugcuuguggucccuugucgaaaccaagacgagcugauaggccgugcaagaaucagccagggggcgggauggucccucaaagaaacggccugccugggcaagaguuaugcucagauguggacauugauguacuuucaccgccgggauuuaaggcuggccgcaaacgcuauuuguucugccguuccaagccauugggugccgaccuccagaacuacauggucaauccacgcaaagcacgaguggaugaccacugaggacaugcucgccguauggaaucgcguguggauucaggaaaaccccuggauggaggacaaaaccccugucgaaaguugggaggaagugccauaucuugguaagcgggaggaucaauggugcgggucucugaucggacuaacaagcagggcgacgugggcuaaaaauauacagaccgccaucaaccagguucgaucccugauuggcaaugaggaauacacugacuauaugcccucaaugaagagauuccggaaagaggaagaggaagcaggcgugcucugguga

SEQ ID NO: 14689 - RNA, 9876 nt, Artificial Sequence
  derived and/or modified CDS sequence (opt3) from DENV-2__EU687216__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaagcuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguuuuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucaucccaaaaaacuucgcaggccccgucagccagcacaacuaccgaccugguuaucauacccaaacagcuggcccauggcaccucgggaagcuggaaauggauuuuaauuucugugagggaacuaccgugguugugacagaagacugcggcaacagagggcccucucuaaggacgaccacugccuccggaaaacugauuacagaguggugcugucgcucaugcacccucccgccucugcgguacagaggcgaggaugguuguugguacgggauggaaaucaggccacuuaaggagaaggaagagaauuuggucaacagucuggugacugcgggacauggccagauugacaauuuuagcuuagguguucucggcauggcccuguuccuugaagagaugcugcgcacacgaguggggaccaaacacgcuauauugcucguagcacugucguuugucacgcuaaucacuggaaacauguccuuccgggaucugggccgugugauggugauggucggggccaccaugacagacgauauuggaaugggcguuaccuaucucgcucugcuugccgcauuuaaggugagacccacuuucgcggccgguuugcuguuaaggaaacucacaucuaaggagcugaugauggcuaccaucgggauugcccuucugagccagucaacacuaccugaaacuauccucgagcugaccgacgcauuggcucugggaaugaugguauuaaaaauagugcgcaauauggaaaaguaccaacucgccgucacgaucauggcaauuaguugcgugcccaacgccguuauccugcagaaugcuuggaagguguccuguacaauucuugcggccgucucugugagcccacuguugcucaccuccucacagcagaaagcagauuggaucccucuggcucuaacuauaaagggccugaaccccaccgccauuuuucuuacaacucucagccggaccaguaaaaagagaucuuggccacugaaugaggccaucauggcuguuggcaugguguccaucuuggcaagcucgcuguuaaaaaacgacauuccgaugacggggccucucgucgccggaggucugcuuacaguaugcuaugugcugaccggcaggucagcggacuuggaacucgagcgagcugccgauguuaagugggaggaccaagcagaaauaucugggaguucccccauccugagcauuacuaucucugaggauggaagcauguccauuaaaaaugaagaggaggaacagacacuaaccauccugauacgcacuggccuucucgugaucucaggugucuucccagugaguauucccaucacagccgcugcaugguaccugugggagguaaagaagcagcgggccgggguguugugggacgucccuagcccacccccuguuggaaaagcggaauuagaggauggcgcuuauagaauuaagcagaggggcauccugggguacucucaaauaggagccgguguguauaaagaaggcaccuuucacacgauguggcaugugacucguggggcaguccucaugcaccgcggaaagcggauugagccguccugggccgacgugaaaaaggaucugaucucauacggcgguggguggaagcuugagggagaauggaaagagggcgaagagguucagguacuggcuuuggaaccaggcaagaaccccagagccgugcagaccaaaccugggaucuucaagacaaauaccggaacaauuggugcagucagucuagacuuuagcccaggcacuuccgggucucccaucguggauaggaaaggaaagguugugggccuguacgguaacggggucgugacccgaucgggagcuuauguaagcgccauagcgcagacggagaagucaauugaggacaacccugaaaucgaggaugacauuuuccggaaaaagcgccucacaaucauggaucugcauccgggcgccggcaaaacuaagagauaccuucccgcaauagucagggaagcuauuaaacggggguuacgaacccugauccucgccccaacaagagugguugcugcagagauggaagaggccuugcgcggacugccuaucagguaucaaacccccgccauucgugcugagcacacuggucgggaaaucguggaccucaugugucaugcgaccuucacaaugagacugcuuuccccagucagggugccuaauuacaaccugauuauaauggacgaggcacacuuuacggaucccgccaguaucgcugcccgcggcuauauuucuacucgaguugaaaugggggaggcagccggaaucuucaugaccgcuacaccaccgggcagcagagacccuuuuccccaguccaaugcgccaaucauggaugaggaacgggagauucccgaaaggucauggaacucuggucacgagugggugaccgacuucaaggggaagacugucugguuugugccuagcauaaaagccggaaaugauaucgcagcuugcuugcgcaagaacggcaaaaagguaauucagcuaagucguaaaacauucgacuccgaauacgugaagaccagagccaaugauugggacuuuguugucacgacugauaucagcgagaugggcgcaaacuucaaggccgagcgggugauugacccaaggcgcuguaugaaacccgugauccugacagauggggaagagcgagucauacucgcuggaccuaugccgguaacccauucuucagccgcgcaaagacgggguaggaucggccgcaauccaaagaacgaaaaugaccaguauauuuacaugggggagcccuuagaaaacgacgaggauugcgcacacuggaaagaggccaagaugcugcuugacaauaucaacaccccugaaggaauuauccccuccauguuugagccagaaagagagaaaguggaugcuauagacggcgaauacaggcugcggggugaggcccguaagacuuucguugagcucaugcgccgaggggauuugccuguguggcuggcuuauaaagucgcagccgaaggcauuaauuacgcugacagaaagugguguuuugauggaaucaagaacaaccagauucucgaggaaaauguggagguugagaucuggacaaaagaaggcgagaggaagaaacugaagccccgguggcuugacgcccgcauauauagugauccacuagcacugaaagaauucaaggaguucgcggccgggagaaagagcuugaccuuaaaccugaucacagaaaugggaaggcucccuacuuuuaugacgcagaaagcucggaaugcccuggacaaccuugcagugcugcauaccgcugaggucgguggccgagccuacaaucacgcacucucggaguugccggaaacacuggagacucuacugcuccuuacccuguuagccacagugaccgggggaauuuucuuguuucugaugucuggcaaggguguagggaaaaugacucucggcaugugcugcaucauuacggcuuccauccugcuuugguaugcgcaaauacagccccacuggauugccgcaagcaucauccuggaauucuuucucauuguguugcugaucccagagccugaaaagcagagaaccccccaggauaaccaauuaacauacguugucauagcuauucuaacugugguggccgccaccauggcaaaugagaugggauuccuggagaaaacaaagaaggaccucggcuuugggucaaucaccacucaggaaagugagucuaacauucuugauaucgaccugcgcccagcuuccgccuggacauuguaugcggucgcuacgaccuucauaacuccuaugcugaggcauagcaucgaaaauucaaguguuaacgugagccucacagccauugcaaaucaggccaccguacugaugggacuugguaaaggcuggccccucuccaagauggacaucggggugccgcuguuggcuauuggauguuacucucaggucaacccaaucacccugacagcagccuuacuacugcucguggcgcacuacgcuauuaucggcccuggucuucaagccaaagcaacucgggaggcccagaagcgugcugccgcagggauaaugaaaaaucccacgguugauggcauuaccgugaucgaccuggaaccaauccccuaugauccuaaguuugagaagcaguugggacaggucaugcugcucauucugugcguaacacaagugcuuaugaugagaacuaccugggcuuuaugugaggcccugacacucgcgaccggcccgauaagcacuuugugggaagggaaccccggaagguucuggaauacgacaaucgccguuuccauggcaaacauuuuucgcggcucauaccuggcuggugccgggcuacuguucucuaucaugaaaaauaccacuaacacccggcgaggaacaggcaacgugggugagacucucggcgaaaaguggaaaaguagacuuaaugcacuggggaagucggaguuucagauuuauaaaaagagcggaauccaggaggucgacaggaccuuggcuaaagaaggcauaaagcgcggggagacagaucaucacgccgugucccggggaucugccaagcugagaugguucgucgaacguaacauggugacgccagagggcaaaguuguggaccucgguugcgggaggggaggcuggucauacuauugugguggccugaagaauguacgggaagugaaaggguuaaccaagggaggcccugggcaugaggagcccaucccuaugagcacuuacggauggaaccuuguccgccugcaauccggcguugauguguucuuuacaccacccgaaaaaugcgacacccuccuaugugauauuggugagaguucuccuaauccaacuaucgaagcggggcgaacacugagagucuugaaccugguggagaauuggcucaacaauaacacccaguucugcauuaagguacuuaaucccuauaugccgagcgugaucgaaaagauggagacgcugcagaggaaauacggaggcgcuuugguucggaacccucugucacgcaauuccacccacgagauguacugggugaguaacgcaacaggcaauauagucagcucugugaacaugauuuccagaaugcucaucaacagguuuacuaugaagcacaaaaaggccaccuaugaaccagacgucgauuuagggucaggaacacgaaauaucgguauugagagcgaaauacccaaccuggacaucauuggcaaacggaucgagaagauuaagcaggaacaugagacuucguggcacuacgaucaagaccauccuuauaaaaccugggcuuaccacgggucuuaugagacaaagcagaccggaagugccuccagcauggugaauggcguuguacgucuucugacuaaaccaugggacgugguccccauggugacgcagauggcaaugacagauaccacuccguucggucagcaaagaguuuuuaaggaaaaaguggacacccgcacacaggagccuaaggaagggacgaagaaacuaaugaagaucaccgccgaguggcucuggaaagagcugggaaaggaaaaaacucccaggauguguacacgggaggaauucaccagaaagguccgcucaaacgcugcguugggcgccauauuuacugaugagaauaaauggaaguccgcaagggaagcuguggaggacggccgauucugggagcugguagaucgggaaagaaaccuccaccuugaggggaagugcgaaacauguguguacaauaugaugggaaaaagggagaagaaacugggugaauuuggcaaggccaaagggucucgcgcaaucugguauaugugguuaggagcccguuuccuggaguuugaggcuuugggcuuccucaacgaagaccauugguuuagccgggguaauagucuguccgggguugagggagaaggccuacacagacuuggcuacauucugagggaggucgggaagaaggaaggaggugccauguacgcggaugacaccgcaggcugggauacacgcaucacucucgaggaccugaaaaacgaggaaauggugaccaaucauaugaagggggagcacaaaaaguuggccgaagcuauuuucaaacugacguaucagaacaaggugguccgaguucagcggccaaccccuagaggaacagugauggauaucauuagcaggaaggaccaacgcggcucuggucagguagggacuuacggacucaauaccuucacaaacauggaggcccagcuuauaagacaaauggagggcgaaggcaucuuuaaaucaauucagcaucugacugcaaccgaggaaaucgcugugcagaauugguuagcccgggucgggagggagcgucugagucgaauggcuaucuccggagacgauugcgugguuaagcccauugacgaucgcuucgccagcgcauugacggcgcucaacgacauggguaaagugagaaaggauauacagcaaugggaaccaucucggggcuggaacgacuggacacagguccccuuuugcucgcaccacuuccaugagcuggugaugaaagaugggaggguacuaguugugccuugucgcaaucaggacgagcuuaucggaagagcccggauuucacagggcgcugguuggagccugaaggaaaccgccugccucgggaaguccuaugcacaaauguggacucugauguacuuucacaggcgagauuugcguuuagcugccaacgcaaucuguagugccgucccaucucauugggugccgacaagcagaaccacuugguccauucacgcgaaacacgaguggaugaccacagaagacaugcuggcuguguggaaucgcgucuggauccaggagaaccccuggauggaagauaagacgccuguugagucaugggaggaagugccauaucucggaaaacgggaggaccaguggugcggcagucuuauaggccugaccucuagggccacuugggcaaagaauauccagacagccauuaaccaaguaagaagccuaaucgggaaugaagaguacaccgauuauaugcccuccaugaaacgcuuccggagggaagaggaggaagcuggagugcugugguga

SEQ ID NO: 14690 - RNA, 9876 nt, Artificial Sequence
  derived and/or modified CDS sequence (opt3) from DENV-2__EU726770__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauuaaaggaaucaugcaggccggcaagcgcucucugagaccucagccaaccgaacuuaaauauucguggaagacuugggggaaggcuaaaauguugagcacagagucccauaaccaaaccuuccugauugauggaccggaaacagccgagugccccaauacuaacagggcauggaauucacucgaggucgaagacuacggcuuugguguuuucaguaccaacaucuggcugaaguuacgugagaaacaggacguguuuugugauucuaagcugaugagcgcggcuauaaaagacaaucgggccgugcacgcagauaugggguauuggauugaauccgcccuuaacgacacguggaagauggagaaggcuucauucaucgagaucaaaagcugccacuggccuaagucucauacauugugguccaauggaguacucgaaagugagaugauuaucccaaaaaacuucgccggccccgucagccagcacaacuaccgaccugguuaucauacccagacugcaggcccauggcaccuggggaagcuagaaauggauuuugacuucugugagggaaccacagugguugugacugaagauugcggcaauagagggcccucucugaggaccacaacggcuuccggaaaacucauuaccgaguggugcugucgcucaugcacucugccgccucuucgguacagaggcgaggacgguuguugguacgggauggaaauaaggccauugaaggagaaggaagagaaccuggucaauaguuuagugacagccggacauggccaaaucgauaacuuuagccucgguguucugggcauggcgcuuuuccuggaagagauguugcgcacccgaguggggacuaaacacgccauucuccugguagcugucucguuugugacacuaaucaccggaaauauguccuuccgggaccugggccgugugauggucaugguuggggcaacgaugacugaugacauuggaaugggcgugaccuaucucgcccugcuugcugccuuuaagguaagacccacauucgcagcggguuugcuguuaaggaaacucaccucuaaggagcugaugauggccacuaucgggauagcucuucugagccagucaacaaucccugaaaccauucuagagcucacagaugcccuggcauugggaaugauggugcugaaaaucguccgcaacauggaaaaguaccaguuagcugugacuauuauggccaucaguugcguucccaaugcagugauacuccaaaacgccuggaaggucuccuguaccauucuggcugcggugucuguuagcccacuucuguugacguccucacagcagaaagccgacuggaucccucucgcacugacaaucaagggccuaaaucccaccgcuauuuuucugacuacccuuagccggacaaguaaaaagagaucuuggccacucaacgaggccgugauggccgucggcaugguauccauacuggcuagcucguugcugaaaaaugacaucccgaugacugggccuuuaguggcaggaggucuccugaccguuugcuaugugcuuacgggcaggucagccgaucuggaauuggagcgagcggcugacgucaagugggaggaucaggccgaaauuucugggaguucccccauccucagcauuacaaucucugaggacggaagcauguccauaaaaaacgaagaggaggaacacacccugacuauccuaauucgcacaggccugcuugugaucucagguguauucccagugaguauucccaucaccgcagccgcuugguaccucugggaggucaagaagcaacgggcagggguucugugggaugugccuagcccacccccugugggaaaagccgaauuggaggacggcgcguauagaauaaagcagaggggcauuuuuggguacucucagaucggagcuggugucuauaaagaaggcacuuuccauacaauguggcacgugacccguggggccguuuuaaugcaucgcggaaagcggaucgagccguccugggcagauguaaaaaaggaccugauuucauacggcgguggguggaagcucgagggagaauggaaagagggcgaagaggugcagguccuggcccuugaaccaggcaagaaucccagagcugugcaaacgaaaccugggcuguuuaagacuaacaccggaacaaucggugccguuaguuuggauuucagcccaggcaccuccgggucucccauaguggacaggaaaggaaaggucgugggccuauacgguaaugggguagucacacgaucgggagcauaugugagcgcuauugcccagacugagaagucaaucgaggauaacccugaaauugaggacgauaucuuccggaaaaagcgccugaccauaauggaccuccacccgggcgcgggcaaaacgaagagauaccugcccgccauuguuagggaagcaaucaaacgggggcuucgaacauuaauccuggcuccaacuagaguggucgccgcugagauggaagaggcacuccgcggauugccuauuagguaucagacccccgccauccgugccgagcauacaggucgggaaauuguggaccugaugugucacgcuaccuuuacuaugagacuccuguccccaguuagggugccuaacuacaaucuuauaaucauggaugaggcgcacuucaccgaccccgcaaguauugccgcucgcggcuauaucucuacacgagucgaaaugggggaggccgcaggaaucuuuaugacggccacuccaccgggcagcagagauccuuucccccaguccaacgcuccaauuauggacgaggaacgggagauacccgaaaggucauggaauucuggucaugagugggugaccgauuuuaaggggaagacaguaugguucgugccuagcaucaaagcgggaaacgacauugccgcaugccugcgcaagaauggcaaaaagguuauccaauugagucguaaaaccuuugauuccgaauacgucaagacuagagcuaacgacugggauuucguggugacaaccgacauuagcgagaugggcgccaauuuucgggcagagagggucaucgauccacgccgauguaugaagcccguaauacuaacggacggggaagagagagugauccuggccggaccuaugccgguuacucacucuucagcugcccagcggaggggucgcauuggcagaaacccaaaaaaugaaaacgaccaguauaucuacaugggggagccccucgaaaaugaugaggacugcgcgcauuggaaggaggcaaaaauguuacuggauaacauuaauacaccugaaggaaucauacccuccauguucgagccagaaagggagaagguggacgccauugauggcgaauaccggcuucguggugaggcucgcaaaaccuuugucgaccugaugcgaagaggggaucucccugugugguuggccuauaggguugcugcagagggcaucaacuacgccgaccggcgcugguguuucgauggaauuaagaauaaccaaauccuggaagagaacguggaagucgagauauggaccaaagagggcgaaagaaagaagcucaaacccagguggcuggacgcucggaucuauagugauccacuugcccuaaaggaguucaaagaauuugcagcggggcgaaagagccugacuuugaauuuaauuacagagaugggaagacugccuaccuucaugacacagaaagcccgcgacgcucucgauaaccuggccgugcuucacacugcagaaguagguggcagggcuuacaaucacgcccugucggagcucccggagacguuggaaacccugcuacugcucacacuucuggcaacugugaccgggggaaucuuuuuauucuugaugucuggcaaggguauugggaagaugacacugggcaugugcugcaucauaaccgccuccauucuccugugguaugcucagauccagccccauuggaucgcggccagcauuauccuugaguuuuuccugauaguucucuugauuccagaaccugagaaacaacggacuccccaggacaaccagcugacguacgucgugaucgcaauuuuaaccguggucgcugccacaauggccaaugaaaugggauuucuagagaagacuaaaaaggaccugggccucgggucaaucaccacacaggagagugaaucuaacauacuugauaucgaccugcguccagcauccgcuuggaccuuguaugccguugcgacuacauucgugacgccuaugcugagacacagcauugagaauucaaguguaaacgugagccucaccgcuaucgccaaucaagcaacuguccugaugggacuugguaggggcuggccccucuccaaaauggauauuggggugccgcuguuggccaucggauguuacucucagguuaacccaauuacacugaccgcugcauuacuacugcucguggcccauuacgcgaucauaggcccuggucuucaggcuaaggccacccgcgaagcacagaagcggacagccgcugggauuaugaaaaaucccacugucgacggcaucacgguaaucgaucuggagccaauucccuaugacccuaaguuugaaaaacaauugggacaggugaugcugcucguucugugcgugacccagguccuuaugaugcgaacaacuugggccuuaugugaggcacugacccucgcuacaggcccgauaagcaccuugugggaggggaaccccggaagauucuggaauacuacgaucgccguguccauggcgaacauuuuuaggggcucauaccuggccggugcagggcuacuguucucuaucaugaagaauacaaccaacacucgccggggaaccggcaauauuggugaaacacucggcgagaaauggaagaguagacuuaacgcucuggggaagucggaauuucagaucuauaaaaagagcggaauacaagaggucgaucguacuuuggccaaagagggcaucaagaggggggaaaccgaccaccaugcagugucccggggaucugcuaaacugcgcugguucguugagcgaaacauggugacaccagaaggcaagguaguggaucucgguugcgggagaggaggcuggucauacuauugugguggccugaaaaaugucagggagguuaagggguuaacgaagggaggcccugggcacgaagagcccauuccuaugagcaccuacggauggaaccuugugcggcugcaguccggcgucgacguguucuuuacuccacccgagaaaugcgauacacuccuaugugacaucggugaaaguucuccuaauccaaccauugaggccgggcgcacucugagaguauugaaccugguggaaaauuggcucaacaauaacacacaguucugcguuaaggugcuuaaucccuauaugccgagcgucaucgagaaaauggaaacccugcaaaggaaguacggaggcgccuuggugcgaaacccucugucacggaauuccacgcacgagauguacugggucaguaacgcgaccggcaauauagugagcucuguuaacaugauuucccguaugcucaucaauagauuuacaaugaaacauaagaaggcuacuuaugagccagauguagacuuagggucaggaacccgcaacaucgguauugaaaacgagauacccaaucuggacaucauuggcaaaaggaucgaaaagauuaaacaggagcacgaaacaagcuggcauuacgaucaggaccacccuuauaagacuugggcauaccacgggucguaugagaccaaacagacaggaucugccaguuccauggugaacggcgucgugaagcuucugaccaagccaugggauguugugcccauggucacucaaauggcuaugacggacacaaccccguucggucagcagcggguguuuaaagagaagguagauacuagaacccaggaaccuaaagaggggacaaagaaacuaaugcgcaucacggccgaauggcucuggaaggagcugggaaagaaaaagacccccaggauguguacucgagaggaauucacacggaaagugagaagcaaugcagccuugggcgcuauauuuaccgacgagaacaaguggaaaucagcgagggaagccguugaggauucccgcuucugggaacuggucgaccgugagcggaaucuccaucuugagggcaagugcgaaacuuguguguacaacaugauggggaaaagagagaagaagcugggagaauuugguaaagcaaagggcucuagggcuaucugguauaugugguuaggggcccgcuuccuggaguuugaagcauugggauuccucaaugaggaucacugguuuagccgaggcaacagucuguccgguguggagggggaaggacuacauaaacuuggcuacauucugcgggacgucagcaagaaagagggcgggacaauguacgccgaugacaccgcuggaugggacacaagaaucacucucgaagaucugaagaaugaggaaaugguuaccaaccacaugaagggugagcauaaaaaguuggccgaggcgauuuucaaacugacguaucaaaauaaggugguaagggugcagcgcccaaccccuagaggcacagucauggacaucauuucucggaaagaucagagggggucaggacaggugggcacuuacggucucaacaccuucacaaauauggaagcacaacuuauacgucagauggagggggaaggaaucuuuaagaguauucagcgacugacuguuaccgaggagaucgccgugcaaaacugguuagcucgcgucggcagagaacggcuguccaggauggccaucagcggcgacgauugcgugguaaagcccuuggacgaucgcuucgcaucugcucucacggcccugaaugacauggggaaaguuagaaaggauauucagcagugggagccaucgcggggauggaacgacuggacacaggugcccuuuugcucacaccacuuccaugaacuagucaugaaagaugguagggugcuuguggucccuugucgaaaccaagacgagcugauaggccgugcuagaaucagccagggggccggauggucccucaaggaaaccgcaugccugggcaaaaguuaugcgcagauguggacuuugauguacuuucaccgccgggauuuaaggcuggccgcuaaugccauuuguucugcaguuccaagccauugggugccgacauccagaaccacuuggucaauccacgcuaagcacgaguggaugaccacagaggacaugcucgccguauggaaccgcguguggauucaggaaaaucccuggauggaggacaagacgccugucgaaaguugggaggaagugccauaucuugguaaacgggaggaucaauggugcgggucucugaucggacuaaccagcagggcaacuugggccaagaacauacagacagcgaucaaucagguucgaucccugauuggcaacgaggaauacaccgacuauaugcccucaaugaaaagauuccggaaggaggaagaggaagcuggcgugcucugguga

SEQ ID NO: 14691 - RNA, 9876 nt, Artificial Sequence
  derived and/or modified CDS sequence (opt3) from DENV-2__EU781135__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauuaaaggaaucaugcaggccggcaagcgcucucugagaccucagccaaccgaacuuaaauauucguggaagacuugggggaaggcuaaaauguugagcacagagucccauaaccaaaccuuccugauugauggaccggaaacagccgagugccccaauacuaacagggcauggaauucacucgaggucgaagacuacggcuuugguguuuucaguaccaacaucuggcugaaguuacgugagaaacaggacguguuuugugauucuaagcugaugagcgcggcuauaaaagacaaucgggccgugcacgcagauaugggguauuggauugaauccgcccuuaacgacacguggaagauggagaaggcuucauucaucgagaucaaaagcugccacuggccuaagucucauacauugugguccaauggaguacucgaaagugagaugauuaucccaaaaaacuucgccggccccgucagccagcacaacuaccgaccugguuaucauacccagacugcaggcccauggcaccuggggaagcuagaaauggauuuugacuucugugagggaaccacagugguugugacugaagauugcggcaauagagggcccucucugaggaccacaacggcuuccggaaaacucauuaccgaguggugcugucgcucaugcacucugccgccucuucgguacagaggcgaggacgguuguugguacgggauggaaauaaggccauugaaggagaaggaagagaaccuggucaauaguuuagugacagccggacauggccaaaucgauaacuuuagccucgguguucugggcauggcgcuuuuccuggaagagauguugcgcacccgaguggggacuaaacacgccauucuccugguagcugucucguuugugacacuaaucaccggaaauauguccuuccgggaccugggccgugugauggucaugguuggggcaacgaugacugaugacauuggaaugggcgugaccuaucucgcccugcuugcugccuuuaagguaagacccacauucgcagcggguuugcuguuaaggaaacucaccucuaaggagcugaugauggccacuaucgggauagcucuucugagccagucaacaaucccugaaaccauucuagagcucacagaugcccuggcauugggaaugauggugcugaaaaucguccgcaacauggaaaaguaccaguuagcugugacuauuauggccaucaguugcguucccaaugcagugauacuccaaaacgccuggaaggucuccuguaccauucuggcugcggugucuguuagcccacuucuguugacguccucacagcagaaagccgacuggaucccucucgcacugacaaucaagggccuaaaucccaccgcuauuuuucugacuacccuuagccggacaaguaaaaagagaucuuggccacucaacgaggccauaauggccgugggcauggucuccauccuggcuagcucguugcugaaaaaugacauuccgaugacugggccuuuaguagcaggaggucuccugaccgugugcuauguucuuacgggcaggucagccgaucuggaauuggagcgagcggcugacgugaagugggaggaucaggccgaaaucucugggaguucccccauucucagcaucacaauaucugaggacggaagcauguccaucaaaaacgaagaggaggaacacacccugacuauucuaauccgcacaggccugcuugucauuucagguguguucccaguaaguauccccauaaccgcagccgcuugguaccucugggaggugaagaagcaacgggcagggguccugugggauguuccuagcccacccccugugggaaaagccgaauuggaggacggcgcguauagaauuaagcagaggggcaucuuuggguacucucagaucggagcugguguguauaaagaaggcacuuuccauacaauguggcacgucacccguggggccguguuaaugcaucgcggaaagcggauugagccguccugggcagauguuaaaaaggaccugaucucauacggcgguggguggaagcucgagggagaauggaaagagggcgaagagguacaggugcuggcccuugaaccaggcaagaaucccagagcuguccaaacgaaaccugggcuguuuaagacuaacaccggaacaauaggugccgugaguuuggauuucagcccaggcaccuccgggucucccauuguugacaggaaaggaaagguggucggccuauacgguaauggggugguaacacgaucgggagcauaugucagcgcuaucgcccagacugagaagucaauugaggauaacccugaaaucgaggacgauauauuccggaaaaagcgccugaccauuauggaccuccacccgggcgcgggcaaaacgaagagauaccugcccgccaucgugagggaagcaaucaaacgggggcuucgaacauuaauucuggcuccaacuagaguuguggccgcugagauggaagaggcacuccgcggauugccuaucagguaucagacccccgccauucgugccgagcauacaggucgggaaauagucgaccugaugugucacgcuaccuuuacuaugagacuccuguccccagugaggguuccuaacuacaaucuuaucauuauggaugaggcgcacuucaccgaccccgcaaguaucgccgcucgcggcuauaucucuacacgaguggaaaugggggaggccgcaggaauuuuuaugacggccacuccaccgggcagcagagauccuuucccccaguccaacgcuccaauaauggacgaggaacgggagauccccgaaaggucauggaauucuggucaugagugggucaccgauuuuaaggggaagacagugugguucguaccuagcauuaaagcgggaaacgacaucgccgcaugccugcgcaagaauggcaaaaaggugauucaauugagucguaaaaccuuugauuccgaauacguuaagacuagagcuaacgacugggauuucgucgugacaaccgacaucagcgagaugggcgccaauuuucgggcagagagggugauagauccacgccgauguaugaagcccgucauccuaacggacggggaagagagaguaauucuggccggaccuaugccggugacucacucuucagcugcccagcggaggggucgcaucggcagaaacccaaaaaaugaaaacgaccaguauauuuacaugggggagccccucgaaaaugaugaggacugcgcgcauuggaaggaggcaaaaauguuacuggauaacaucaauacaccugaaggaauaauucccuccauguucgagccagaaagggagaagguugacgccaucgauggcgaauaccggcuucguggugaggcucgcaaaaccuuuguggaccugaugcgaagaggggaucucccugucugguuggccuauaggguggcugcagagggcauuaacuacgccgaccggcgcugguguuucgauggaaucaagaauaaccaaauacuggaagagaacguugaaguggagaucuggaccaaagagggcgaaagaaagaagcucaaacccagguggcuggacgcucggauuuauagugauccacuugcccuaaaggaguucaaagaauuugcagcggggcgaaagagccugacuuugaauuuaaucacagagaugggaagacugccuaccuucaugacacagaaagcccgcgacgcucucgauaaccuggccguccuucacacugcagaaguggguggcagggcuuacaaucacgcccugucggagcucccggagacguuggaaacccugcuacugcucacacuucuggcaacuguaaccgggggaauuuuuuuauucuugaugucuggcaaggguaucgggaagaugacacugggcaugugcugcauaauuaccgccuccauccuccugugguaugcucagauccagccccauuggauugcggccagcaucauacuugaguuuuuccugauugugcucuugaucccagaaccugagaaacaacggacuccccaggacaaccagcugacguacguugucauugcaaucuuaaccgugguggcugccacaauggccaaugaaaugggauuucuagagaagacuaaaaaggaccugggccucgggucaauaaccacacaggagagugaaucuaacauccuugauauugaccugcguccagcauccgcuuggaccuuguaugccgucgcgacuacauucguuacgccuaugcugagacacagcaucgagaauucaagugugaacguaagccucaccgcuauugccaaucaagcaacugugcugaugggacuugguaggggcuggccccucuccaaaauggauaucggggucccgcuguuggccauuggauguuacucucaggugaacccaaucacacugaccgcugcauuacuacugcucguugcccauuacgcgauaauuggcccuggucuucaggcuaaggccacccgcgaagcacagaagcggacagccgcugggaucaugaaaaaucccacuguggacggcaucacggucauugaucuggagccaauacccuaugacccuaaguuugaaaaacaauugggacagguaaugcugcucgugcugugcguuacccaggugcuuaugaugcgaacaacuugggccuuaugugaggcacugacccucgcuacaggcccgaucagcaccuugugggaggggaaccccggaagauucuggaauacuacgauugccgucuccauggcgaacaucuuuaggggcucauaccuggccggugcagggcuacuguucucuauuaugaagaauacaaccaacacucgccggggaaccggcaauaucggugaaacacucggcgagaaauggaagaguagacuuaacgcucuggggaagucggaauuucagauauauaaaaagagcggaauccaagagguggaucguacuuuggccaaagagggcauuaagaggggggaaaccgaccaccaugcagucucccggggaucugcuaaacugcgcugguucguggagcgaaacaugguuacaccagaaggcaaggugguagaucucgguugcgggagaggaggcuggucauacuauugugguggccugaaaaaugugagggaggucaagggguuaacgaagggaggcccugggcacgaagagcccaucccuaugagcaccuacggauggaaccuuguucggcugcaguccggcguggacgucuucuuuacuccacccgagaaaugcgauacacuccuaugugacauuggugaaaguucuccuaauccaaccaucgaggccgggcgcacucugagaguguugaaccugguagaaaauuggcucaacaauaacacacaguucugcgugaagguucuuaaucccuauaugccgagcgugauagagaaaauggaaacccugcaaaggaaguacggaggcgccuugguccgaaacccucugucacggaauuccacgcacgagauguacugggugaguaacgcgaccggcaauauugucagcucugugaacaugaucucccguaugcucaucaauagauuuacaaugaaacauaagaaggcuacuuaugagccagauguugacuuagggucaggaacccgcaacauugguauagaaaacgagauccccaaucuggacauuaucggcaaaaggauugaaaagaucaaacaggagcacgaaacaagcuggcauuacgaucaggaccacccuuauaagacuugggcauaccacgggucguaugagaccaaacagacaggaucugccaguuccaugguaaacggcguggucaagcuucugaccaagccaugggaugugguucccauggugacucaaauggcuaugacggacacaaccccguucggucagcagcgggucuuuaaagagaagguggauacuagaacccaggaaccuaaagaggggacaaagaaacuaaugcgcauaacggccgaauggcucuggaaggagcugggaaagaaaaagacccccaggauguguacucgagaggaauucacacggaaaguaagaagcaaugcagccuugggcgcuaucuuuaccgacgagaacaaguggaaaucagcgagggaagccguggaggauucccgcuucugggaacugguugaccgugagcggaaucuccaucuugagggcaagugcgaaacuugugucuacaacaugauggggaaaagagagaagaagcugggagaauuugguaaagcaaagggcucuagggcuauuugguauaugugguuaggggcccgcuuccuggaguuugaagcauugggauuccucaaugaggaucacugguuuagccgaggcaacagucuguccgguguggagggggaaggacuacauaaacuuggcuacauccugcgggacgugagcaagaaagagggcggggccauguacgcugaugacacagccggaugggacaccagaauuacacucgaagaucugaagaaugaggaaauggucacuaaccacaugaagggugagcauaaaaaguuggcggaggcaaucuucaaacugaccuaucaaaauaagguugugaggguacagcgcccaacgccuagaggcaccgugauggacauuauaucucggaaagaucagagggggucaggacaggucggcacauacggucucaacacuuucaccaauauggaagcccaacuuauccgucagauggagggggaaggaauuuuuaagaguauccagcgacugacagugacugaggagaucgcuguucaaaacugguuagcccgcgugggcagagaacggcuguccaggauggcaauuagcggcgacgauugcgucgugaagcccuuggacgaucgcuucgcuucugcccucaccgcucugaaugacauggggaaaguaagaaaggauauacagcagugggagccaucgcggggauggaacgacuggacgcagguucccuuuugcucacaccacuuccaugaacuagugaugaaagaugguaggguccuuguggugccuugucgaaaccaagacgagcugaucggccgugccagaauuagccagggggcaggauggucccucaaggaaacagcgugccugggcaaaaguuaugcccagauguggaccuugauguacuuucaccgccgggauuuaaggcuggcugccaaugcaaucuguucugcugucccaagccauuggguuccgacuuccagaacaaccuggucaauucacgccaagcacgaguggaugacuaccgaggacaugcucgcaguguggaaccgcguauggauccaggaaaaucccuggauggaggacaagacaccuguggaaaguugggaggaagucccauaucuugguaaacgggaggaucaauggugcgggucucugauaggacuaacgagcagggccaccugggcgaagaacauccagacugcuauuaaucaggugcgaucccugaucggcaacgaggaauacacagacuauaugcccucaaugaaaagauuccggaaggaggaagaggaagccggcguucucugguga

SEQ ID NO: 14692 - RNA, 9876 nt, Artificial Sequence
  derived and/or modified CDS sequence (opt3) from DENV-2__EU687222__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagaucaaaucuugccacuggccuaagucccauacguuguggaguaauggaguacucgaaagcgagaugauuaucccaaaaaacuucgccggccccgucucucagcacaacuaccgaccugguuaucauacacagaccgcaggcccauggcaccuggggaagcuagaaauggauuuugacuucugugagggaacuaccgugguugugacagaagauugcggcaauagagggcccucccugaggacuaccacagcuucaggaaaacucauuacggaguggugcugucgcaguugcacccugccgccucuucgguacagaggcgaggacgguuguugguacgggauggaaauaaggccauugaaggagaaggaagagaaccuggucaauagcuuagugacugccggacauggccaaaucgauaacuuuucgcucgguguucugggcauggcgcuuuuccuggaagagauguugcgcacacgaguggggaccaaacacgccauucuccugguagcugucuccuuugugacucuaaucacaggaaauaugucuuuccgggaccugggccgugugauggucaugguuggggcaaccaugacggaugacauuggaaugggcgugacuuaucucgcccugcuugcugccuuuaagguaagacccaccuucgcagcggguuugcuguuaaggaaacucacaagcaaggagcugaugauggccaccaucgggauagcucuucugucacagaguacuaucccugaaacaauucuagagcucaccgaugcccuggcauugggaaugauggugcugaaaaucguccgcaacauggaaaaguaccaguuagcugugacaauuauggccaucuccugcguucccaaugcagugauacuccaaaacgccuggaaggucucuuguacuauucuggcugcggugagcguuuccccacuucuguugaccucaagccagcagaaagccgacuggaucccucucgcacugacgaucaagggccuaaaucccacagcuauuuuucugaccacucuuagucggaccucuaaaaagagauccuggccacucaacgaggccgugauggccgucggcaugguaagcauacuggcuucgucauugcugaaaaaugacaucccgaugacagggccuuuaguggcaggaggucuccugacuguuugcuaugugcuuaccggcaggucugccgaucuggaauuggagcgagcggcugacgucaagugggaggaucaggccgaaauuaguggguccagccccauccucucuauuacgaucagcgaggacggauccaugucaauaaaaaacgaagaggaggaacacacacugaccauccuaauucgcacuggccugcuugugaucagugguguauucccagugagcauucccaucacagcagccgcuugguaccucugggaggucaagaagcaacgggcagggguucugugggaugugccuucuccacccccugugggaaaagccgaauuggaggacggcgcguauagaauaaagcagaggggcauuuuuggguacucccagaucggagcuggugucuauaaagaaggcaccuuccauacuauguggcacgugacacguggggccguuuuaaugcaucgcggaaagcggaucgagccgucaugggcagauguaaaaaaggaccugauuaguuacggcgguggguggaagcucgagggagaauggaaagagggcgaagaggugcagguccuggcccuugaaccaggcaagaaucccagagcugugcaaaccaaaccugggcuguuuaagacgaacacuggaaccaucggugccguuagcuuggauuucuccccaggcacaucugggucgcccauaguggacaggaaaggaaaggucgugggccuauacgguaaugggguagucacccgaagcggagcauaugugucagcuauugcccagacagagaaguccaucgaggauaacccugaaauugaggacgauaucuuccggaaaaagcgccugacuauaauggaccuccacccgggcgcgggcaaaaccaagagauaccugcccgccauuguuagggaagcaaucaaacgggggcuucgaacguuaauccuggcuccaacaagaguggucgccgcugagauggaagaggcacuccgcggauugccuauuagguaucagacucccgccauccgugccgagcauaccggucgggaaauuguggaccugaugugucacgcuacauuuaccaugagacuccugaguccaguuagggugccuaacuacaaucuuauaaucauggaugaggcgcacuucacugaccccgcaucuauugccgcucgcggcuauaucagcacccgagucgaaaugggggaggccgcaggaaucuuuaugacagccacgccaccgggcuccagagauccuuucccccagucaaacgcuccaauuauggacgaggaacgggagauacccgaaaggucuuggaauagcggucaugagugggugacugauuuuaaggggaagaccguaugguucgugccuaguaucaaagcgggaaacgacauugccgcaugccugcgcaagaauggcaaaaagguuauccaauugucccguaaaacauuugauagcgaauacgucaagaccagagcuaacgacugggauuucguggugacuacagacauuucugagaugggcgccaauuuucgggcagagagggucaucgauccacgccgauguaugaagcccguaauacuaaccgacggggaagagagagugauccuggccggaccuaugccgguuacgcacucauccgcugcccagcggaggggucgcauuggcagaaacccaaaaaaugaaaacgaccaguauaucuacaugggggagccccucgaaaaugaugaggacugcgcgcauuggaaggaggcaaaaauguuacuggauaacauuaauacuccugaaggaaucauacccaguauguucgagccagaaagggagaagguggacgccauugauggcgaauaccggcuucguggugaggcucgcaaaacauuugucgaccugaugcgaagaggggaucucccugugugguuggccuauaggguugcugcagagggcaucaacuacgccgaccggcgcugguguuucgauggaauuaagaauaaccaaauccuggaagagaacguggaagucgagauauggaccaaagagggcgaaagaaagaagcucaaacccagguggcuggacgcucggaucuauagcgauccacuugcccuaaaggaguucaaagaauuugcagcggggcgaaagucgcugaccuugaauuuaauuacugagaugggaagacugccuacauucaugacccagaaagcccgcgacgcucucgauaaccuggccgugcuucacacagcagaaguagguggcagggcuuacaaucacgcccugucugagcucccggagacuuuggaaacgcugcuacugcucacccuucuggcaacagugacugggggaaucuuuuuauucuugauguccggcaaggguauugggaagaugacccugggcaugugcugcaucauaacagccagcauucuccugugguaugcucagauccagccccauuggaucgcggccucaauuauccuugaguuuuuccugauaguucucuugauuccagaaccugagaaacaacggaccccccaggacaaccagcugacuuacgucgugaucgcaauuuuaacgguggucgcugccaccauggccaaugaaaugggauuucuagagaagacaaaaaaggaccugggccucgggaguaucacuacccaggagucugaauccaacauacuugauaucgaccugcguccagcaagcgcuuggacauuguaugccguugcgaccacuuucgugacaccuaugcugagacacucaauugagaauaguagcguaaacgugucccucacggcuaucgccaaucaagcaaccguccugaugggacuugguaggggcuggccccucucuaaaauggauauuggggugccgcuguuggccaucggauguuacagccagguuaacccaauuacucugacagcugcauuacuacugcucguggcccauuacgcgaucauaggcccuggucuucaggcuaaggccacccgcgaagcacagaagcggaccgccgcugggauuaugaaaaaucccacagucgacggcaucacuguaaucgaucuggagccaauucccuaugacccuaaguuugaaaaacaauugggacaggugaugcugcucguucugugcgugacgcagguccuuaugaugcgaaccacaugggccuuaugugaggcacugacucucgcuaccggcccgauauccacauugugggaggggaaccccggaagauucuggaauaccacuaucgccgugucaauggcgaacauuuuuaggggcucuuaccuggccggugcagggcuacuguucaguaucaugaagaauacgacaaacacccgccggggaacuggcaauauuggugaaacccucggcgagaaauggaagucgagacuuaacgcucuggggaagagcgaauuucagaucuauaaaaaguccggaauacaagaggucgaucguacauuggccaaagagggcaucaagaggggggaaacugaccaccaugcagugucucggggaucagcuaaacugcgcugguucguugagcgaaacauggugaccccagaaggcaagguaguggaucucgguugcgggagaggaggcuggagcuacuauugugguggccugaaaaaugucagggagguuaagggguuaacaaagggaggcccugggcacgaagagcccauuccuauguccacguacggauggaaccuugugcggcugcagaguggcgucgacguguucuuuaccccacccgagaaaugcgauacucuccuaugugacaucggugaaucuagcccuaauccaacaauugaggccgggcgcacccugagaguauugaaccugguggaaaauuggcucaacaauaacacucaguucugcaucaagguucuuaaucccuauaugccgucagugauagagaaaauggaaacacugcaaaggaaguacggaggcgccuugguccgaaacccucugucccggaauaguacccacgagauguacugggugagcaacgcgacgggcaauauugucucuuccgugaacaugaucucacguaugcucaucaauagauuuaccaugaaacauaagaaggcuacauaugagccagauguugacuuagggagcggaacucgcaacauugguauagaaaacgagauccccaaucuggacauuaucggcaaaaggauugaaaagaucaaacaggagcacgaaaccucguggcauuacgaucaggaccacccuuauaagacaugggcauaccacgggucuuaugagacuaaacagaccggaagugccuccagcaugguaaacggcguggucaagcuucugacaaagccaugggaugugguucccauggugacccaaauggcuaugacugacacgacaccguucggucagcagcgggucuuuaaagagaagguggauaccagaacucaggaaccuaaagaggggaccaagaaacuaaugcgcauaacagccgaauggcucuggaaggagcugggaaagaaaaagacgcccaggauguguacccgagaggaauucacucggaaaguaagaucaaaugcagccuugggcgcuaucuuuacagacgagaacaaguggaaauccgcgagggaagccguggaggauucucgcuucugggaacugguugaccgugagcggaaucuccaucuugagggcaagugcgaaaccugugucuacaacaugauggggaaaagagagaagaagcugggagaauuugguaaagcaaagggcagcagggcuauuugguauaugugguuaggggcccgcuuccuggaguuugaagcauugggauuccucaaugaggaucacugguuuagucgaggcaacucccugagcgguguggagggggaaggacuacauaaacuuggcuacauccugcgggacgugucuaagaaagagggcggggccauguacgcugaugacacugccggaugggacacaagaauuacccucgaagaucugaagaaugaggaaauggucacaaaccacaugaagggugagcauaaaaaguuggcggaggcaaucuucaaacugacuuaucaaaauaagguugugaggguacagcgcccaaccccuagaggcacggugauggacauuauaucacggaaagaucagagggggaguggacaggucggcaccuacggucucaacacauucacuaauauggaagcccaacuuauccgucagauggagggggaaggaauuuuuaaguccauccagcgacugaccgugacagaggagaucgcuguucaaaacugguuagcccgcgugggcagagaacggcugagcaggauggcaauuucuggcgacgauugcgucgugaagcccuuggacgaucgcuucgcuucggcccucacugcucugaaugacauggggaaaguaagaaaggauauacagcagugggagccaucacggggauggaacgacuggacccagguucccuuuugcagccaccacuuccaugaacuagugaugaaagaugguaggguccuuguggugccuugucgaaaccaagacgagcugaucggccgugccagaauuucccagggggcaggauggagucucaaggaaacggcgugccugggcaaaucuuaugcccagauguggacauugauguacuuucaccgccgggauuuaaggcuggcugccaaugcaaucuguagcgcugucccaucccauuggguuccgaccucaagaacuacauggaguauucacgccaagcacgaguggaugaccacugaggacaugcucgcaguguggaaccgcguauggauccaggaaaaucccuggauggaggacaagaccccuguggaaucuugggaggaagucccauaucuugguaaacgggaggaucaauggugcgggagccugauaggacuaacauccagggccacgugggcgaagaacauccagaccgcuauuaaucaggugcgaucacugaucggcaacgaggaauacacugacuauaugcccagcaugaaaagauuccggaaggaggaagaggaagccggcguucucugguga

SEQ ID NO: 14693 - RNA, 9876 nt, Artificial Sequence
  derived and/or modified CDS sequence (opt3) from DENV-2__EU687223__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccggaaaggacuccccugugaacaucgaagccgagcccccauuuggcgauagcuacauuauaaucggggucgaaccuggacagcugaaacuaaauugguucaagaaggguucgucuauuggccagauguuugagacaacuaugcgaggggcuaaacgcauggccauccucggagacaccgcaugggauuucggcucccugggugggguguuuacaucaauuggcaaggcccuucaccaaguuuucggagcuaucuacggcgcggcauuuaguggggugagcuggacuaugaaaauauugaucggaguaauuaucaccuggauuggcaugaacuccagaucuacgagccugucagucagucucgugcugguugguguggucacacuuuaucugggggugaugguacaggccgacuccggaugugugguuagcuggaagaauaaagaguugaagugcggcucugguaucuucauaaccgauaacguccacacuuggacagaacaguacaaguuucagcccgagucaccaaguaaacucgcuagcgccauucaaaaggcacaugaagagggcaucugugggauuagguccgugacccggcuggaaaauuuaauguggaaacagaucacucccgagcugaaccacauacuaucugagaaugaagugaagcucaccaucaugacaggagacauuaaaggcaucaugcaggccgggaagcgcucgcugagaccucagccaacggagcuuaaauauagcuggaagaccuggggaaaggcuaaaauguuguccacugaaucacauaaccaaacauuccugauugauggcccggagaccgccgaaugccccaauacaaacagggcauggaauagucucgaggucgaggacuacgguuuugggguuuucucuacuaacaucuggcugaaguuacgugaaaaacaggacguguuuugugauagcaagcugauguccgcggcuauaaaagacaaucgggccgugcacgcagauaugggauauuggauugagucagcccuuaacgacaccuggaagauggaaaaggcuagcuucaucgagaucaaaucuugccacuggccuaagucccauacguuguggaguaauggcguacucgagagcgaaaugauuaucccaaaaaacuucgccggucccgucucucagcacaacuaccgaccuggcuaucauacacagaccgcagggccauggcaccugggaaagcuagagauggauuuugacuucugugaaggcacuaccgugguugugacagaggauugcgggaauagaggacccucccugaggacuaccacagcuucaggcaaacucauuacggaauggugcugucgcaguugcacccugccgccucuucgguacagaggugaggacggguguugguacggaauggagauaaggccauugaaggaaaaggaggaaaaccuggucaauagcuuagugacugccggccauggucaaaucgauaacuuuucgcucggcguucuggggauggcgcuuuuccuggaggaaauguugcgcacacgagugggaaccaaacacgccauucuccugguagcugucuccuuugugacucuaaucacaggcaauaugucuuuccgggaccuggggcgugugauggucaugguuggagcaaccaugacggaugacauuggcaugggugugacuuaucucgcccugcuugcugccuuuaagguaagacccaccuucgcagcgggguugcuguuaaggaaacucacaagcaaggagcugaugauggccaccaucggaauagcucuucugucacagaguacuaucccugagacaauucuagaacucaccgaugcccuggcauugggcaugauggugcugaaaaucguccgcaacauggagaaguaccaguuagcugugacaauuauggccaucuccugcguucccaaugcagugauacuccaaaacgccuggaaggucucuuguacuauucuggcugcggugagcguuuccccacuucuguugaccucaagccagcagaaagccgacuggaucccucucgcacugacgaucaagggccuaaaucccacagcuauuuuucugaccacucuuagucggaccucuaaaaagagauccuggccacucaacgaagccgugauggccgucgggaugguaagcauacuggcuucgucauugcugaaaaaugacaucccgaugacaggaccuuuaguggcagguggccuccugacuguuugcuaugugcuuaccgggaggucugccgaucuggaguuggaacgagcggcugacgucaagugggaggaucaggccgagauuaguggauccagccccauccucucuauuacgaucagcgaagacggcuccaugucaauaaaaaacgaggaagaggagcacacacugaccauccuaauucgcacuggucugcuugugaucaguggggcauucccaguaagcauucccaucacagccgcugcaugguaccucugggaagugaagaagcaacgggccggaguccugugggauguuccuucuccacccccugugggcaaagcggaguuggaagacggcgcuuauagaauaaagcagagggggauuuuuggauacucccagaucggugccggcguguauaaagaggggaccuuccauacuauguggcacgucacacguggagcaguguuaaugcaucgcggcaagcggaucgaaccgucaugggccgauguuaaaaaggaccugauuaguuacggugggggauggaagcucgagggcgaguggaaagaaggcgaggaaguacaggugcuggcucuugagccagggaagaaucccagagccguccaaaccaaaccuggacuguuuaagacgaacacugguaccaucggcgcagugagcuuggauuucuccccagggacaucuggaucgcccauaguugacaggaaaggcaagguggucggucuauacgggaauggagugguaacccgaagcggcgcuuaugucucagccauugcgcagacagaaaaguccaucgaggauaacccugagauugaagacgauaucuuccggaaaaagcgccugacuauaauggaccuccacccgggcgccgggaaaaccaagagauaccugcccgcaauugugagggaggcuaucaaacggggacuucgaacguuaauccuggccccaacaagaguuguggcugcagaaauggaggaagcccuccgcgguuugccuauuagguaucagacucccgccauccgugcugagcauaccggccgggagauugucgaccugaugugucacgcgacauuuaccaugagacuccugaguccagugaggguuccuaacuacaaucuuauaaucauggaugaagcacacuucacugaccccgccucuauugcugcccgcggguauaucagcacccgaguggagaugggagaagcagccggcaucuuuaugacagcuacgccaccggguuccagagauccuuucccccagucaaacgcgccaauuauggacgaggagcgggaaauacccgagaggucuuggaauagcgggcaugaaugggucacugauuuuaagggaaagaccgugugguucguaccuaguaucaaagccggcaacgacauugcagcuugccugcgcaagaauggcaaaaaggugauccaauugucccguaaaacauuugauagcgaguacguuaagaccagagccaacgacugggauuucgucgugacuacagacauuucugaaaugggggcaaauuuucgggccgagagggugaucgauccacgccgauguaugaagcccgucauacuaaccgacggagaggaaagaguaauccuggcugguccuaugccggugacgcacucauccgccgcgcagcggaggggccgcauugggagaaacccaaaaaaugagaacgaccaguauaucuacaugggagaaccccucgagaaugaugaagacugcgcacauuggaaggaggccaaaauguuacuggauaacauuaauacuccugagggcaucauacccaguauguucgaaccagagagggaaaagguugacgcuauugauggugaguaccggcuucguggggaagcccgcaaaacauuuguggaccugaugcgaagaggcgaucucccugucugguuggcuuauaggguggcagccgagggaaucaacuacgcugaccggcgcugguguuucgauggcauuaagaauaaccaaauccuggaggaaaacguugagguggaaauauggaccaaagagggggagagaaagaagcucaaacccagguggcuggacgcccggaucuauagcgauccacuugcacuaaaggaauucaaagaguuugcggccggacgaaagucgcugaccuugaauuuaauuacugaaauggguagacugccuacauucaugacccagaaagcucgcgacgcccucgauaaccuggcaguccuucacacagcugaggugggcgggagggccuacaaucacgcacugucugaacucccggagacuuuggagacgcugcuacugcucacccuucuggccacaguaacuggaggcaucuuuuuauucuugauguccgguaaggggauuggcaagaugacccugggaaugugcugcaucauaacagcuagcauucuccugugguaugcgcagauccagccccauuggaucgccgcaucaauuauccuugaauuuuuccugauagugcucuugauuccagagccugaaaaacaacggaccccccaggacaaccagcugacuuacguugucaucgcuauuuuaacggugguggccgccaccauggcaaaugagaugggcuuucuagaaaagacaaaaaaggaccuggggcucggaaguaucacuacccaggagucugaguccaacauacuugauaucgaccugcguccagcuagcgccuggacauuguaugcggucgcuaccacuuucguuacaccuaugcugagacacucaauugaaaauaguagcgugaacguaucccucacggccaucgcaaaucaagccaccgugcugaugggucuuggcaggggguggccccucucuaaaauggauauuggagucccgcuguuggcuaucggcuguuacagccaggugaacccaauuacucugacagcagccuuacuacugcucguugcgcauuacgcuaucauagguccugggcuucaggccaaggcaacccgcgaggcccagaagcggaccgcugccggcauuaugaaaaaucccacaguggacggaaucacugucaucgaucuggaaccaauucccuaugacccuaaguuugagaaacaauugggccagguaaugcugcucgugcugugcguuacgcaggugcuuaugaugcgaaccacaugggcauuaugugaagcucugacucucgccaccgggccgauauccacauugugggagggaaaccccggcagauucuggaauaccacuaucgcggucucaauggccaacauuuuuagggguucuuaccuggcaggggcuggacuacuguucaguaucaugaagaauacgacaaacacccgccggggcacugguaauauuggcgagacccucggggaaaaauggaagucgagacuuaacgcccugggaaagagcgaguuucagaucuauaaaaaguccggcauacaagaaguggaucguacauuggcaaaagaggggaucaagaggggagagacugaccaccaugcugucucucggggcucagccaaacugcgcugguucguggaacgaaacaugguuaccccagaggguaaggugguagaucucgggugcggaagaggcgguuggagcuacuauuguggcgggcugaaaaaugugagggaagucaagggauuaacaaagggcgggccuggacacgaggaacccauuccuauguccacguacggcuggaaccuuguucggcugcagagugguguggacgucuucuuuaccccacccgagaaaugcgauacucuccuaugugacaucggggagucuagcccuaauccaacaauugaagccggacgcacccugagaguguugaaccugguagagaauuggcucaacaauaacacucaguucugcaucaaggugcuuaaucccuauaugccgucaguuauagaaaaaauggagacacugcaaaggaaguacggcggcgcguuggugcgaaacccucugucccggaauaguacccacgaaauguacugggucagcaacgcuacggggaauauugugucuuccgucaacaugaucucacguaugcucaucaauagauuuaccaugaaacauaagaaggcaacauaugagccagauguggacuuaggaagcgguacucgcaacauuggcauagagaacgaaauccccaaucuggacauuaucgggaaaaggauugagaagaucaaacaggaacacgagaccucguggcauuacgaucaggaccacccuuauaagacaugggccuaccacggaucuuaugaaacuaaacagaccggcagugcuuccagcaugguuaacgguguagugaagcuucugacaaagccaugggaugucgugcccaugguuacccaaauggccaugacugacacgacaccguucgggcagcagcggguguuuaaagagaaggucgauaccagaacucaggagccuaaagaaggaaccaagaaacuaaugcgcauaacagcagaguggcucuggaaggaacugggcaagaaaaagacgcccaggauguguacccgagaggaguucacucggaaagugagaucaaaugccgcuuugggcgcgaucuuuacagacgaaaacaaguggaaauccgccagggaggcaguagaagauucucgcuucugggagcugguggaccgugaacggaaucuccaucuugaggggaagugcgagaccuguguuuacaacaugaugggaaaaagagaaaagaagcugggugaguuuggcaaagcuaaggggagcagggccauuugguauaugugguuaggagcacgcuuccuggaauuugaggccuugggcuuccucaaugaagaucacugguuuagucgagguaacucccugagcggggucgagggagagggccuacauaaacuuggcuacauccugcgggacgugucuaagaaagaagggggagcuauguacgccgaugacacugcggguugggacacaagaauuacccucgaggaucugaagaaugaagagauggugacaaaccacaugaagggcgaacauaaaaaguuggcagaggccaucuucaaacugacuuaucaaaauaaggucguuagggugcagcgcccaaccccuagagggacgguaauggacauuauaucacggaaagaucagaggggaaguggccagguggguaccuacgggcucaacacauucacuaauauggaggcucaacuuauccgucagauggaaggagagggcauuuuuaaguccauccagcgacugaccgucacagaagagaucgccgugcaaaacugguuagcacgcguuggcagagagcggcugagcaggauggcuauuucuggggacgauugcguggucaagcccuuggacgaucgcuucgccucggcucucacugcccugaaugacaugggaaaagugagaaaggauauacagcagugggaaccaucacgggguuggaacgacuggacccagguacccuuuugcagccaccacuuccaugagcuaguuaugaaagauggcagggugcuugucgugccuugucgaaaccaagacgaacugaucgggcgugcaagaauuucccagggagcgggcuggagucucaaggagacggccugccuggguaaaucuuaugcucagauguggacauugauguacuuucaccgccgggauuuaaggcuggccgcaaaugcuaucuguagcgccgugccaucccauugggucccgaccucaagaacuacauggaguauucacgcaaagcacgaauggaugaccacugaggacaugcucgccguuuggaaccgcguguggauccaggagaaucccuggauggaagacaagaccccuguagagucuugggaagaggugccauaucuugggaaacgggaagaucaauggugcggaagccugauaggccuaacauccagggcgacgugggcuaagaacauccagaccgccauuaaucagguccgaucacugaucggcaacgaggaguacacugacuauaugcccagcaugaaaagauuccggaaggaagaggaagaggcaggggugcucugguga

SEQ ID NO: 14694 - RNA, 9876 nt, Artificial Sequence
  derived and/or modified CDS sequence (opt3) from DENV-2__EU687227__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagaucaaaucuugccacuggccuaagucccauacguuguggaguaauggaguacucgaaagcgagaugauuaucccaaaaaacuucgccggccccgucucucagcacaacuaccgaccugguuaucauacacagaccgcaggcccauggcaccuggggaagcuagaaauggauuuugacuucugugagggaacuaccgugguugugacagaagauugcggcaauagagggcccucccugaggacuaccacagcuucaggaaaacucauuacggaguggugcugucgcaguugcacccugccgccucuucgguacagaggcgaggacgguuguugguacgggauggaaauaaggccauugaaggagaaggaagagaaccuggucaauagcuuagugacugccggacauggccaaaucgauaacuuuucgcucgguguucugggcauggcgcuuuuccuggaagagauguugcgcacacgaguggggaccaaacacgccauucuccugguagcugucuccuuugugacucuaaucacaggaaauaugucuuuccgggaccugggccgugugauggucaugguuggggcaaccaugacggaugacauuggaaugggcgugacuuaucucgcccugcuugcugccuuuaagguaagacccaccuucgcagcggguuugcuguuaaggaaacucacaagcaaggagcugaugauggccaccaucgggauagcucuucugucacagaguacuaucccugaaacaauucuagagcucaccgaugcccuggcauugggaaugauggugcugaaaaucguccgcaacauggaaaaguaccaguuagcugugacaauuauggccaucuccugcguucccaaugcagugauacuccaaaacgccuggaaggucucuuguacuauucuggcugcggugagcguuuccccacuucuguugaccucaagccagcagaaagccgacuggaucccucucgcacugacgaucaagggccuaaaucccacagcuauuuuucugaccacucuuagucggaccucuaaaaagagauccuggccacucaacgaggccgugauggccgucggcaugguaagcauacuggcuucgucauugcugaaaaaugacaucccgaugacagggccuuuaguggcaggaggucuccugacuguuugcuaugugcuuaccggcaggucugccgaucuggaauuggagcgagcggcugacgucaagugggaggaucaggccgaaauuaguggguccagccccauccucucuauuacgaucagcgaggacggauccaugucaauaaaaaacgaagaggaggaacacacacugaccauccuaauucgcacuggccugcuugugaucagugguguauucccagugagcauucccaucacagcagccgcuugguaccucugggaggucaagaagcaacgggcagggguucugugggaugugccuucuccacccccugugggaaaagccgaauuggaggacggcgcguauagaauaaagcagaggggcauuuuuggguacucccagaucggagcuggugucuauaaagaaggcaccuuccauacuauguggcacgugacacguggggccguuuuaaugcaucgcggaaagcggaucgagccgucaugggcagauguaaaaaaggaccugauuaguuacggcgguggguggaagcucgagggagaauggaaagagggcgaagaggugcagguccuggcccuugaaccaggcaagaaucccagagcugugcaaaccaaaccugggcuguuuaagacgaacacuggaaccaucggugccguuagcuuggauuucuccccaggcacaucugggucgcccauaguggacaggaaaggaaaggucgugggccuauacgguaaugggguagucacccgaagcggagcauaugugucagcuauugcccagacagagaaguccaucgaggauaacccugaaauugaggacgauaucuuccggaaaaagcgccugacuauaauggaccuccacccgggcgcgggcaaaaccaagagauaccugcccgccauuguuagggaagcaaucaaacgggggcuucgaacguuaauccuggcuccaacaagaguggucgccgcugagauggaagaggcacuccgcggauugccuauuagguaucagacucccgccauccgugccgagcauaccggucgggaaauuguggaccugaugugucacgcuacauuuaccaugagacuccugaguccaguuagggugccuaacuacaaucuuauaaucauggaugaggcgcacuucacugaccccgcaucuauugccgcucgcggcuauaucagcacccgagucgaaaugggggaggccgcaggaaucuuuaugacagccacgccaccgggcuccagagauccuuucccccagucaaacgcuccaauuauggacgaggaacgggagauacccgaaaggucuuggaauagcggucaugagugggugacugauuuuaaggggaagaccguaugguucgugccuaguaucaaagcgggaaacgacauugccgcaugccugcgcaagaauggcaaaaagguuauccaauugucccguaaaacauuugauagcgaauacgucaagaccagagcuaacgacugggauuucguggugacuacagacauuucugagaugggcgccaauuuucgggcagagagggucaucgauccacgccgauguaugaagcccguaauacuaaccgacggggaagagagagugauccuggccggaccuaugccgguuacgcacucauccgcugcccagcggaggggucgcauuggcagaaacccaaaaaaugaaaacgaccaguauaucuacaugggggagccccucgaaaaugaugaggacugcgcgcauuggaaggaggcaaaaauguuacuggauaacauuaauacuccugaaggaaucauacccaguauguucgagccagaaagggagaagguggacgccauugauggcgaauaccggcuucguggugaggcucgcaaaacauuugucgaccugaugcgaagaggggaucucccugugugguuggccuauaggguugcugcagagggcaucaacuacgccgaccggcgcugguguuucgauggaauuaagaauaaccaaauccuggaagagaacguggaagucgagauauggaccaaagagggcgaaagaaagaagcucaaacccagguggcuggacgcucggaucuauagcgauccacuugcccuaaaggaguucaaagaauuugcagcggggcgaaagucgcugaccuugaauuuaauuacugagaugggaagacugccuacauucaugacccagaaagcccgcgacgcucucgauaaccuggccgugcuucacacagcagaaguagguggcagggcuuacaaucacgcccugucugagcucccggagacuuuggaaacgcugcuacugcucacccuucuggcaacagugacugggggaaucuuuuuauucuugauguccggcaaggguauugggaagaugacccugggcaugugcugcaucauaacagccagcauucuccugugguaugcucagauccagccccauuggaucgcggccucaauuauccuugaguuuuuccugauaguucucuugauuccagaaccugagaaacaacggaccccccaggacaaccagcugacuuacgucgugaucgcaauuuuaacgguggucgcugccaccauggccaaugaaaugggauuucuagagaagacaaaaaaggaccugggccucgggaguaucacuacccaggagucugaauccaacauacuugauaucgaccugcguccagcaagcgcuuggacauuguaugccguugcgaccacuuucgugacaccuaugcugagacacucaauugagaauaguagcguaaacgugucccucacggcuaucgccaaucaagcaaccguccugaugggacuugguaggggcuggccccucucuaaaauggauauuggggugccgcuguuggccaucggauguuacagccagguuaacccaauuacucugacagcugcauuacuacugcucguggcccauuacgcgaucauaggcccuggucuucaggcuaaggccacccgcgaagcacagaagcggaccgccgcugggauuaugaaaaaucccacagucgacggcaucacuguaaucgaucuggagccaauucccuaugacccuaaguuugaaaaacaauugggacaggugaugcugcucguucugugcgugacgcagguccuuaugaugcgaaccacaugggccuuaugugaggcacugacucucgcuaccggcccgauauccacauugugggaggggaaccccggaagauucuggaauaccacuaucgccgugucaauggcgaacauuuuuaggggcucuuaccuggccggugcagggcuacuguucaguaucaugaagaauacgacaaacacccgccggggaacuggcaauauuggugaaacccucggcgagaaauggaagucgagacuuaacgcucuggggaagagcgaauuucagaucuauaaaaaguccggaauacaagaggucgaucguacauuggccaaagagggcaucaagaggggggaaacugaccaccaugcagugucucggggaucagcuaaacugcgcugguucguugagcgaaacauggugaccccagaaggcaagguaguggaucucgguugcgggagaggaggcuggagcuacuauugugguggccugaaaaaugucagggagguuaagggguuaacaaagggaggcccugggcacgaagagcccauuccuauguccacguacggauggaaccuugugcggcugcagaguggcgucgacguguucuuuaccccacccgagaaaugcgauacucuccuaugugacaucggugaaucuagcccuaauccaacaauugaggccgggcgcacccugagaguauugaaccugguggaaaauuggcucaacaauaacacucaguucugcaucaagguucuuaaucccuauaugccgucagugauagagaaaauggaaacacugcaaaggaaguacggaggcgccuugguccgaaacccucugucccggaauaguacccacgagauguacugggugagcaacgcgacgggcaauauugucucuuccgugaacaugaucucacguaugcucaucaauagauuuaccaugaaacauaagaaggcuacauaugagccagauguugacuuagggagcggaacucgcaacauugguauagaaaacgagauccccaaucuggacauuaucggcaaaaggauugaaaagaucaaacaggagcacgaaaccucguggcauuacgaucaggaccacccuuauaagacaugggcauaccacgggucuuaugagacuaaacagaccggaagugccuccagcaugguaaacggcguggucaagcuucugacaaagccaugggaugugguucccauggugacccaaauggcuaugacugacacgacaccguucggucagcagcgggucuuuaaagagaagguggauaccagaacucaggaaccuaaagaggggaccaagaaacuaaugcgcauaacagccgaauggcucuggaaggagcugggaaagaaaaagacgcccaggauguguacccgagaggaauucacucggaaaguaagaucaaaugcagccuugggcgcuaucuuuacagacgagaacaaguggaaauccgcgagggaagccguggaggauucucgcuucugggaacugguugaccgugagcggaaucuccaucuugagggcaagugcgaaaccugugucuacaacaugauggggaaaagagagaagaagcugggagaauuugguaaagcaaagggcagcagggcuauuugguauaugugguuaggggcccgcuuccuggaguuugaagcauugggauuccucaaugaggaucacugguuuagucgaggcaacucccugagcgguguggagggggaaggacuacauaaacuuggcuacauccugcgggacgugucuaagaaagagggcggggccauguacgcugaugacacugccggaugggacacaagaauuacccucgaagaucugaagaaugaggaaauggucacaaaccaaaugaagggugagcacaaaaaguuggcggaggcaaucuucaaacugacuuaucagaauaagguugugaggguacagcgcccaaccccuagaggcacggugauggacauuauaucacggaaagaucagagggggaguggacaagucggcaccuacggucucaacacauucacuaauauggaagcccagcuuauccgucagauggagggggaaggaauuuuuaaguccauccaacgacugaccgugacagaggagaucgcuguucagaacugguuagcccgcgugggcagagaacggcugagcaggauggcaauuucuggcgacgauugcgucgugaagcccuuggacgaucgcuucgcuucggcccucacugcucugaaugacauggggaaaguaagaaaggauauacagcagugggagccaucacggggauggaacgacuggacccaaguucccuuuugcagccaucacuuccacgaacuagugaugaaagaugguaggguccuuguggugccuugucgaaaccaggacgagcugaucggccgugccagaauuucccagggggcaggauggagucucaaggaaacggcgugccugggcaaaucuuaugcccagauguggacauugauguacuuucaucgccgggauuuaaggcuggcugccaaugcaaucuguagcgcugucccaucccacuggguuccgaccucaagaacuacauggaguauucaugccaagcacgaguggaugaccacugaggacaugcucgcaguguggaaccgcguauggauccaagaaaaucccuggauggaggacaagaccccuguggaaucuugggaggaagucccauaucuugguaaacgggaggaucaguggugcgggagccugauaggacuaacauccagggccacgugggcgaagaacauccagaccgcuauuaaucaggugcgaucacugaucggcaacgaggaauacacugacuauaugcccagcaugaaaagauuccggaaggaggaagaggaagccggcguucucugguga

SEQ ID NO: 14695 - RNA, 9876 nt, Artificial Sequence
  derived and/or modified CDS sequence (opt3) from DENV-2__EU687228__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaacgaaauuaaaaucacaccgcaguccucaauaaccgaggccgaacuuacuggcuaugguaccgugacaauggaguguagucccaggaccgggcuggauuucaaugaaaugguauugcuccagauggaggacaaggcauggcuggugcaccggcaaugguuuuuagaucugccucucccauggcuucccggcgcugacacucagggaagcaacuggauucagaaagagacacuggucacguucaagaauccucaugccaagaaacaggacgugguuguguugggcucucaagaaggggcgaugcacaccgcccuaacuggagcaacagagauccagauguccucagguaaccugcucuuuaccggccaucugaagugccgucuucgcauggauaaacugcaguugaaggggaugagcuacaguauguguacaggaaaauucaagaucgucaaggaaauugcugagacucaacacggcaccaucgugauuagaguacaguaugagggugacgggucuccaugcaaaauacccuucgaaaucauggaucucgagaagaggcauguucugggccgguuaauuacggugaacccgaucgucaccgaaaaagacuccccugugaauaucgaggccgaacccccauuuggagauagcuacauuauaaucggcgucgagccugggcagcugaagcuaaacugguucaaaaagggaucgucuauuggucagauguuugagacaacuaugcgaggcgcuaagcgcauggccauccucggggacaccgcaugggauuucggaucccugggcgguguguuuacaucaauugggaaagcccuucaccaaguuuucggcgcuaucuacggagcggcauuuaguggcgugagcuggacuaugaagauauugaucgggguaauuaucaccuggauuggaaugaauuccagaucuacgagccugucagucagucucgugcugguuggcguggucacacuuuaucugggugugaugguacaggccgacuccgggugugugguuagcuggaaaaacaaggaauugaaaugcggaucuggcaucuucauaaccgauaauguccacacuuggacagagcaguacaaguuucagcccgaaucaccaaguaagcucgcuagcgccauucaaaaagcacaugaggaagguaucuguggcauuagguccgugacccggcuggagaacuuaauguggaagcagaucacucccgagcugaaucacauacuaucugaaaacgaggugaaacucaccaucaugacaggggacauuaagggaaucaugcaggccggcaaacgcucgcugagaccucagccaacggaacuuaaguauagcuggaaaaccugggggaaggcuaagauguuguccacugagucacauaaucaaacauuccugauugauggaccggaaaccgccgagugccccaacacaaauagggcauggaacagucucgaggucgaagacuacggcuuugguguuuucucuacuaauaucuggcugaaauuacgugagaagcaggacguguuuugugauagcaaacugauguccgcggcuauaaaggacaaccgggccgugcacgcagauaugggguauuggauugaaucagcccuuaaugacaccuggaaaauggagaaggcuagcuucaucgagaucaagucuugccacuggccuaaaucccauacguuguggaguaacggaguacucgaaagcgagaugauuaucccaaagaacuucgccggccccgucucucagcacaauuaccgaccugguuaucauacacagaccgcaggcccauggcaccuggggaaacuagaaauggauuuugacuucugugagggaacuaccgugguugugacagaagauugcggcaacagagggcccucccugaggacuaccacagcuucaggaaagcucauuacggaguggugcugucgcaguugcacccugccgccucuucgguacagaggcgaggacgguuguugguacgggauggaaauaaggccauugaaagagaaggaagagaaucuggucaacagcuuagugacugccggacauggccaaaucgauaauuuuucgcucgguguucugggcauggcgcuuuuccuggaagagauguugcgcacacgaguggggaccaagcacgccauucuccugguagcugucuccuuugugacucuaaucacaggaaacaugucuuuccgggaccugggccgugugauggucaugguuggggcaaccaugacggaugacauuggaaugggcgugacuuaucucgcccugcuugcugccuuuaaaguaagacccaccuucgcagcggguuugcuguuaaggaagcucacaagcaaagagcugaugauggccaccaucgggauagcucuucugucacagaguacuaucccugaaacaauucuagagcucaccgaugcccuggcauugggaaugauggugcugaagaucguccgcaauauggaaaaauaccaguuagcugugacaauuauggccaucuccugcguucccaacgcagugauacuccaaaaugccuggaaggucucuuguacuauucuggcugcggugagcguuuccccacuucuguugaccucaagccagcagaaggccgacuggaucccucucgcacugacgaucaaaggccuaaaccccacagcuauuuuucugaccacucuuagucggaccucuaagaaaagauccuggccacucaaugaggccgugauggccgucggcaugguaagcauacuggcuucgucauugcugaagaacgacaucccgaugacagggccuuuaguggcaggaggucuccugacuguuugcuaugugcuuaccggcaggucugccgaucuggaauuggagcgagcggcugacgucaaaugggaggaucaggccgaaauuaguggguccagccccauccucucuauuacgaucagcgaggacggauccaugucaauaaagaaugaagaggaggaacacacacugaccauccuaauucgcacuggccugcuugugaucagugguguauucccagugagcauucccaucacagcagccgcuugguaccucugggaggucaaaaagcaacgggcagggguucugugggaugugccuucuccacccccugugggaaaggccgaauuggaggacggcgcguauagaauaaaacagaggggcauuuuuggguacucccagaucggagcuggugucuauaaggaaggcaccuuccauacuauguggcacgugacacguggggccguuuuaaugcaucgcggaaaacggaucgagccgucaugggcagauguaaagaaagaccugauuaguuacggcgguggguggaagcucgagggagaauggaaggagggcgaagaggugcagguccuggcccuugaaccaggcaaaaaccccagagcugugcaaaccaagccugggcuguuuaaaacgaauacuggaaccaucggugccguuagcuuggauuucuccccaggcacaucugggucgcccauaguggacaggaagggaaaagucgugggccuauacgguaacgggguagucacccgaagcggagcauaugugucagcuauugcccagacagagaaguccaucgaggauaacccugaaauugaggacgauaucuuccggaagaaacgccugacuauaauggaccuccacccgggcgcgggcaagaccaaaagauaccugcccgccauuguuagggaagcaaucaagcgggggcuucgaacguuaauccuggcuccaacaagaguggucgccgcugagauggaagaggcacuccgcggauugccuauuagguaucagacucccgccauccgugccgagcauaccggucgggaaauuguggaccugaugugucacgcuacauuuaccaugagacuccugaguccaguuagggugccuaauuacaaccuuauaaucauggaugaggcgcacuucacugaccccgcaucuauugccgcucgcggcuauaucagcacccgagucgaaaugggggaggccgcaggaaucuuuaugacagccacgccaccgggcuccagagauccuuucccccagucaaaugcuccaauuauggacgaggaacgggagauacccgaaaggucuuggaacagcggucaugagugggugacugauuuuaaagggaagaccguaugguucgugccuaguaucaaggcgggaaaugacauugccgcaugccugcgcaaaaacggcaagaaaguuauccaauugucccguaagacauuugauagcgaauacgucaaaaccagagcuaaugacugggauuucguggugacuacagacauuucugagaugggcgccaacuuucgggcagagagggucaucgauccacgccgauguaugaagcccguaauacuaaccgacggggaagagagagugauccuggccggaccuaugccgguuacgcacucauccgcugcccagcggaggggucgcauuggcagaaauccaaagaacgaaaaugaccaguauaucuacaugggggagccccucgaaaacgaugaggacugcgcgcauuggaaagaggcaaagauguuacuggauaauauuaacacuccugaaggaaucauacccaguauguucgagccagaaagggagaaaguggacgccauugauggcgaauaccggcuucguggugaggcucgcaagacauuugucgaccugaugcgaagaggggaucucccugugugguuggccuauaggguugcugcagagggcaucaauuacgccgaccggcgcugguguuucgauggaauuaaaaacaaccaaauccuggaagagaauguggaagucgagauauggaccaaggagggcgaaagaaaaaagcucaagcccagguggcuggacgcucggaucuauagcgauccacuugcccuaaaagaguucaaggaauuugcagcggggcgaaaaucgcugaccuugaacuuaauuacugagaugggaagacugccuacauucaugacccagaaggcccgcgacgcucucgauaaucuggccgugcuucacacagcagaaguagguggcagggcuuacaaccacgcccugucugagcucccggagacuuuggaaacgcugcuacugcucacccuucuggcaacagugacugggggaaucuuuuuauucuugauguccggcaaagguauugggaagaugacccugggcaugugcugcaucauaacagccagcauucuccugugguaugcucagauccagccccauuggaucgcggccucaauuauccuugaguuuuuccugauaguucucuugauuccagaaccugagaagcaacggaccccccaggacaaucagcugacuuacgucgugaucgcaauuuuaacgguggucgcugccaccauggccaacgaaaugggauuucuagagaaaacaaagaaagaccugggccucgggaguaucacuacccaggagucugaauccaauauacuugauaucgaccugcguccagcaagcgcuuggacauuguaugccguugcgaccacuuucgugacaccuaugcugagacacucaauugagaacaguagcguaaaugugucccucacggcuaucgccaaccaagcaaccguccugaugggacuugguaggggcuggccccucucuaagauggauauuggggugccgcuguuggccaucggauguuacagccagguuaauccaauuacucugacagcugcauuacuacugcucguggcccauuacgcgaucauaggcccuggucuucaggcuaaagccacccgcgaagcacagaagcggaccgccgcugggauuaugaagaaccccacagucgacggcaucacuguaaucgaucuggagccaauucccuaugacccuaaauuugaaaagcaauugggacaggugaugcugcucguucugugcgugacgcagguccuuaugaugcgaaccacaugggccuuaugugaggcacugacucucgcuaccggcccgauauccacauugugggaggggaaucccggaagauucuggaacaccacuaucgccgugucaauggcgaauauuuuuaggggcucuuaccuggccggugcagggcuacuguucaguaucaugaaaaacacgacaaauacccgccggggaacuggcaacauuggugaaacccucggcgagaaguggaaaucgagacuuaacgcucuggggaagagcgaauuucagaucuauaagaaauccggaauacaagaggucgaucguacauuggccaaggagggcaucaaaaggggggaaacugaccaccaugcagugucucggggaucagcuaagcugcgcugguucguugagcgaaauauggugaccccagaaggcaaaguaguggaucucgguugcgggagaggaggcuggagcuacuauugugguggccugaagaacgucagggagguuaaaggguuaacaaagggaggcccugggcacgaagagcccauuccuauguccacguacggauggaaucuugugcggcugcagaguggcgucgacguguucuuuaccccacccgagaagugcgauacucuccuaugugacaucggugaaucuagcccuaacccaacaauugaggccgggcgcacccugagaguauugaaucugguggaaaacuggcucaauaacaauacucaguucugcaucaaaguucuuaaccccuauaugccgucagugauagagaagauggaaacacugcaaaggaaauacggaggcgccuugguccgaaauccucugucccggaacaguacccacgagauguacugggugagcaaugcgacgggcaacauugucucuuccgugaauaugaucucacguaugcucaucaacagauuuaccaugaagcauaaaaaggcuacauaugagccagauguugacuuagggagcggaacucgcaacauugguauagaaaaugagauccccaaccuggacauuaucggcaagaggauugaaaaaaucaagcaggagcacgaaaccucguggcauuacgaucaggaccacccuuauaaaacaugggcauaccacgggucuuaugagacuaagcagaccggaagugccuccagcaugguaaauggcguggucaaacuucugacaaagccaugggaugugguucccauggugacccaaauggcuaugacugacacgacaccguucggucagcagcgggucuuuaaggagaaaguggauaccagaacucaggaaccuaaggaggggaccaaaaagcuaaugcgcauaacagccgaauggcucuggaaagagcugggaaagaagaaaacgcccaggauguguacccgagaggaauucacucggaagguaagaucaaacgcagccuugggcgcuaucuuuacagacgagaauaaauggaaguccgcgagggaagccguggaggauucucgcuucugggaacugguugaccgugagcggaaccuccaucuugagggcaaaugcgaaaccugugucuacaauaugauggggaagagagagaaaaagcugggagaauuugguaaggcaaaaggcagcagggcuauuugguauaugugguuaggggcccgcuuccuggaguuugaagcauugggauuccucaacgaggaucacugguuuagucgaggcaauucccugagcgguguggagggggaaggacuacauaagcuuggcuacauccugcgggacgugucuaaaaaggagggcggggccauguacgcugaugacacugccggaugggacacaagaauuacccucgaagaucugaaaaacgaggaaauggucacaaaucacaugaagggugagcauaagaaauuggcggaggcaaucuucaagcugacuuaucaaaacaaaguugugaggguacagcgcccaaccccuagaggcacggugauggacauuauaucacggaaggaucagagggggaguggacaggucggcaccuacggucucaauacauucacuaacauggaagcccaacuuauccgucagauggagggggaaggaauuuuuaaauccauccagcgacugaccgugacagaggagaucgcuguucaaaauugguuagcccgcgugggcagagaacggcugagcaggauggcaauuucuggcgacgauugcgucgugaagcccuuggacgaucgcuucgcuucggcccucacugcucugaacgacauggggaagguaagaaaagauauacagcagugggagccaucacggggauggaacgacuggacccagguucccuuuugcagccaccacuuccaugaacuagugaugaaggaugguaggguccuuguggugccuugucgaaaucaagacgagcugaucggccgugccagaauuucccagggggcaggauggagucucaaagaaacggcgugccugggcaagucuuaugcccagauguggacauugauguacuuucaccgccgggauuuaaggcuggcugccaacgcaaucuguagcgcugucccaucccauuggguuccgaccucaagaacuacauggaguauucacgccaaacacgaguggaugaccacugaggacaugcucgcaguguggaaucgcguauggauccaggaaaaccccuggauggaggacaagaccccuguggaaucuugggaggaagucccauaucuugguaagcgggaggaucaauggugcgggagccugauaggacuaacauccagggccacgugggcgaaaaauauccagaccgcuauuaaccaggugcgaucacugaucggcaaugaggaauacacugacuauaugcccagcaugaagagauuccggaaagaggaagaggaagccggcguucucugguga

SEQ ID NO: 14696 - RNA, 9876 nt, Artificial Sequence
  derived and/or modified CDS sequence (opt3) from DENV-2__EU687230__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaggcacgucucugagcgucucacucgugcugguugguguggucacacuuuaucugggggugaugguacaggccgacaguggaugugugguuuccuggaagaauaaagaauugaagugcggcagcgguaucuucauaaccgauaacguccacacuuggacagagcaguacaaguuucagcccgaaucuccaucaaaacucgcuagugccauucaaaaggcacaugaggaaggcaucugugggauuaggagcgugacccggcuggagaauuuaauguggaaacagaucacucccgagcugaaccacauacuauccgaaaaugaggugaagcucaccaucaugacaggagacauuaaaggcaucaugcaggccgggaagcgcucucugagaccucagccaacggaacuuaaauauucguggaagaccuggggaaaggcuaaaauguugagcacugagucccauaaccaaacauuccugauugauggcccggaaaccgccgagugccccaauacaaacagggcauggaauucacucgaggucgaagacuacgguuuugggguuuucaguacuaacaucuggcugaaguuacgugagaaacaggacguguuuugugauucuaagcugaugagcgcggcuauaaaagacaaucgggccgugcacgcagauaugggauauuggauugaauccgcccuuaacgacaccuggaagauggagaaggcuucauucaucgagaucaaaagcugccacuggccuaagucucauacguugugguccaauggcguacucgaaagugagaugauuaucccaaaaaacuucgccggucccgucagccagcacaacuaccgaccuggcuaucauacacagaccgcagggccauggcaccugggaaagcuagaaauggauuuugacuucugugagggcacuaccgugguugugacagaagauugcgggaauagaggacccucucugaggacuaccacagcuuccggcaaacucauuacggaguggugcugucgcucaugcacccugccgccucuucgguacagaggugaggacggguguugguacggaauggaaauaaggccauugaaggagaaggaagagaaccuggucaauaguuuagugacugccggccauggucaaaucgauaacuuuagccucggcguucuggggauggcgcuuuuccuggaagagauguugcgcacacgagugggaaccaaacacgccauucuccugguagcugucucguuugugacucuaaucacaggcaauauguccuuccgggaccuggggcgugugauggucaugguuggagcaaccaugacggaugacauuggcaugggugugacuuaucucgcccugcuugcugccuuuaagguaagacccaccuucgcagcgggguugcuguuaaggaaacucacaucuaaggagcugaugauggccaccaucggaauagcucuucugagccagucaacuaucccugaaacaauucuagagcucaccgaugcccuggcauugggcaugauggugcugaaaaucguccgcaacauggaaaaguaccaguuagcugugacaauuauggccaucaguugcguucccaaugcagugauacuccaaaacgccuggaaggucuccuguacuauucuggcugcggugucuguuagcccacuucuguugaccuccucacagcagaaagccgacuggaucccucucgcacugacgaucaagggccuaaaucccacagcuauuuuucugaccacucuuagccggaccaguaaaaagagaucuuggccacucaacgaggccgugauggccgucgggaugguauccauacuggcuagcucguugcugaaaaaugacaucccgaugacaggaccuuuaguggcagguggccuccugacuguuugcuaugugcuuaccgggaggucagccgaucuggaauuggagcgagcggcugacgucaagugggaggaucaggccgaaauuucuggaaguucccccauccucagcauuacgaucucugaggacggcagcauguccauaaaaaacgaagaggaggaacacacacugaccauccuaauucgcacuggucugcuugugaucucagggguauucccagugaguauucccaucacagcagccgcuugguaccucugggaggucaagaagcaacgggcaggaguucugugggaugugccuagcccacccccugugggcaaagccgaauuggaggacggcgcguauagaauaaagcagagggggauuuuuggauacucucagaucggugcuggcgucuauaaagaagggaccuuccauacuauguggcacgugacacguggagccguuuuaaugcaucgcggcaagcggaucgagccguccugggcagauguaaaaaaggaccugauuucauacggugggggauggaagcucgagggcgaauggaaagagggcgaagaggugcagguccuggcccuugaaccagggaagaaucccagagcugugcaaaccaaaccuggacuguuuaagacgaacacugguaccaucggcgccguuaguuuggauuucagcccagggacauccggaucucccauaguggacaggaaaggcaaggucgugggucuauacgggaauggaguagucacccgaucgggcgcauaugugagcgcuauugcccagacagagaagucaaucgaggauaacccugaaauugaggacgauaucuuccggaaaaagcgccugacuauaauggaccuccacccgggcgcggggaaaaccaagagauaccugcccgccauuguuagggaagcaaucaaacggggacuucgaacguuaauccuggcuccaacaagaguggucgccgcugagauggaagaggcacuccgcgguuugccuauuagguaucagacucccgccauccgugccgagcauaccggccgggaaauuguggaccugaugugucacgcuacauuuaccaugagacuccuguccccaguuagggugccuaacuacaaucuuauaaucauggaugaggcgcacuucacugaccccgcaaguauugccgcucgcggguauaucucuacccgagucgaaaugggagaggccgcaggcaucuuuaugacagccacgccaccggguagcagagauccuuucccccaguccaacgcuccaauuauggacgaggaacgggagauacccgaaaggucauggaauucugggcaugagugggugacugauuuuaagggaaagaccguaugguucgugccuagcaucaaagcgggcaacgacauugccgcaugccugcgcaagaauggcaaaaagguuauccaauugagucguaaaacauuugauuccgaauacgucaagaccagagcuaacgacugggauuucguggugacuacagacauuagcgagaugggggccaauuuucgggcagagagggucaucgauccacgccgauguaugaagcccguaauacuaaccgacggagaagagagagugauccuggccgguccuaugccgguuacgcacucuucagcugcccagcggaggggccgcauugggagaaacccaaaaaaugaaaacgaccaguauaucuacaugggagagccccucgaaaaugaugaggacugcgcgcauuggaaggaggcaaaaauguuacuggauaacauuaauacuccugaaggcaucauacccuccauguucgagccagaaagggagaagguggacgccauugauggugaauaccggcuucguggggaggcucgcaaaacauuugucgaccugaugcgaagaggcgaucucccugugugguuggccuauaggguugcugcagagggaaucaacuacgccgaccggcgcugguguuucgauggcauuaagaauaaccaaauccuggaagagaacguggaagucgagauauggaccaaagagggggaaagaaagaagcucaaacccagguggcuggacgcucggaucuauagugauccacuugcccuaaaggaguucaaagaauuugcagcgggacgaaagagccugaccuugaauuuaauuacugagauggguagacugccuacauucaugacccagaaagcccgcgacgcucucgauaaccuggccgugcuucacacagcagaaguaggcgggagggcuuacaaucacgcccugucggagcucccggagacuuuggaaacgcugcuacugcucacccuucuggcaacagugacuggaggcaucuuuuuauucuugaugucugguaaggggauuggcaagaugacccugggaaugugcugcaucauaacagccuccauucuccugugguaugcucagauccagccccauuggaucgcggccagcauuauccuugaguuuuuccugauaguucucuugauuccagaaccugagaaacaacggaccccccaggacaaccagcugacuuacgucgugaucgcaauuuuaacgguggucgcugccaccauggccaaugaaaugggcuuucuagagaagacaaaaaaggaccuggggcucggaucaaucacuacccaggagagugaaucuaacauacuugauaucgaccugcguccagcauccgcuuggacauuguaugccguugcgaccacuuucgugacaccuaugcugagacacagcauugagaauucaaguguaaacgugagccucacggcuaucgccaaucaagcaaccguccugaugggucuuggcaggggguggccccucuccaaaauggauauuggagugccgcuguuggccaucggcuguuacucucagguuaacccaauuacucugacagcugcauuacuacugcucguggcccauuacgcgaucauagguccugggcuucaggcuaaggccacccgcgaagcacagaagcggaccgccgcuggcauuaugaaaaaucccacagucgacggaaucacuguaaucgaucuggagccaauucccuaugacccuaaguuugaaaaacaauugggccaggugaugcugcucguucugugcgugacgcagguccuuaugaugcgaaccacaugggccuuaugugaggcacugacucucgcuaccgggccgauaagcacauugugggagggaaaccccggcagauucuggaauaccacuaucgccguguccauggcgaacauuuuuagggguucauaccuggccggggcaggacuacuguucucuaucaugaagaauacgacaaacacccgccggggcacugguaauauuggcgaaacccucggggagaaauggaagaguagacuuaacgcucugggaaagucggaauuucagaucuauaaaaagagcggcauacaagaggucgaucguacauuggccaaagaggggaucaagaggggagaaacugaccaccaugcagugucccggggcucugcuaaacugcgcugguucguugagcgaaacauggugaccccagaagguaagguaguggaucucgggugcggaagaggcgguuggucauacuauuguggcgggcugaaaaaugucagggagguuaagggauuaacaaagggcgggccuggacacgaagagcccauuccuaugagcacguacggcuggaaccuugugcggcugcaguccggugucgacguguucuuuaccccacccgagaaaugcgauacucuccuaugugacaucggggaaaguucuccuaauccaacaauugaggccggacgcacccugagaguauugaaccugguggaaaauuggcucaacaauaacacucaguucugcaucaagguucuuaaucccuauaugccgagcgugauagagaaaauggaaacacugcaaaggaaguacggcggcgccuugguccgaaacccucugucacggaauuccacccacgagauguacugggugaguaacgcgacggggaauauugucagcucugugaacaugaucucccguaugcucaucaauagauuuaccaugaaacauaagaaggcuacauaugagccagauguugacuuaggaucagguacucgcaacauuggcauagaaaacgagauccccaaucuggacauuaucgggaaaaggauugaaaagaucaaacaggagcacgaaaccagcuggcauuacgaucaggaccacccuuauaagacaugggcauaccacggaucguaugagacuaaacagaccggcucugccaguuccaugguaaacgguguggucaagcuucugacaaagccaugggaugugguucccauggugacccaaauggcuaugacugacacgacaccguucgggcagcagcgggucuuuaaagagaagguggauaccagaacucaggaaccuaaagagggaaccaagaaacuaaugcgcauaacagccgaauggcucuggaaggagcugggcaagaaaaagacgcccaggauguguacccgagaggaauucacucggaaaguaagaagcaaugcagccuugggcgcuaucuuuacagacgagaacaaguggaaaucagcgagggaagccguggaggauucccgcuucugggaacugguugaccgugagcggaaucuccaucuugaggggaagugcgaaaccugugucuacaacaugaugggaaaaagagagaagaagcugggugaauuuggcaaagcaaaggggucuagggcuauuugguauaugugguuaggagcccgcuuccuggaguuugaagcauugggcuuccucaaugaggaucacugguuuagccgagguaacagucuguccgggguggagggagaaggccuacauaaacuuggcuacauccugcgggacgugagcaagaaagaggggggagccauguacgcugaugacacugccgguugggacacaagaauuacccucgaagaucugaagaaugaggaaauggucacaaaccacaugaagggcgagcauaaaaaguuggcggaggcaaucuucaaacugacuuaucaaaauaagguugugaggguacagcgcccaaccccuagagggacggugauggacauuauaucucggaaagaucagaggggaucaggccaggucgguaccuacgggcucaacacauucacuaauauggaagcccaacuuauccgucagauggagggagaaggcauuuuuaagaguauccagcgacugaccgugacagaggagaucgcuguucaaaacugguuagcccgcgugggcagagaacggcuguccaggauggcaauuagcggggacgauugcgucgugaagcccuuggacgaucgcuucgcuucugcccucacugcucugaaugacaugggaaaaguaagaaaggauauacagcagugggagccaucgcgggguuggaacgacuggacccagguucccuuuugcucacaccacuuccaugaacuagugaugaaagauggcaggguccuuguggugccuugucgaaaccaagacgagcugaucgggcgugccagaauuagccagggagcaggcuggucccucaaggaaacggcgugccuggguaaaaguuaugcccagauguggacauugauguacuuucaccgccgggauuuaaggcuggcugccaaugcaaucuguucugcugucccaagccauuggguuccgaccuccagaacuacauggucaauucacgccaagcacgaguggaugaccacugaggacaugcucgcaguguggaaccgcguauggauccaggaaaaucccuggauggaggacaagaccccuguggaaaguugggaggaagucccauaucuugggaaacgggaggaucaauggugcggaucucugauaggccuaacaagcagggccacgugggcgaagaacauccagaccgcuauuaaucaggugcgaucccugaucggcaacgaggaauacacugacuauaugcccucaaugaaaagauuccggaaggaggaagaggaagccgggguucucugguga

SEQ ID NO: 14697 - RNA, 9876 nt, Artificial Sequence
  derived and/or modified CDS sequence (opt3) from DENV-2__EU687231__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagaucaaaucuugccacuggccuaagucccauacguuguggaguaauggaguacucgaaagcgagaugauuaucccaaaaaacuucgccggccccgucucucagcacaacuaccgaccugguuaucauacacagaccgcaggcccauggcaccuggggaagcuagaaauggauuuugacuucugugagggaacuaccgugguugugacagaagauugcggcaauagagggcccucccugaggacuaccacagcuucaggaaaacucauuacggaguggugcugucgcaguugcacccugccgccucuucgguacagaggcgaggacgguuguugguacgggauggaaauaaggccauugaaggagaaggaagagaaccuggucaauagcuuagugacugccggacauggccaaaucgauaacuuuucgcucgguguucugggcauggcgcuuuuccuggaagagauguugcgcacacgaguggggaccaaacacgccauucuccugguagcugucuccuuugugacucuaaucacaggaaauaugucuuuccgggaccugggccgugugauggucaugguuggggcaaccaugacggaugacauuggaaugggcgugacuuaucucgcccugcuugcugccuuuaagguaagacccaccuucgcagcggguuugcuguuaaggaaacucacaagcaaggagcugaugauggccaccaucgggauagcucuucugucacagaguacuaucccugaaacaauucuagagcucaccgaugcccuggcauugggaaugauggugcugaaaaucguccgcaacauggaaaaguaccaguuagcugugacaauuauggccaucuccugcguucccaaugcagugauacuccaaaacgccuggaaggucucuuguacuauucuggcugcggugagcguuuccccacuucuguugaccucaagccagcagaaagccgacuggaucccucucgcacugacgaucaagggccuaaaucccacagcuauuuuucugaccacucuuagucggaccucuaaaaagagauccuggccacucaacgaggccgugauggccgucggcaugguaagcauacuggcuucgucauugcugaaaaaugacaucccgaugacagggccuuuaguggcaggaggucuccugacuguuugcuaugugcuuaccggcaggucugccgaucuggaauuggagcgagcggcugacgucaagugggaggaucaggccgaaauuaguggguccagccccauccucucuauuacgaucagcgaggacggauccaugucaauaaaaaacgaagaggaggaacacacacugaccauccuaauucgcacuggccugcuugugaucagugguguauucccagugagcauucccaucacagcagccgcuugguaccucugggaggucaagaagcaacgggcagggguucugugggaugugccuucuccacccccugugggaaaagccgaauuggaggacggcgcguauagaauaaagcagaggggcauuuuuggguacucccagaucggagcuggugucuauaaagaaggcaccuuccauacuauguggcacgugacacguggggccguuuuaaugcaucgcggaaagcggaucgagccgucaugggcagauguaaaaaaggaccugauuaguuacggcgguggguggaagcucgagggagaauggaaagagggcgaagaggugcagguccuggcccuugaaccaggcaagaaucccagagcugugcaaaccaaaccugggcuguuuaagacgaacacuggaaccaucggugccguuagcuuggauuucuccccaggcacaucugggucgcccauaguggacaggaaaggaaaggucgugggccuauacgguaaugggguagucacccgaagcggagcauaugugucagcuauugcccagacagagaaguccaucgaggauaacccugaaauugaggacgauaucuuccggaaaaagcgccugacuauaauggaccuccacccgggcgcgggcaaaaccaagagauaccugcccgccauuguuagggaagcaaucaaacgggggcuucgaacguuaauccuggcuccaacaagaguggucgccgcugagauggaagaggcacuccgcggauugccuauuagguaucagacucccgccauccgugccgagcauaccggucgggaaauuguggaccugaugugucacgcuacauuuaccaugagacuccugaguccaguuagggugccuaacuacaaucuuauaaucauggaugaggcgcacuucacugaccccgcaucuauugccgcucgcggcuauaucagcacccgagucgaaaugggggaggccgcaggaaucuuuaugacagccacgccaccgggcuccagagauccuuucccccagucaaacgcuccaauuauggacgaggaacgggagauacccgaaaggucuuggaauagcggucaugagugggugacugauuuuaaggggaagaccguaugguucgugccuaguaucaaagcgggaaacgacauugccgcaugccugcgcaagaauggcaaaaagguuauccaauugucccguaaaacauuugauagcgaauacgucaagaccagagcuaacgacugggauuucguggugacuacagacauuucugagaugggcgccaauuuucgggcagagagggucaucgauccacgccgauguaugaagcccguaauacuaaccgacggggaagagagagugauccuggccggaccuaugccgguuacgcacucauccgcugcccagcggaggggucgcauuggcagaaacccaaaaaaugaaaacgaccaguauaucuacaugggggagccccucgaaaaugaugaggacugcgcgcauuggaaggaggcaaaaauguuacuggauaacauuaauacuccugaaggaaucauacccaguauguucgagccagaaagggagaagguggacgccauugauggcgaauaccggcuucguggugaggcucgcaaaacauuugucgaccugaugcgaagaggggaucucccugugugguuggccuauaggguugcugcagagggcaucaacuacgccgaccggcgcugguguuucgauggaauuaagaauaaccaaauccuggaagagaacguggaagucgagauauggaccaaagagggcgaaagaaagaagcucaaacccagguggcuggacgcucggaucuauagcgauccacuugcccuaaaggaguucaaagaauuugcagcggggcgaaagucgcugaccuugaauuuaauuacugagaugggaagacugccuacauucaugacccagaaagcccgcgacgcucucgauaaccuggccgugcuucacacagcagaaguagguggcagggcuuacaaucacgcccugucugagcucccggagacuuuggaaacgcugcuacugcucacccuucuggcaacagugacugggggaaucuuuuuauucuugauguccggcaaggguauugggaagaugacccugggcaugugcugcaucauaacagccagcauucuccugugguaugcucagauccagccccauuggaucgcggccucaauuauccuugaguuuuuccugauaguucucuugauuccagaaccugagaaacaacggaccccccaggacaaccagcugacuuacgucgugaucgcaauuuuaacgguggucgcugccaccauggccaaugaaaugggauuucuagagaagacaaaaaaggaccugggccucgggaguaucacuacccaggagucugaauccaacauacuugauaucgaccugcguccagcaagcgcuuggacauuguaugccguugcgaccacuuucgugacaccuaugcugagacacucaauugagaauaguagcguaaacgugucccucacggcuaucgccaaucaagcaaccguccugaugggacuugguaggggcuggccccucucuaaaauggauauuggggugccgcuguuggccaucggauguuacagccagguuaacccaauuacucugacagcugcauuacuacugcucguggcccauuacgcgaucauaggcccuggucuucaggcuaaggccacccgcgaagcacagaagcggaccgccgcugggauuaugaaaaaucccacagucgacggcaucacuguaaucgaucuggagccaauucccuaugacccuaaguuugaaaaacaauugggacaggugaugcugcucguucugugcgugacgcagguccuuaugaugcgaaccacaugggccuuaugugaggcacugacucucgcuaccggcccgauauccacauugugggaggggaaccccggaagauucuggaauaccacuaucgccgugucaauggcgaacauuuuuaggggcucuuaccuggccggugcagggcuacuguucaguaucaugaagaauacgacaaacacccgccggggaacuggcaauauuggugaaacccucggcgagaaauggaagucgagacuuaacgcucuggggaagagcgaauuucagaucuauaaaaaguccggaauacaagaggucgaucguacauuggccaaagagggcaucaagaggggggaaacugaccaccaugcagugucucggggaucagcuaaacugcgcugguucguugagcgaaacauggugaccccagaaggcaagguaguggaucucgguugcgggagaggaggcuggagcuacuauugugguggccugaaaaaugucagggagguuaagggguuaacaaagggaggcccugggcacgaagagcccauuccuauguccacguacggauggaaccuugugcggcugcagaguggcgucgacguguucuuuaccccacccgagaaaugcgauacucuccuaugugacaucggugaaucuagcccuaauccaacaauugaggccgggcgcacccugagaguauugaaccugguggaaaauuggcucaacaauaacacucaguucugcaucaagguucuuaaucccuauaugccgucagugauagagaaaauggaaacacugcaaaggaaguacggaggcgccuugguccgaaacccucugucccggaauaguacccacgagauguacugggugagcaacgcgacgggcaauauugucucuuccgugaacaugaucucacguaugcucaucaauagauuuaccaugaaacauaagaaggcuacauaugagccagauguugacuuagggagcggaacucgcaacauugguauagaaaacgagauccccaaucuggacauuaucggcaaaaggauugaaaacaucaagcaggagcacgaaaccucguggcauuacgaucaggaccacccuuauaaaacaugggcauaccacgggucuuaugagacuaagcagaccggaagugccuccagcaugguaaauggcguggucaaacuucugacaaagccaugggaugugguucccauggugacccaaauggcuaugacugacacgacaccguucggucagcagcgggucuuuaaggagaaaguggauaccagaacucaggaaccuaaggaggggaccaaaaagcuaaugcgcauaacagccgaauggcucuggaaagagcugggaaagaagaaaacgcccaggauguguacccgagaggaauucacucggaagguaagaucaaacgcagccuugggcgcuaucuuuacagacgagaauaaauggaaguccgcgagggaagccguggaggauucucgcuucugggaacugguugaccgugagcggaaccuccaucuugagggcaaaugcgaaaccugugucuacaauaugauggggaagagagagaaaaagcugggagaauuugguaaggcaaaaggcagcagggcuauuugguauaugugguuaggggcccgcuuccuggaguuugaagcauugggauuccucaacgaggaucacugguuuagucgaggcaauucccugagcgguguggagggggaaggacuacauaagcuuggcuacauccugcgggacgugucuaaaaaggagggcggggccauguacgcugaugacacugccggaugggacacaagaauuacccucgaagaucugaaaaacgaggaaauggucacaaaucacaugaagggugagcauaagaaauuggcggaggcaaucuucaagcugacuuaucaaaacaaaguugugaggguacagcgcccaaccccuagaggcacggugauggacauuauaucacggaaggaucagagggggaguggacaggucggcaccuacggucucaauacauucacuaacauggaagcccaacuuauccgucagauggagggggaaggaauuuuuaaauccauccagcgacugaccgugacagaggagaucgcuguucaaaauugguuagcccgcgugggcagagaacggcugagcaggauggcaauuucuggcgacgauugcgucgugaagcccuuggacgaucgcuucgcuucggcccucacugcucugaacgacauggggaagguaagaaaagauauacagcagugggagccaucacggggauggaacgacuggacccagguucccuuuugcagccaccacuuccaugaacuagugaugaaggaugguaggguccuuguggugccuugucgaaaucaagacgagcugaucggccgugccagaauuucccagggggcaggauggagucucaaagaaacggcgugccugggcaagucuuaugcccagauguggacauugauguacuuucaccgccgggauuuaaggcuggcugccaacgcaaucuguagcgcugucccaucccauuggguuccgaccucaagaacuacauggaguauucacgccaaacacgaguggaugaccacugaggacaugcucgcaguguggaaucgcguauggauccaggaaaaccccuggauggaggacaagaccccuguggaaucuugggaggaagucccauaucuugguaagcgggaggaucaauggugcgggagccugauaggacuaacauccagggccacgugggcgaaaaauauccagaccgcuauuaaccaggugcgaucacugaucggcaaugaggaauacacugacuauaugcccagcaugaagagauuccggaaagaggaagaggaagccggcguucucugguga

SEQ ID NO: 14698 - RNA, 9876 nt, Artificial Sequence
  derived and/or modified CDS sequence (opt3) from DENV-2__EU687199__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaugauggaucucgagaaaaggcauguucugggccgguuaaucacggugaacccgauugucaccgaaaaggacuccccugugaacaucgaggccgaacccccauuuggagauagcuacaucauuauaggcgucgagccugggcagcugaaacuaaauugguucaagaagggaucgucuaucggucagauguuugagacaacuaugcgaggcgcuaaacgcauggccauucucggggacaccgcaugggauuucggaucccugggcgguguguuuacaucaaucgggaaggcccuucaccaaguuuucggcgcuauuuacggagcggcauuuaguggcgugagcuggacuaugaaaaucuugauagggguaaucauuaccuggaucggaaugaacuccagaucuacgagccugucagucagucucgugcugguuggcguggucacacuuuaucugggugugaugguacaggccgacaccgggugugugguuuccuggaagaauaaagaauugaagugcggaagcggcauuuucaucacugauaacguccacacauggaccgagcaguacaaguuucagcccgaaucuccaucaaaacucgcuagugccauacaaaaggcacaugaggaagguauuuguggcaucaggagcgugacucggcuggagaauuuaauguggaaacagauuacccccgagcugaaccacauccuauccgaaaaugaggugaagcucacaauaaugacgggggacaucaaaggaauuaugcaggccggcaagcgcucucugagaccucagccaaccgaacuuaaauauucguggaagacuugggggaaggcuaaaauguugagcacagagucccauaaccaaaccuuccugaucgauggaccggaaacagccgagugccccaauacuaacagggcauggaauucacucgaggucgaagacuacggcuuugguguuuucaguaccaacauuuggcugaaguuacgugagaaacaggacguguuuugugauucuaagcugaugagcgcggcuaucaaagacaaucgggccgugcacgcagauaugggguauuggauagaauccgcccuuaacgacacguggaagauggagaaggcuucauucauugagaucaaaagcugccacuggccuaagucucauacauugugguccaauggaguacucgaaagugagaugaucauuccaaaaaacuucgccggccccgucagccagcacaacuaccgaccugguuaucauacccagacugcaggcccauggcaccuggggaagcuagaaauggauuuugacuucugugagggaaccacagugguugugacugaagauugcggcaauagagggcccucucugaggaccacaacggcuuccggaaaacucaucaccgaguggugcugucgcucaugcacucugccgccucuucgguacagaggcgaggacgguuguugguacgggauggaaauuaggccauugaaggagaaggaagagaaccuggucaauaguuuagugacagccggacauggccaaauagauaacuuuagccucgguguucugggcauggcgcuuuuccuggaagagauguugcgcacccgaguggggacuaaacacgccauccuccugguagcugucucguuugugacacuaauuaccggaaauauguccuuccgggaccugggccgugugauggucaugguuggggcaacgaugacugaugacaucggaaugggcgugaccuaucucgcccugcuugcugccuuuaagguaagacccacauucgcagcggguuugcuguuaaggaaacucaccucuaaggagcugaugauggccacuauugggaucgcucuucugagccagucaacaauaccugaaaccauccuagagcucacagaugcccuggcauugggaaugauggugcugaaaauuguccgcaacauggaaaaguaccaguuagcugugacuaucauggccauuaguugcguucccaaugcagugauccuccaaaacgccuggaaggucuccuguaccauacuggcugcggugucuguuagcccacuucuguugacguccucacagcagaaagccgacuggauuccucucgcacugacaaucaagggccuaaaucccaccgcuaucuuucugacuacccuuagccggacaaguaaaaagagaucuuggccacucaacgaggccgugauggccgucggcaugguauccauucuggcuagcucguugcugaaaaaugacauaccgaugacugggccuuuaguggcaggaggucuccugaccguuugcuaugugcuuacgggcaggucagccgaucuggaauuggagcgagcggcugacgucaagugggaggaucaggccgaaaucucugggaguucccccauucucagcaucacaauuucugaggacggaagcauguccaucaaaaacgaagaggaggaacacacccugacuauacuaauccgcacaggccugcuugugauuucagguguauucccagugaguauccccauuaccgcagccgcuugguaccucugggaggucaagaagcaacgggcagggguucugugggaugugccuagcccacccccugugggaaaagccgaauuggaggacggcgcguauagaaucaagcagaggggcauauuuggguacucucagauuggagcuggugucuauaaagaaggcacuuuccauacaauguggcacgugacccguggggccguuuuaaugcaucgcggaaagcggaucgagccguccugggcagauguaaaaaaggaccugaucucauacggcgguggguggaagcucgagggagaauggaaagagggcgaagaggugcagguccuggcccuugaaccaggcaagaaucccagagcugugcaaacgaaaccugggcuguuuaagacuaacaccggaacaauuggugccguuaguuuggauuucagcccaggcaccuccgggucucccaucguggacaggaaaggaaaggucgugggccuauacgguaaugggguagucacacgaucgggagcauaugugagcgcuauagcccagacugagaagucaauugaggauaacccugaaaucgaggacgauauuuuccggaaaaagcgccugaccaucauggaccuccacccgggcgcgggcaaaacgaagagauaccugcccgccauaguuagggaagcaauuaaacgggggcuucgaacauuaauccuggcuccaacuagaguggucgccgcugagauggaagaggcacuccgcggauugccuaucagguaucagacccccgccauucgugccgagcauacaggucgggaaaucguggaccugaugugucacgcuaccuuuacuaugagacuccuguccccaguuagggugccuaacuacaaucuuauuauaauggaugaggcgcacuucaccgaccccgcaaguaucgccgcucgcggcuauauuucuacacgagucgaaaugggggaggccgcaggaaucuuuaugacggccacuccaccgggcagcagagauccuuucccccaguccaacgcuccaaucauggacgaggaacgggagauucccgaaaggucauggaauucuggucaugagugggugaccgauuuuaaggggaagacaguaugguucgugccuagcauaaaagcgggaaacgacaucgccgcaugccugcgcaagaauggcaaaaagguuauucaauugagucguaaaaccuuugauuccgaauacgucaagacuagagcuaacgacugggauuucguggugacaaccgacaucagcgagaugggcgccaauuuucgggcagagagggucauugauccacgccgauguaugaagcccguaauccuaacggacggggaagagagagugauacuggccggaccuaugccgguuacucacucuucagcugcccagcggaggggucgcaucggcagaaacccaaaaaaugaaaacgaccaguauauuuacaugggggagccccucgaaaaugaugaggacugcgcgcauuggaaggaggcaaaaauguuacuggauaacaucaauacaccugaaggaauuauccccuccauguucgagccagaaagggagaagguggacgccauagauggcgaauaccggcuucguggugaggcucgcaaaaccuuugucgaccugaugcgaagaggggaucucccugugugguuggccuauaggguugcugcagagggcauuaacuacgccgaccggcgcugguguuucgauggaaucaagaauaaccaaauucuggaagagaacguggaagucgagaucuggaccaaagagggcgaaagaaagaagcucaaacccagguggcuggacgcucggauauauagugauccacuugcccuaaaggaguucaaagaauuugcagcggggcgaaagagccugacuuugaauuuaaucacagagaugggaagacugccuaccuucaugacacagaaagcccgcgacgcucucgauaaccuggccgugcuucacacugcagaaguagguggcagggcuuacaaucacgcccugucggagcucccggagacguuggaaacccugcuacugcucacacuucuggcaacugugaccgggggaauuuuuuuauucuugaugucuggcaaggguaucgggaagaugacacugggcaugugcugcauuaucaccgccuccauacuccugugguaugcucagauucagccccauuggaucgcggccagcaucauucuugaguuuuuccugaucguucucuugauaccagaaccugagaaacaacggacuccccaggacaaccagcugacguacgucgugauugcaaucuuaaccguggucgcugccacaauggccaaugaaaugggauuucuagagaagacuaaaaaggaccugggccucgggucaauuaccacacaggagagugaaucuaacauccuugauauagaccugcguccagcauccgcuuggaccuuguaugccguugcgacuacauucgugacgccuaugcugagacacagcaucgagaauucaaguguaaacgugagccucaccgcuauugccaaucaagcaacuguccugaugggacuugguaggggcuggccccucuccaaaauggauaucggggugccgcuguuggccauuggauguuacucucagguuaacccaaucacacugaccgcugcauuacuacugcucguggcccauuacgcgauuaucggcccuggucuucaggcuaaggccacccgcgaagcacagaagcggacagccgcugggauaaugaaaaaucccacugucgacggcauuacgguaaucgaucuggagccaauccccuaugacccuaaguuugaaaaacaauugggacaggugaugcugcucguucugugcgugacccagguccuuaugaugcgaacaacuugggccuuaugugaggcacugacccucgcuacaggcccgauuagcaccuugugggaggggaaccccggaagauucuggaauacuacgauagccguguccauggcgaacaucuuuaggggcucauaccuggccggugcagggcuacuguucucuauuaugaagaauacaaccaacacucgccggggaaccggcaauaucggugaaacacucggcgagaaauggaagaguagacuuaacgcucuggggaagucggaauuucagauuuauaaaaagagcggaauccaagaggucgaucguacuuuggccaaagagggcauaaagaggggggaaaccgaccaccaugcagugucccggggaucugcuaaacugcgcugguucguugagcgaaacauggugacaccagaaggcaagguaguggaucucgguugcgggagaggaggcuggucauacuauugugguggccugaaaaaugucagggagguuaagggguuaacgaagggaggcccugggcacgaagagcccaucccuaugagcaccuacggauggaaccuugugcggcugcaguccggcgucgacguguucuuuacuccacccgagaaaugcgauacacuccuaugugacauuggugaaaguucuccuaauccaaccaucgaggccgggcgcacucugagaguauugaaccugguggaaaauuggcucaacaauaacacacaguucugcguuaaggugcuuaaucccuauaugccgagcgucauugagaaaauggaaacccugcaaaggaaguacggaggcgccuuggugcgaaacccucugucacggaauuccacgcacgagauguacugggucaguaacgcgaccggcaauaucgugagcucuguuaacaugauaucccguaugcucauuaauagauuuacaaugaaacauaagaaggcuacuuaugagccagauguagacuuagggucaggaacccgcaacaucgguaucgaaaacgagauucccaaucuggacauaaucggcaaaaggauugaaaagaucaaacaggagcacgaaacaagcuggcauuacgaucaggaccacccuuauaagacuugggcauaccacgggucguaugagaccaaacagacaggaucugccaguuccauggugaacggcgucgugaagcuucugaccaagccaugggauguugugcccauggucacucaaauggcuaugacggacacaaccccguucggucagcagcggguguuuaaagagaagguagauacuagaacccaggaaccuaaagaggggacaaagaaacuaaugcgcauuacggccgaauggcucuggaaggagcugggaaagaaaaagacccccaggauguguacucgagaggaauucacacggaaagugagaagcaaugcagccuugggcgcuaucuuuaccgacgagaacaaguggaaaucagcgagggaagccguugaggauucccgcuucugggaacuggucgaccgugagcggaaucuccaucuugagggcaagugcgaaacuuguguguacaacaugauggggaaaagagagaagaagcugggagaauuugguaaagcaaagggcucuagggcuauaugguauaugugguuaggggcccgcuuccuggaguuugaagcauugggauuccucaaugaggaucacugguuuagccgaggcaacagucuguccgguguggagggggaaggacuacauaaacuuggcuacauccugcgggacgucagcaagaaagagggcggggccauguacgcugaugacacagccggaugggacaccagaauuacacucgaagaucugaagaaugaggaaaugguuacuaaccacaugaagggugagcauaaaaaguuggcggaggcaaucuucaaacugaccuaucaaaauaaggugguaagggugcagcgcccaacgccuagaggcaccgucauggacauuaucucucggaaagaucagagggggucaggacaggugggcacauacggucucaacacuuucaccaauauggaagcccaacuuauucgucagauggagggggaaggaauauuuaagaguauccagcgacugacaguuacugaggagauugcugugcaaaacugguuagcccgcgucggcagagaacggcuguccaggauggcaaucagcggcgacgauugcgugguaaagcccuuggacgaucgcuucgcuucugcccucaccgcucugaaugacauggggaaaguuagaaaggauauccagcagugggagccaucgcggggauggaacgacuggacgcaggugcccuuuugcucacaccacuuccaugaacuagucaugaaagaugguagggugcuuguggucccuugucgaaaccaagacgagcugauuggccgugccagaauaagccagggggcaggauggucccucaaggaaacagcgugccugggcaaaaguuaugcccagauguggaccuugauguacuuucaccgccgggauuuaaggcuggcugccaaugcaaucuguucugcuguuccaagccauugggugccgacuuccagaacaaccuggucaauucacgccaagcacgaguggaugacuaccgaggacaugcucgcaguauggaaccgcguguggauccaggaaaaucccuggauggaggacaagacaccugucgaaaguugggaggaagugccauaucuugguaaacgggaggaucaauggugcgggucucugauuggacuaacgagcagggccaccugggcgaagaacauccagacugcuauaaaucagguucgaucccugaucggcaacgaggaauacacagacuauaugcccucaaugaaaagauuccggaaggaggaagaggaagccggcgugcucugguga

SEQ ID NO: 14699 - RNA, 9876 nt, Artificial Sequence
  derived and/or modified CDS sequence (opt3) from DENV-2__EU687235__SS-prME
accgccggcgugauaauuaugcugauaccaacggcuauggcuuuccaccucacuacgcggaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagacagucgcuguccaacucaaggagagcccucccugaaugaggaacaggauaaacgauuuaucugcaagcauucuaugguggacagaggcugggguaacggguguggacuguucggcaagggcgggauuguaaccugcgccauguuuacaugcaaaaagaauauggagggaaaaguggugcucccugaaaaccuggaguacaccauagucaucacuccacacagcggugaagaacaugcuguuggcaaugauacggggaagcacggaaaagagauuaagaucacaccgcaguccucaauaaccgaagccgagcuuacuggcuaugguaccgugacaauggaauguagucccaggaccgggcuggacuucaacgagaugguauugcuccagauggaagauaaagcauggcuggugcaccggcaaugguuuuuagaccugccucucccauggcuucccggcgcugacacucagggaagcaauuggauucagaaggagacacuggucacguucaagaacccucaugccaaaaagcaggaugugguuguguugggcucucaagagggggcgaugcacaccgcccuaacuggagcaacagaaauccagauguccucagguaaucugcucuuuaccggccaucugaaaugccgucuucgcauggacaagcugcaguugaaagggaugagcuacaguauguguacaggaaaguucaagaucgucaaagagauugcugaaacucaacacggcaccaucgugauuagaguacaguaugagggugaugggucuccaugcaagauacccuucgagaucauggaccucgagaaaaggcauguucugggccgguuaauuacggugaacccgaucgucaccgagaaggauuccccugugaacaucgaagccgagcccccauuuggagacagcuacauuauaaucggcgucgaaccugggcagcugaaacuaaauugguucaagaagggaucgucuauuggucagauguuugagacaacuaugcgaggcgcuaaacgcauggccauccucggggauaccgcaugggacuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgauaccgggugugugguuuccuggaagaauaaagaguugaagugcggaagcggcaucuucauaacugacaacguccacacauggaccgaacaguacaaguuucagcccgagucuccaucaaaacucgcuagugccauucaaaaggcacaugaagaggguaucuguggcauuaggagcgugacucggcuggaaaauuuaauguggaaacagaucacccccgagcugaaccacauacuauccgagaaugaagugaagcucacaaucaugacgggggauauuaaaggaaucaugcaggccggcaagcgcucucugagaccucagccaaccgagcuuaaauauucguggaagacuugggggaaggcuaaaauguugagcacagaaucccauaaccaaaccuuccugauugacggaccggagacagccgaaugccccaauacuaacagggcauggaacucacucgaggucgaggacuacggcuuugguguuuucaguaccaacaucuggcugaaguuacgugaaaaacaggauguguuuugugacucuaagcugaugagcgcggcuauaaaagauaaucgggccgugcacgcagacaugggguauuggauugaguccgcccuuaacgauacguggaagauggaaaaggcuucauucaucgagaucaaaagcugccacuggccuaagucucauacauugugguccaauggaguacucgagagugaaaugauuauccccaaaaauuucgccggccccgucagccagcacaacuaccgaccugguuaucauacccagacugcaggcccauggcaccuggggaagcuagagauggacuuugauuucugugaaggaaccacagugguugugacugaggacugcggcaauagagggcccucucugaggaccacaacggcuuccggaaaacucauuaccgaauggugcugucgcucaugcacucugccgccucuucgguacagaggcgaggaugguuguugguacgggauggagauaaggccauugaaggaaaaggaggaaaaccuggucaauaguuuagugacagccggacauggccaaaucgacaacuuuagccucgguguucugggcauggcgcuuuuccuggaggaaauguugcgcacccgaguggggacuaaacacgccauucuccugguagcugucucguuugugacacuaaucaccggaaauauguccuuccgggaucugggccgugugauggucaugguuggggcaacgaugacugacgauauuggaaugggcgugaccuaucucgcccugcuugcugccuuuaagguaagacccacauucgcagcggguuugcuguuaaggaaacucaccucuaaggagcugaugauggccacuaucgggauagcacuucugagccagucaacaaucccugagaccauucuagaacucacagacgcccuggcauugggaaugauggugcugaaaaucguccgcaacauggagaaguaccaguuagcugugacuauuauggccaucaguugcguucccaaugcagugauacuccaaaacgccuggaaggucuccuguaccauucuggcugcggugucuguuagcccacuucuguugacguccucacagcagaaagccgacuggaucccucucgcacugacaaucaagggccuaaaucccaccgcuauuuuucugacuacccuuagccggacaaguaaaaagagaucuuggccacucaacgaagccgugauggccgucggcaugguauccauacuggcuagcucguugcugaaaaaugauaucccgaugacugggccuuuaguggcaggaggucuccugaccguuugcuaugugcuuacgggcaggucagccgaccuggaguuggaacgagcggcugaugucaagugggaggaccaggccgagauuucugggaguucccccauccucagcauuacaaucucugaagauggaagcauguccaucaaaaaugaggaagaggagcacacccugacuauccuaauucgcacaggccugcuugugaucucagguguauucccagugaguauucccaucaccgcagccgcuugguaccucugggaagucaagaagcaacgggcagggguucugugggacgugccuagcccacccuuggugggaaaagccgaguuagaagauggcgcguauagaauaaagcagaggggcauuuuuggguacucucagaucggagcuggugucuauaaagagggcacuuuccauacaauguggcacgugacccguggggccguucugaugcaucgcggaaagcggaucgaaccuuccugggcagacgucaaaaaggaucucauuucauacggcgguggguggaagcuggagggagaguggaaagaaggcgaggaagugcagguccuugcccuggagccgggcaagaauccaagagcugugcaaacgaaacccggguuguuuaagacuaacaccggaacaaucggugccguuagucuagacuucagcccuggcaccuccgggucuccaauaguggauaggaaaggaaaggucgugggccuguacgguaaugggguagucacacgaucgggagcauaugugagcgcuauugcccagacugaaaagucaaucgaggacaaccccgagauugaagaugacaucuuccggaaaaagcgccucaccauaauggaccugcacccuggcgcgggcaaaacgaagagauaccuuccggccauuguuagggaggcaaucaaacggggguuacgaacacugauccucgcucccacuagaguggucgccgcugaaauggaggaagcauugcgcggacugccaauuagguaucagaccccugccauccgugccgagcauacaggucgggagauuguggaucucaugugucacgcuaccuuuacuaugagacugcuuucccccguuagggugccaaacuacaaucugauaaucauggacgaagcgcacuucaccgauccugcaaguauugccgcucgcggcuauaucucuacacgagucgagaugggggaagccgcaggaaucuuuaugacggccacucccccaggcagcagagacccguucccucaguccaacgcucccauuauggaugaggagcgggaaauaccagagaggucauggaacucuggucaugaaugggugaccgacuuuaaggggaagacaguaugguucgugcccagcaucaaagcgggaaacgauauugccgcaugcuugcgcaagaauggcaaaaagguuauccaacuaagucguaaaaccuuugacuccgaguacgucaagacuagagcuaacgauugggacuucguggugacaaccgauauuagcgaaaugggcgccaauuuucgggcagagagggucaucgacccucgccgauguaugaagccaguaauacugacggacggggaggaaagagugauccucgccggacccaugccuguuacucacucuucagcugcccagcggaggggucgcauuggcagaaacccgaaaaaugagaacgaucaguauaucuacaugggggaaccauuagagaaugacgaagauugcgcgcauuggaaggaggcaaaaaugcugcuugacaacauuaauacacccgagggaaucauaccuuccauguucgaacccgagagggaaaagguggaugccauugacggcgaguaccggcugcguggugaagcucgcaaaaccuuugucgaucucaugcgaagaggggacuugccaguguggcuggccuauaggguugcugcagagggcaucaacuacgccgaucggcgcugguguuucgacggaauuaagaauaaccaaauccucgaggaaaacguggaggucgaaauauggaccaaagagggcgagagaaagaagcugaaaccuagguggcuugaugcucggaucuauagugacccccuagcccugaaggaguucaaagaguuugcagcggggcgaaagagcuugacuuuaaaucugauuacagaaaugggaagacucccaaccuucaugacacagaaagcccgcgaugcucuggacaaccuugccgugcugcacacugcagagguagguggcagggcuuacaaucacgcccucucggaauugccugagacgcuggagacccuacugcuccuuacacuguuagcaacugugaccgggggaaucuuuuuguuccugaugucuggcaaggguauugggaagaugacacucggcaugugcugcaucauaaccgccuccauucugcuuugguaugcucagauccagccgcauuggaucgcggccagcauuauccuggaauuuuuccucauaguuuugcugauucccgagccagaaaaacaacggacuccucaggacaaccaguuaacguacgucgugaucgcaauucuaaccguggucgcugccacaauggccaaugagaugggauuucuggaaaagacuaaaaaggaucucggccuugggucaaucaccacacaggagagugagucuaacauacuggacaucgauuugcgucccgcauccgcuuggacccuguaugccguugcgacuacauucgugacgccaaugcucagacacagcauugaaaauucaaguguaaacgugagccugaccgcuaucgccaaucaagcaacuguccuuaugggacucgguaggggcuggccucuguccaaaauggacauuggggugcccuugcuggccaucggauguuacucucagguuaacccgauuacauuaaccgcugcacuacugcuccuuguggcccauuacgcgaucauaggcccaggucugcaggcuaaggccacccgcgaggcacagaagcggacagccgcugggauuaugaaaaauccuacugucgauggcaucacgguaaucgacuuggaacccauuccauaugaucccaaguuugagaaacaacugggacaggugaugcuccugguucuuugcgugacccaggucuuaaugaugcgaacaacuugggcccugugugaagcacucaccuuggcuacaggcccuauaagcacccugugggaggggaacccgggaagauucuggaauacuacgaucgccguguccauggcgaacauuuuuaggggcucauaccuagccggugcagggcuacucuucucuaucaugaagaauacaaccaacacucgccggggaaccggcaauauuggugagacacuuggcgaaaaauggaagaguagacugaacgcuuuggggaagucggaguuucagaucuauaaaaagagcggaauacaagaagucgaccguacucuggccaaagagggcaucaagaggggagaaaccgaucaccaugcagugucccgggggucugcuaaacuccgcugguucguugaacgaaacauggugacacccgagggcaagguaguggaccuggguugcgggagaggaggcuggucauacuauugugguggccuuaaaaaugucagggaaguuaaggggcuaacgaagggaggcccagggcacgaggaaccuauucccaugagcaccuacggauggaaccuggugcggcuccaguccggcgucgauguguucuuuacuccuccagagaaaugcgacacacuacugugugauaucggugagaguucucccaauccuaccauugaagccgggcgcacuuugagaguacugaaccucguggagaauuggcuuaacaauaacacacaguucugcguuaaggugcugaauccauauaugcccagcgucaucgagaaaauggagaccuugcaaaggaaguacggaggcgcccuggugcgaaacccgcucucaagaaauuccacgcacgaaauguacugggucaguaacgcgaccggcaauauagugagcucuguuaacaugauuucccguauguuaaucaauagauuuacaaugaaacauaagaaggcuacuuaugagccugacguagaccuggggucaggaacccgcaacaucgguauugagaacgaaauaccaaaucuugauaucauuggcaaaaggaucgagaagauuaaacaggaacacgagacaagcuggcauuacgaccaggaucaccccuauaagacuugggcauaccacgggucguaugaaaccaaacagacaggaucugccaguuccauggugaacggcgucgugaagcugcuaaccaagccuugggacguugugccaauggucacucaaauggcuaugacggauacaacccccuucggucagcagcggguguuuaaagagaagguagacacuagaacccaggagccgaaagaagggacaaagaaacucaugcgcaucacggccgaguggcuguggaaggaauugggaaagaaaaagaccccuaggauguguacucgagaggaguucacacggaaagugagaagcaaugcagcccugggcgcuauauuuaccgaugaaaacaaguggaaaucagcgagggaggccguugaagacucccgcuucugggagcucgucgaucgugaacggaaucuucaucuggagggcaagugcgagacuuguguguacaacaugauggggaaaagagaaaagaaguuaggagaguuugguaaagcaaagggcucuagggcuaucugguauauguggcugggggcccgcuucuuggaauuugaggcacucggauuccugaaugaagaccacugguuuagccgaggcaacagucuauccgguguggagggggagggacuucauaaacugggcuacauucuccgggaugucagcaagaaagaaggcggggccauguacgcugacgacacagccggaugggauaccagaaucacacuggaggacuugaagaaugaagagaugguuacuaaccacaugaagggugaacauaaaaagcuggcggaggcaauuuucaaacucaccuaucaaaauaaggugguaagggugcagcgccccacgccaagaggcaccgucauggauaucauuucucggaaagaccagagggggucaggacaggugggcacauacggucuuaacacuuucaccaauauggaggcccaacugauacgucagauggaaggggagggaaucuuuaagaguauucagcgauuaacaguuacugaagagaucgcugugcaaaacuggcuggcccgcgucggcagagagcgguuguccaggauggcaaucagcggcgaugacugcgugguaaagccucucgaugaccgcuucgcuucugcccugaccgcucuaaaugauauggggaaaguuagaaaggacauucagcagugggaacccucgcggggauggaacgauuggacacaggugccauuuugcucacaccacuuccaugagcuugucaugaaagacgguagggugcuggugguccccugucgaaaccaagaugaacucauaggccgugccagaaucagccagggggcaggauggucccugaaggagacagcgugcuugggcaaaaguuaugcccagauguggaccuuaauguacuuucaccgccgggaccugaggcucgcugccaaugcaauuuguucugcuguuccuagccauugggugccaacuuccagaacaaccuggucaauccacgccaagcacgaauggaugacuaccgaggacaugcuugcaguauggaaccgcguguggauucaggagaauccguggauggaagauaagacacccgucgagaguugggaagaggugccuuaucuggguaaacgggaagaccaauggugcgggucucuaaucggacugacgagcagggccaccugggcgaagaacauacagacugcuaucaaucagguucgaucccucauuggcaacgaggaguacacagauuauaugccaucaaugaaaagauuccggaaggaagaggaagaggccggcguguugugguga

SEQ ID NO: 14700 - RNA, 9876 nt, Artificial Sequence
  derived and/or modified CDS sequence (opt3) from DENV-2__EU687236__SS-prME
accgccggagugaucauuaugcugauacccaccgcuauggcuuuccaccucacuacgaggaauggggagccucauaugaucgucggaaggcaggaaaaggguaaaagccuucuguuuaagaccgaggacggcguuaauaugugcacguugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauuaaaggaaucaugcaggccggcaagcgcucucugagaccucagccaaccgaacuuaaauauucguggaagacuugggggaaggcuaaaauguugagcacagagucccauaaccaaaccuuccugauugauggaccggaaacagccgagugccccaauacuaacagggcauggaacucacucgaggucgaagacuacggcuuugguguuuucaguaccaacaucuggcugaaguuacgugagaaacaggacguguuuugugauucuaagcugaugagcgcggcuauaaaagacaaucgggccgugcacgcagauaugggguauuggauugaauccgcccuuaacgacacguggaagauggagaaggcuucauucaucgagaucaaaagcugccacuggccuaagucucauacauugugguccaauggaguacucgaaagugagaugauuauccccaagaauuucgccggccccgucagccagcacaacuaccgaccugguuaucauacccagacugcaggcccauggcaccuggggaagcuagaaauggauuuugacuucugugagggaaccacagugguugugacugaagauugcggcaauagagggcccucucugaggaccacaacggcuuccggaaaacucauuaccgaguggugcugucgcucaugcacucugccgccucuucgguacagaggcgaggacgguuguugguacgggauggaaauaaggccauugaaggagaaggaagagaaccuggucaauaguuuagugacagccggacauggccaaaucgauaacuuuagccucgguguucugggcauggcgcuuuuccuggaagagauguugcgcacccgaguggggacuaaacacgccauucuccugguagcugucucguuugugacacuaaucaccggaaauauguccuuccgggaccugggccgugugauggucaugguuggggcaacgaugacugaugacauuggaaugggcgugaccuaucucgcccugcuugcugccuuuaagguaagacccacauucgcagcggguuugcuguuaaggaaacucaccucuaaggagcugaugauggccacuaucgggauagcacuucugagccagucaacaaucccugaaaccauucuagagcucacagaugcccuggcauugggaaugauggugcugaaaaucguccgcaacauggaaaaguaccaguuagcugugacuauuauggccaucaguugcguucccaaugcagugauacuccaaaacgccuggaaggucuccuguaccauucuggcugcggugucuguuagcccacuucuguugacguccucacagcagaaagccgacuggaucccucucgcacugacaaucaagggccuaaaucccaccgcuauuuuucugacuacccuuagccggacaaguaaaaagagaucuuggccacucaacgaggccgugauggccgucggcaugguauccauacuggcuagcucguugcugaaaaaugacaucccgaugacugggccuuuaguggcaggaggucuccugaccguuugcuaugugcuuacgggcaggucagccgaucuggaauuggagaaggcggcugacgucaaaugggaggaucaggccgaaauuucugggaguucccccauccucagcauuacaaucucugaggacggaagcauguccauaaagaacgaagaggaggaacacacccugacuauccuaauucgaacaggccugcuugugaucucagguguauucccagugaguauucccaucaccgcagccgcuugguaccucugggaggucaagaaacaacgcgcagggguucugugggaugugccuagcccacccccugugggaaaggccgaauuggaggacggcgcguaucggauaaaacagagaggcauuuuuggguacucucagaucggagcuggugucuauaaggaaggcacuuuccauacaauguggcacgugaccagaggggccguuuuaaugcaucguggaaaacgcaucgagccguccugggcagauguaaagaaggaccugauuucauacggcgguggguggaaacucgagggagaauggaaggagggcgaagaggugcagguccuggcccuugaaccaggcaaaaauccccgggcugugcaaacgaagccugggcuguuuaaaacuaacaccggaacaaucggugccguuaguuuggauuucagcccaggcaccuccgggucucccauaguggacagaaagggaaaggucgugggccuauacgguaaugggguagucacaaggucgggagcauaugugagcgcuauugcccagacugagaaaucaaucgaggauaacccugaaauugaggacgauaucuuccgaaagaaacggcugaccauaauggaccuccacccgggcgcgggcaagacgaaacgcuaccugcccgccauuguuagagaagcaaucaagagggggcuucggacauuaauccuggcuccaacucgaguggucgccgcugagauggaagaggcacucagaggauugccuauucgcuaucagacccccgccaucagggccgagcauacaggucgugaaauuguggaccugaugugucacgcuaccuuuacuaugcggcuccuguccccaguuagagugccuaacuacaaucuuauaaucauggaugaggcgcacuucaccgaccccgcaaguauugccgcuaggggcuauaucucuacacgcgucgaaaugggggaggccgcaggaaucuuuaugacggccacuccaccgggcagccgagauccuuucccccaguccaacgcuccaauuauggacgaggaaagagagauacccgaacggucauggaacucuggucaugagugggugaccgauuuuaaggggaaaacaguaugguucgugccuagcaucaaggcgggaaacgacauugccgcaugccugaggaaaaauggcaagaaaguuauccaauugagucgcaagaccuuugauuccgaauacgucaagacucgugcuaacgacugggauuucguggugacaaccgacauuagcgagaugggcgccaauuuuagagcagagcgggucaucgauccaaggcgcuguaugaaacccguaauacuaacggacggggaagaacgagugauccuggccggaccuaugccgguuacucacucuucagcugcccagagacgggguaggauuggccgcaacccaaagaaugaaaacgaccaguauaucuacaugggggagccccucgaaaaugaugaggacugcgcgcauuggaaagaggcaaagauguuacuggauaacauuaauacaccugaaggaaucauacccuccauguucgagccagaaagagagaaaguggacgccauugauggcgaauacaggcuucggggugaggcucguaagaccuuugucgaccugaugcgccgaggggaucucccugugugguuggccuauagaguugcugcagagggcaucaacuacgccgacaggcggugguguuucgauggaauuaaaaauaaccaaauccuggaagagaacguggaagucgagauauggaccaaggagggcgaacgcaagaaacucaagcccagauggcuggacgcuaggaucuauagugauccacuugcccuaaaagaguucaaggaauuugcagcggggcggaaaagccugacuuugaauuuaauuacagagaugggacgacugccuaccuucaugacacagaaggccagagacgcucucgauaaccuggccgugcuucacacugcagaaguagguggccgcgcuuacaaucacgcccugucggagcucccggagacguuggaaacccugcuacugcucacacuucuggcaacugugaccgggggaaucuuuuuauucuugaugucuggcaaggguauugggaaaaugacacugggcaugugcugcaucauaaccgccuccauucuccugugguaugcucagauccagccccauuggaucgcggccagcauuauccuugaguuuuuccugauaguucucuugauuccagaaccugagaagcaaaggacuccccaggacaaccagcugacguacgucgugaucgcaauuuuaaccguggucgcugccacaauggccaaugaaaugggauuucuagagaaaacuaagaaagaccugggccucgggucaaucaccacacaggagagugaaucuaacauacuugauaucgaccugcggccagcauccgcuuggaccuuguaugccguugcgacuacauucgugacgccuaugcugcgucacagcauugaaaauucaaguguaaacgugagccucaccgcuaucgccaaucaagcaacuguccugaugggacuugguagaggcuggccccucuccaagauggauauuggggugccgcuguuggccaucggauguuacucucagguuaacccaauuacacugaccgcugcauuacuacugcucguggcccauuacgcgaucauaggcccuggucuucaggcuaaggccaccagggaagcacagaaacgcacagccgcugggauuaugaagaaucccacugucgacggcaucacgguaaucgaucuggagccaauucccuaugacccuaaauuugaaaagcaauugggacaggugaugcugcucguucugugcgugacccagguccuuaugaugcggacaacuugggccuuaugugaggcacugacccucgcuacaggcccgauaagcaccuugugggaggggaaccccggacgauucuggaauacuacgaucgccguguccauggcgaacauuuuuagaggcucauaccuggccggugcagggcuacuguucucuaucaugaaaaauacaaccaacacuaggcgcggaaccggcaauauuggugaaacacucggcgagaaguggaagagucggcuuaacgcucuggggaaaucggaauuucagaucuauaagaaaagcggaauacaagaggucgauagaacuuuggccaaggagggcaucaaacguggggaaaccgaccaccaugcaguguccaggggaucugcuaagcugcggugguucguugagcgcaacauggugacaccagaaggcaaaguaguggaucucgguugcgggcgaggaggcuggucauacuauugugguggccugaagaaugucagagagguuaagggguuaacgaaaggaggcccugggcacgaagaaccaauuccuaugagcaccuacggauggaaccuugugaggcugcaguccggcgucgacguguucuuuacuccacccgagaagugcgauacacuccuaugugacaucggugaaaguucuccuaauccaaccauugaggccgggcggacucugcgcguauugaaccugguggaaaauuggcucaacaauaacacacaguucugcguuaaagugcuuaaucccuauaugccgagcgucaucgagaagauggaaacccugcaaagaaaauacggaggcgccuuggugaggaacccucugucacgaaauuccacgcacgagauguacugggucaguaacgcgaccggcaauauagugagcucuguuaacaugauuucccggaugcucaucaaucguuuuacaaugaagcauaagaaagcuacuuaugagccagauguagacuuagggucaggaaccagaaacaucgguauugaaaacgagauacccaaucuggacaucauuggcaagcgcaucgagaaaauuaagcaggagcacgaaacaagcuggcauuacgaucaggaccacccuuauaaaacuugggcauaccacgggucguaugagaccaagcagacaggaucugccaguuccauggugaacggcgucgugaaacuucugaccaaaccaugggauguugugcccauggucacucaaauggcuaugacggacacaaccccguucggucagcagaggguguuuaaggagaaaguagauacucggacccaggaaccuaaggaggggacgaaaaagcuaaugagaaucacagccgaauggcucuggaaggagcugggcaaaaagaaaacaccccgcauguguacuagggaggaguucacaaagaaagugcgaagcaaugcagccuugggcgcuauauuuaccgacgagaacaaguggaaaucagcgcgggaagccguugaggauuccagauucugggaacuggucgacagggagcgcaaucuccaucuugagggcaagugcgaaacuuguguguacaacaugauggggaagcgugagaaaaagcugggagaauuugguaaagcaaagggcucucgggcuaucugguauaugugguuaggggccagauuccuggaguuugaagcauugggauuccucaaugaggaucacugguuuagcaggggcaacagucuguccgguguggagggggaaggacuacauaaacuuggcuacauucugcgcgacgucagcaagaaggagggcggggccauguacgcugaugacacagccggaugggacacccgaaucacacucgaagaucugaaaaaugaggaaaugguuacuaaccacaugaagggugagcauaaaaaguuggcggaggcaauuuucaaacugaccuaucaaaauaaggugguacgggugcagagaccaacgccuaggggcaccgucauggacaucauuucucgcaaggaucagagagggucaggacaggugggcacauacggucucaacacuuucaccaauauggaagcccaacuuauacggcagauggagggggaaggaaucuuuaaaaguauucagaggcugacaguuacugaggagaucgcugugcaaaacugguuagcccgugucggccgagaacgccuguccagaauggcaaucagcggcgacgauugcgugguaaagcccuuggacgaucgguucgcuucugcccucaccgcucugaaugacauggggaaaguuaggaaggauauucagcagugggagccaucgcgcggauggaacgacuggacacaggugcccuuuugcucacaccacuuccaugagcuagucaugaaagaugguagagugcuuguggucccuugucggaaccaagacgagcugauaggcagggcccgaaucagccagggggcaggauggucccucaaggaaacagcgugccugggcaagaguuaugcccagauguggaccuugauguacuuucaccguagagauuuacgccuggcugccaaugcaauuuguucugcuguuccaagccauugggugccgacuucccggacaaccuggucaauccacgccaaacacgaguggaugacuaccgaggacaugcucgcaguauggaacaggguguggauucaggaaaaucccuggauggaggacaagacaccugucgaaaguugggaggaagugccauaucuugguaaaagagaggaucaauggugcgggucucugaucggacuaacgagccgcgccaccugggcgaagaacauacagacugcuaucaaucagguucggucccugauuggcaacgaggaauacacagacuauaugcccucaaugaaaagguuccgaaaggaggaagaggaagccggcgugcucugguga

SEQ ID NO: 14701 - RNA, 9876 nt, Artificial Sequence
  derived and/or modified CDS sequence (opt3) from DENV-2__EU687237__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauuaaaggaaucaugcaggccggcaagcgcucucugagaccucagccaaccgaacuuaaauauucguggaagacuugggggaaggcuaaaauguugagcacagagucccauaaccaaaccuuccugauugauggaccggaaacagccgagugccccaauacuaacagggcauggaauucacucgaggucgaagacuacggcuuugguguuuucaguaccaacaucuggcugaaguuacgugagaaacaggacguguuuugugauucuaagcugaugagcgcggcuauaaaagacaaucgggccgugcacgcagauaugggguauuggauugaauccgcccuuaacgacacguggaagauggagaaggcuucauucaucgagaucaaaagcugccacuggccuaagucucauacauugugguccaauggaguacucgaaagugagaugauuaucccaaaaaacuucgccggccccgucagccagcacaacuaccgaccugguuaucauacccagacugcaggcccauggcaccuggggaagcuagaaauggauuuugacuucugugagggaaccacagugguugugacugaagauugcggcaauagagggcccucucugaggaccacaacggcuuccggaaaacucauuaccgaguggugcugucgcucaugcacucugccgccucuucgguacagaggcgaggacgguuguugguacgggauggaaauaaggccauugaaggagaaggaagagaaccuggucaauaguuuagugacagccggacauggccaaaucgauaacuuuagccucgguguucugggcauggcgcuuuuccuggaagagauguugcgcacccgaguggggacuaaacacgccauucuccugguagcugucucguuugugacacuaaucaccggaaauauguccuuccgggaccugggccgugugauggucaugguuggggcaacgaugacugaugacauuggaaugggcgugaccuaucucgcccugcuugcugccuuuaagguaagacccacauucgcagcggguuugcuguuaaggaaacucaccucuaaggagcugaugauggccacuaucgggauagcucuucugagccagucaacaaucccugaaaccauucuagagcucacagaugcccuggcauugggaaugauggugcugaaaaucguccgcaacauggaaaaguaccaguuagcugugacuauuauggccaucaguugcguucccaaugcagugauacuccaaaacgccuggaaggucuccuguaccauucuggcugcggugucuguuagcccacuucuguugacguccucacagcagaaagccgacuggaucccucucgcacugacaaucaagggccuaaaucccaccgcuauuuuucugacuacccuuagccggacaaguaaaaagagaucuuggccacucaacgaggccgugauggccgucggcaugguauccauacuggcuagcucguugcugaaaaaugacaucccgaugacugggccuuuaguggcaggaggucuccugaccguuugcuaugugcuuacgggcaggucagccgaucuggaauuggagcgagcggcugacgucaagugggaggaucaggccgaaauuucugggaguucccccauccucagcauuacaaucucugaggacggaagcauguccauaaaaaacgaagaggaggaacacacccugacuauccuaauucgcacaggccugcuugugaucucagguguauucccagugaguauucccaucaccgcagccgcuugguaccucugggaggucaagaagcaacgggcagggguucugugggaugugccuagcccacccccugugggaaaagccgaauuggaggacggcgcguauagaauaaagcagaggggcauuuuuggguacucucagaucggagcuggugucuauaaagaaggcacuuuccauacaauguggcacgugacccguggggccguuuuaaugcaucgcggaaagcggaucgagccguccugggcagauguaaaaaaggaccugauuucauacggcgguggguggaagcucgagggagaauggaaagagggcgaagaggugcagguccuggcccuugaaccaggcaagaaucccagagcugugcaaacgaaaccugggcuguuuaagacuaacaccggaacaaucggugccguuaguuuggauuucagcccaggcaccuccgggucucccauaguggacaggaaaggaaaggucgugggccuauacgguaaugggguagucacacgaucgggagcauaugugagcgcuauugcccagacugagaagucaaucgaggauaacccugaaauugaggacgauaucuuccggaaaaagcgccugaccauaauggaccuccacccgggcgcgggcaaaacgaagagauaccugcccgccauuguuagggaagcaaucaaacgggggcuucgaacauuaauccuggcuccaacuagaguggucgccgcugagauggaagaggcacuccgcggauugccuauuagguaucagacccccgccauccgugccgagcauacaggucgggaaauuguggaccugaugugucacgcuaccuuuacuaugagacuccuguccccaguuagggugccuaacuacaaucuuauaaucauggaugaggcgcacuucaccgaccccgcaaguauugccgcucgcggcuauaucucuacacgagucgaaaugggggaggccgcaggaaucuuuaugacggccacuccaccgggcagcagagauccuuucccccaguccaacgcuccaauuauggacgaggaacgggagauacccgaaaggucauggaauucuggucaugagugggugaccgauuuuaaggggaagacaguaugguucgugccuagcaucaaagcgggaaacgacauugccgcaugccugcgcaagaauggcaaaaagguuauccaauugagucguaaaaccuuugauuccgaauacgucaagacuagagcuaacgacugggauuucguggugacaaccgacauuagcgagaugggcgccaauuuucgggcagagagggucaucgauccacgccgauguaugaagcccguaauacuaacggacggggaagagagagugauccuggccggaccuaugccgguuacucacucuucagcugcccagcggaggggucgcauuggcagaaacccaaaaaaugaaaacgaccaguauaucuacaugggggagccccucgaaaaugaugaggacugcgcgcauuggaaggaggcaaaaauguuacuggauaacauuaauacaccugaaggaaucauacccuccauguucgagccagaaagggagaagguggacgccauugauggcgaauaccggcuucguggugaggcucgcaaaaccuuugucgaccugaugcgaagaggggaucucccugugugguuggccuauaggguugcugcagagggcaucaacuacgccgaccggcgcugguguuucgauggaauuaagaauaaccaaauccuggaagagaacguggaagucgagauauggaccaaagagggcgaaagaaagaagcucaaacccagguggcuggacgcucggaucuauagugauccacuugcccuaaaggaguucaaagaauuugcagcggggcgaaagagccugacuuugaauuuaauuacagagaugggaagacugccuaccuucaugacacagaaagcccgcgacgcucucgauaaccuggccgugcuucacacugcagaaguagguggcagggcuuacaaucacgcccugucggagcucccggagacguuggaaacccugcuacugcucacacuucuggcaacugugaccgggggaaucuuuuuauucuugaugucuggcaaggguauugggaagaugacacugggcaugugcugcaucauaaccgccuccauucuccugugguaugcucagauccagccccauuggaucgcggccagcauuauccuugaguuuuuccugauaguucucuugauuccagaaccugagaaacaacggacuccccaggacaaccagcugacguacgucgugaucgcaauuuuaaccguggucgcugccacaauggccaaugaaaugggauuucuagagaagacuaaaaaggaccugggccucgggucaaucaccacacaggagagugaaucuaacauacuugauaucgaccugcguccagcauccgcuuggaccuuguaugccguugcgacuacauucgugacgccuaugcugagacacagcauugagaauucaaguguaaacgugagccucaccgcuaucgccaaucaagcaacuguccugaugggacuugguaggggcuggccccucuccaaaauggauauuggggugccgcuguuggccaucggauguuacucucagguuaacccaauuacacugaccgcugcauuacuacugcucguggcccauuacgcgaucauaggcccuggucuucaggcuaaggccacccgcgaagcacagaagcggacagccgcugggauuaugaaaaaucccacugucgacggcaucacgguaaucgaucuggagccaauucccuaugacccuaaguuugaaaaacaauugggacaggugaugcugcucguucugugcgugacccagguccuuaugaugcgaacaacuugggccuuaugugaggcacugacccucgcuacaggcccgauaagcaccuugugggaggggaaccccggaagauucuggaauacuacgaucgccguguccauggcgaacauuuuuaggggcucauaccuggccggugcagggcuacuguucucuaucaugaagaauacaaccaacacucgccggggaaccggcaauauuggugaaacacucggcgagaaauggaagaguagacuuaacgcucuggggaagucggaauuucagaucuauaaaaagagcggaauacaagaggucgaucguacuuuggccaaagagggcaucaagaggggggaaaccgaccaccaugcagugucccggggaucugcuaaacugcgcugguucguugagcgaaacauggugacaccagaaggcaagguaguggaucucgguugcgggagaggaggcuggucauacuauugugguggccugaaaaaugucagggagguuaagggguuaacgaagggaggcccugggcacgaagagcccauuccuaugagcaccuacggauggaaccuugugcggcugcaguccggcgucgacguguucuuuacuccacccgagaaaugcgauacacuccuaugugacaucggugaaaguucuccuaauccaaccauugaggccgggcgcacucugagaguauugaaccugguggaaaauuggcucaacaauaacacacaguucugcguuaaggugcuuaaucccuauaugccgagcgucaucgagaaaauggaaacccugcaaaggaaguacggaggcgccuuggugcgaaacccucugucacggaauuccacgcacgagauguacugggucaguaacgcgaccggcaauauagugagcucuguuaacaugauuucccguaugcucaucaauagauuuacaaugaaacauaagaaggcuacuuaugagccagauguagacuuagggucaggaacccgcaacaucgguauugaaaacgagauacccaaucuggacaucauuggcaaaaggaucgaaaagauuaaacaggagcacgaaacaagcuggcauuacgaucaggaccacccuuauaagacuugggcauaccacgggucguaugagaccaaacagacaggaucugccaguuccauggugaacggcgucgugaagcuucugaccaagccaugggauguugugcccauggucacucaaauggcuaugacggacacaaccccguucggucagcagcggguguuuaaagagaagguagauacuagaacccaggaaccuaaagaggggacaaagaaacuaaugcgcaucacggccgaauggcucuggaaggagcugggaaagaaaaagacccccaggauguguacucgagaggaauucacacggaaagugagaagcaaugcagccuugggcgcuauauuuaccgacgagaacaaguggaaaucagcgagggaagccguugaggauucccgcuucugggaacuggucgaccgugagcggaaucuccaucuugagggcaagugcgaaacuuguguguacaacaugauggggaaaagagagaagaagcugggagaauuugguaaagcaaagggcucuagggcuaucugguauaugugguuaggggcccgcuuccuggaguuugaagcauugggauuccucaaugaggaucacugguuuagccgaggcaacagucuguccgguguggagggggaaggacuacauaaacuuggcuacauucugcgggacgucagcaagaaagagggcggggccauguacgcugaugacacagccggaugggacaccagaaucacacucgaagaucugaagaaugaggaaaugguuacuaaccacaugaagggugagcauaaaaaguuggcggaggcaauuuucaaacugaccuaucaaaauaaggugguaagggugcagcgcccaacgccuagaggcaccgucauggacaucauuucucggaaagaucagagggggucaggacaggugggcacauacggucucaacacuuucaccaauauggaagcccaacuuauacgucagauggagggggaaggaaucuuuaagaguauucagcgacugacaguuacugaggagaucgcugugcaaaacugguuagcccgcgucggcagagaacggcuguccaggauggcaaucagcggcgacgauugcgugguaaagcccuuggacgaucgcuucgcuucugcccucaccgcucugaaugacauggggaaaguuagaaaggauauucagcagugggagccaucgcggggauggaacgacuggacgcaggugcccuuuugcucacaccacuuccaugaacuagucaugaaagaugguagggugcuuguggucccuugucgaaaccaagacgagcugauaggccgugccagaaucagccagggggcaggauggucccucaaggaaacagcgugccugggcaaaaguuaugcccagauguggaccuugauguacuuucaccgccgggauuuaaggcuggcugccaaugcaauuuguucugcuguuccaagccauugggugccgacuuccagaacaaccuggucaauccacgccaagcacgaguggaugacuaccgaggacaugcucgcaguauggaaccgcguguggauucaggaaaaucccuggauggaggacaagacaccugucgaaaguugggaggaagugccauaucuugguaaacgggaggaucaauggugcgggucucugaucggacuaacgagcagggccaccugggcgaagaacauacagacugcuaucaaucagguucgaucccugauuggcaacgaggaauacacagacuauaugcccucaaugaaaagauuccggaaggaggaagaggaagccggcgugcucugguga

SEQ ID NO: 14702 - RNA, 9876 nt, Artificial Sequence
  derived and/or modified CDS sequence (opt3) from DENV-2__EU687238__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaaccauuacguggaucggaaugaacuccagaucuacaagccugucagucagucucgugcugguuggcguggucacccuuuaucugggugugaugguacaggccgacacugggugugugguuuccuggaagaauaaagaauugaagugcggaagcggcauuuucaucacagauaacguccacaccuggacugagcaguacaaguuucagcccgaaucuccaucaaaacucgcuagugccauacaaaaggcacaugaggaagguauuuguggcaucaggagcgugacccggcuggagaauuuaauguggaaacagauuacacccgagcugaaccacauccuauccgaaaaugaggugaagcucacgauaaugaccggggacaucaaaggaauuaugcaggccggcaagcgcucucugagaccucagccaacugaacuuaaauauucguggaagacaugggggaaggcuaaaauguugagcaccgagucccauaaccaaacauuccugaucgauggaccggaaacugccgagugccccaauaccaacagggcauggaauucacucgaggucgaagacuacggcuuugguguuuucaguacgaacauuuggcugaaguuacgugagaaacaggacguguuuugugauucuaagcugaugagcgcggcuaucaaagacaaucgggccgugcacgcagauaugggguauuggauagaauccgcccuuaacgacacauggaagauggagaaggcuucauucauugagaucaaaagcugccacuggccuaagucucauaccuugugguccaauggaguacucgaaagugagaugaucauuccaaaaaacuucgccggccccgucagccagcacaacuaccgaccugguuaucauacucagaccgcaggcccauggcaccuggggaagcuagaaauggauuuugacuucugugagggaacaacugugguugugaccgaagauugcggcaauagagggcccucucugaggacaacgaccgcuuccggaaaacucaucacugaguggugcugucgcucaugcacacugccgccucuucgguacagaggcgaggacgguuguugguacgggauggaaauuaggccauugaaggagaaggaagagaaccuggucaauaguuuagugaccgccggacauggccaaauagauaacuuuagccucgguguucugggcauggcgcuuuuccuggaagagauguugcgcacucgaguggggacaaaacacgccauccuccugguagcugucucguuugugacccuaauuacgggaaauauguccuuccgggaccugggccgugugauggucaugguuggggcaacuaugaccgaugacaucggaaugggcgugacauaucucgcccugcuugcugccuuuaagguaagacccaccuucgcagcggguuugcuguuaaggaaacucacuucuaaggagcugaugauggccacaauugggaucgcucuucugagccagucaaccauaccugaaacaauccuagagcucacugaugcccuggcauugggaaugauggugcugaaaauuguccgcaacauggaaaaguaccaguuagcugugaccaucauggccauuaguugcguucccaaugcagugauccuccaaaacgccuggaaggucuccuguacgauacuggcugcggugucuguuagcccacuucuguugacauccucacagcagaaagccgacuggauuccucucgcacugaccaucaagggccuaaaucccacugcuaucuuucugaccacacuuagccggacuaguaaaaagagaucuuggccacucaacgaggccgugauggccgucggcaugguauccauucuggcuagcucguugcugaaaaaugacauaccgaugaccgggccuuuaguggcaggaggucuccugacgguuugcuaugugcuuacaggcaggucagccgaucuggaauuggagcgagcggcugacgucaagugggaggaucaggccgaaaucucugggaguucccccauucucagcaucaccauuucugaggacggaagcauguccaucaaaaacgaagaggaggaacacacucugacaauacuaauccgcaccggccugcuugugauuucagguguauucccagugaguauccccauuacugcagccgcuugguaccucugggaggucaagaagcaacgggcagggguucugugggaugugccuagcccacccccugugggaaaagccgaauuggaggacggcgcguauagaaucaagcagaggggcauauuuggguacucucagauuggagcuggugucuauaaagaaggcacauuccauaccauguggcacgugacgcguggggccguuuuaaugcaucgcggaaagcggaucgagccguccugggcagauguaaaaaaggaccugaucucauacggcgguggguggaagcucgagggagaauggaaagagggcgaagaggugcagguccuggcccuugaaccaggcaagaaucccagagcugugcaaacuaaaccugggcuguuuaagaccaacacaggaaccauuggugccguuaguuuggauuucagcccaggcacauccgggucucccaucguggacaggaaaggaaaggucgugggccuauacgguaaugggguagucacucgaucgggagcauaugugagcgcuauagcccagaccgagaagucaauugaggauaacccugaaaucgaggacgauauuuuccggaaaaagcgccugacgaucauggaccuccacccgggcgcgggcaaaacaaagagauaccugcccgccauaguuagggaagcaauuaaacgggggcuucgaacuuuaauccuggcuccaaccagaguggucgccgcugagauggaagaggcacuccgcggauugccuaucagguaucagacacccgccauucgugccgagcauaccggucgggaaaucguggaccugaugugucacgcuacuuuuaccaugagacuccuguccccaguuagggugccuaacuacaaucuuauuauaauggaugaggcgcacuucacagaccccgcaaguaucgccgcucgcggcuauauuucuacgcgagucgaaaugggggaggccgcaggaaucuuuaugacugccaccccaccgggcagcagagauccuuucccccaguccaacgcuccaaucauggacgaggaacgggagauucccgaaaggucauggaauucuggucaugagugggugacagauuuuaaggggaagaccguaugguucgugccuagcauaaaagcgggaaacgacaucgccgcaugccugcgcaagaauggcaaaaagguuauucaauugagucguaaaacuuuugauuccgaauacgucaagacaagagcuaacgacugggauuucguggugaccacggacaucagcgagaugggcgccaauuuucgggcagagagggucauugauccacgccgauguaugaagcccguaauccuaacugacggggaagagagagugauacuggccggaccuaugccgguuacacacucuucagcugcccagcggaggggucgcaucggcagaaacccaaaaaaugaaaacgaccaguauauuuacaugggggagccccucgaaaaugaugaggacugcgcgcauuggaaggaggcaaaaauguuacuggauaacaucaauaccccugaaggaauuauccccuccauguucgagccagaaagggagaagguggacgccauagauggcgaauaccggcuucguggugaggcucgcaaaaccuuugucgaccugaugcgaagaggggaucucccugugugguuggccuauaggguugcugcagagggcauuaacuacgccgaccggcgcugguguuucgauggaaucaagaauaaccaaauucuggaagagaacguggaagucgagaucuggacuaaagagggcgaaagaaagaagcucaaacccagguggcuggacgcucggauauauagugauccacuugcccuaaaggaguucaaagaauuugcagcggggcgaaagagccugacauugaauuuaaucaccgagaugggaagacugccuacauucaugacucagaaagcccgcgacgcucucgauaaccuggccgugcuucacacggcagaaguagguggcagggcuuacaaucacgcccugucggagcucccggagaccuuggaaacacugcuacugcucacucuucuggcaaccgugacagggggaauuuuuuuauucuugaugucuggcaaggguaucgggaagaugacccugggcaugugcugcauuaucacugccuccauacuccugugguaugcucagauucagccccauuggaucgcggccagcaucauucuugaguuuuuccugaucguucucuugauaccagaaccugagaaacaacggacgccccaggacaaccagcugaccuacgucgugauugcaaucuuaacaguggucgcugccacuauggccaaugaaaugggauuucuagagaagaccaaaaaggaccugggccucgggucaauuacaacccaggagagugaaucuaacauccuugauauagaccugcguccagcauccgcuuggacuuuguaugccguugcgacaacguucgugaccccuaugcugagacacagcaucgagaauucaaguguaaacgugagccucacugcuauugccaaucaagcaacaguccugaugggacuugguaggggcuggccccucuccaaaauggauaucggggugccgcuguuggccauuggauguuacucucagguuaacccaaucacccugaccgcugcauuacuacugcucguggcccauuacgcgauuaucggcccuggucuucaggcuaaggccacacgcgaagcacagaagcggacugccgcugggauaaugaaaaaucccacggucgacggcauuaccguaaucgaucuggagccaauccccuaugacccuaaguuugaaaaacaauugggacaggugaugcugcucguucugugcgugacacagguccuuaugaugcgaacuaccugggccuuaugugaggcacugacacucgcuaccggcccgauuagcacuuugugggaggggaaccccggaagauucuggaauacgacaauagccguguccauggcgaacaucuuuaggggcucauaccuggccggugcagggcuacuguucucuauuaugaagaauaccacuaacacccgccggggaacaggcaauaucggugaaacucucggcgagaaauggaagaguagacuuaacgcucuggggaagucggaauuucagauuuauaaaaagagcggaauccaagaggucgaucguaccuuggccaaagagggcauaaagaggggggaaacagaccaccaugcagugucccggggaucugcuaaacugcgcugguucguugagcgaaacauggugacgccagaaggcaagguaguggaucucgguugcgggagaggaggcuggucauacuauugugguggccugaaaaaugucagggagguuaagggguuaaccaagggaggcccugggcacgaagagcccaucccuaugagcacuuacggauggaaccuugugcggcugcaguccggcgucgacguguucuuuacaccacccgagaaaugcgauacccuccuaugugacauuggugaaaguucuccuaauccaacuaucgaggccgggcgcacacugagaguauugaaccugguggaaaauuggcucaacaauaacacccaguucugcguuaaggugcuuaaucccuauaugccgagcgucauugagaaaauggaaacgcugcaaaggaaguacggaggcgccuuggugcgaaacccucugucacggaauuccacccacgagauguacugggucaguaacgcgacaggcaauaucgugagcucuguuaacaugauaucccguaugcucauuaauagauuuacuaugaaacauaagaaggcuaccuaugagccagauguagacuuagggucaggaacacgcaacaucgguaucgaaaacgagauucccaaucuggacauaaucggcaaaaggauugaaaagaucaaacaggagcacgaaacuagcuggcauuacgaucaggaccacccuuauaagaccugggcauaccacgggucguaugagacaaaacagaccggaucugccaguuccauggugaacggcgucgugaagcuucugacuaagccaugggauguugugcccauggucacgcaaauggcuaugacagacaccacuccguucggucagcagcggguguuuaaagagaagguagauaccagaacacaggaaccuaaagaggggacgaagaaacuaaugcgcauuaccgccgaauggcucuggaaggagcugggaaagaaaaagacucccaggauguguacacgagaggaauucacccggaaagugagaagcaaugcagccuugggcgcuaucuuuacugacgagaacaaguggaaaucagcgagggaagccguugaggauucccgcuucugggaacuggucgaccgugagcggaaucuccaucuugagggcaagugcgaaacauguguguacaacaugauggggaaaagagagaagaagcugggagaauuugguaaagcaaagggcucuagggcuauaugguauaugugguuaggggcccgcuuccuggaguuugaagcauugggauuccucaaugaggaucacugguuuagccgaggcaacagucuguccgguguggagggggaaggacuacauaaacuuggcuacauccugcgggacgucagcaagaaagagggcggggccauguacgcugaugacaccgccggaugggacacaagaauuacucucgaagaucugaagaaugaggaaaugguuaccaaccacaugaagggugagcauaaaaaguuggcggaggcaaucuucaaacugacguaucaaaauaaggugguaagggugcagcgcccaaccccuagaggcacagucauggacauuaucucucggaaagaucagagggggucaggacaggugggcacuuacggucucaacaccuucacaaauauggaagcccaacuuauucgucagauggagggggaaggaauauuuaagaguauccagcgacugacuguuaccgaggagauugcugugcaaaacugguuagcccgcgucggcagagaacggcuguccaggauggcaaucagcggcgacgauugcgugguaaagcccuuggacgaucgcuucgcuucugcccucacggcucugaaugacauggggaaaguuagaaaggauauccagcagugggagccaucgcggggauggaacgacuggacacaggugcccuuuugcucacaccacuuccaugaacuagucaugaaagaugguagggugcuuguggucccuugucgaaaccaagacgagcugauuggccgugccagaauaagccagggggcaggauggucccucaaggaaaccgcgugccugggcaaaaguuaugcccagauguggacuuugauguacuuucaccgccgggauuuaaggcuggcugccaaugcaaucuguucugcuguuccaagccauugggugccgacauccagaaccacuuggucaauucacgccaagcacgaguggaugaccacagaggacaugcucgcaguauggaaccgcguguggauccaggaaaaucccuggauggaggacaagacgccugucgaaaguugggaggaagugccauaucuugguaaacgggaggaucaauggugcgggucucugauuggacuaaccagcagggccacuugggcgaagaacauccagacagcuauaaaucagguucgaucccugaucggcaacgaggaauacaccgacuauaugcccucaaugaaaagauuccggaaggaggaagaggaagccggcgugcucugguga

SEQ ID NO: 14703 - RNA, 9876 nt, Artificial Sequence
  derived and/or modified CDS sequence (opt3) from DENV-2__EU687240__SS-prME
accgugggcgucaucauuaugcugauacccacagccauggcuuuccaccucacuacgagaaacggggagccucauaugaucguuggaaggcaggaaaaggguaaaagccuucuguuuaagaccgaggacggcgugaauaugugcacauugauggcaauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcccuggucccccauguggguauggggcuugagaccagaacagaaacuuggaugaguagcgagggagcguggaaacacguucagaggaucgagaccuggauacugcggcauccuggcuucacaaucauggcugccauuuuggcauacaccaucggcacgacucacuuucagcgcgcccucauuuucauccugcugacagcuguggcaccauccaugaccaugagaugcauagggauuucuaacagggauuuugucgaaggagugucggguggcucauggguagacaucguucucgagcacgggagcugugugacuacaauggccaagaauaagcccaccuuagauuucgaacugauuaaaacggaggcuaagcagccugccacccuucggaaauauugcaucgaagcgaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggauugugaccugcgcaauguuuacaugcaaaaagaauauggaaggaaaagugguccucccugagaaccuggaauacaccauaguuaucacuccacacagcggugaggagcaugccgugggcaaugacacggggaagcacggaaaagaaauuaagaucacaccgcaguccucaauaaccgaggcugaacuuacuggcuaugguaccguaacaauggaguguagucccaggaccgggcuggauuucaacgaaaugguguugcuccagauggaggacaaagccuggcugguccaccggcaaugguuuuuagaucugccucucccauggcuucccggcgcagacacucagggaagcaauuggauucagaaggagacacuggugacguucaagaacccucaugcuaaaaagcaggacguuguggucuugggcucucaagaaggggccaugcacaccgcgcuaacuggagccacagagauccagauguccucagguaaucugcucuuuaccggccaucugaaaugccgucuucgcauggauaagcugcaguugaaagggaugagcuacaguauguguacaggaaaguucaagaucgugaaagaaauugcagagacucaacacggcaccaucguaauuagaguucaguaugagggugacgggucuccaugcaagauacccuucgaaaucauggaucucgagaaaaggcaugugcugggccgguuaauuacggucaacccgaucgugaccgaaaaggacuccccugucaacaucgaggcugaacccccauuuggagauagcuacauuauaaucggcguggagccugggcagcugaaacuaaauugguucaagaagggaucgucuauuggucagauguuugagacaacuaugcgaggcgccaaacgcauggcuauccucggggacaccgccugggauuucggaucccugggcgguguuuuuacaucaauugggaaggcacuucaccaaguguucggcgccaucuacggagcugcguuuaguggcguaagcuggacuaugaaaauauugaucggggucauuaucaccuggauuggaaugaacuccagaucuacgagccugucagugagucucguucuggugggcgucgugacacuuuaucuggguguaauggugcaggcagacuccggguguguugucagcuggaagaauaaagaauugaagugcggaucuggcaucuucauaaccgauaacgugcacacuuggacagagcaguacaaguuucagcccgaaucaccaaguaaacucgccagcgcuauucaaaaggcccaugaggaagguaucuguggcauuagguccgugacccggcuggagaauuuaauguggaaacagaucacucccgagcugaaccacauacuaucugaaaaugaggcaaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagaucaaaucuugccacuggccuaagucccauacguuguggaguaauggaguacucgaaagcgagaugauuaucccaaaaaacuucgccggccccgucucucagcacaacuaccgaccugguuaucauacacagaccgcaggcccauggcaccuggggaagcuagaaauggauuuugacuucugugagggaacuaccgugguugugacagaagauugcggcaauagagggcccucccugaggacuaccacagcuucaggaaaacucauuacggaguggugcugucgcaguugcacccugccgccucuucgguacagaggcgaggacgguuguugguacgggauggaaauaaggccauugaaggagaaggaagagaaccuggucaauagcuuagugacugccggacauggccaaaucgauaacuuuucgcucgguguucugggcauggcgcuuuuccuggaagagauguugcgcacacgaguggggaccaaacacgccauucuccugguagcugucuccuuugugacucuaaucacaggaaauaugucuuuccgggaccugggccgugugauggucaugguuggggcaaccaugacggaugacauuggaaugggcgugacuuaucucgcccugcuugcugccuuuaagguaagacccaccuucgcagcggguuugcuguuaaggaaacucacaagcaaggagcugaugauggccaccaucgggauagcucuucugucacagaguacuaucccugaaacaauucuagagcucaccgaugcccuggcauugggaaugauggugcugaaaaucguccgcaacauggaaaaguaccaguuagcugugacaauuauggccaucuccugcguucccaaugcagugauacuccaaaacgccuggaaggucucuuguacuauucuggcugcggugagcguuuccccacuucuguugaccucaagccagcagaaagccgacuggaucccucucgcacugacgaucaagggccuaaaucccacagcuauuuuucugaccacucuuagucggaccucuaaaaagagauccuggccacucaacgaggccgugauggccgucggcaugguaagcauacuggcuucgucauugcugaaaaaugacaucccgaugacagggccuuuaguggcaggaggucuccugacuguuugcuaugugcuuaccggcaggucugccgaucuggaauuggagcgagcggcugacgucaagugggaggaucaggccgaaauuaguggguccagccccauccucucuauuacgaucagcgaggacggauccaugucaauaaaaaacgaagaggaggaacacacacugaccauccuaauucgcacuggccugcuugugaucagugguguauucccagugagcauucccaucacagcagccgcuugguaccucugggaggucaagaagcaacgggcagggguucugugggaugugccuucuccacccccugugggaaaagccgaauuggaggacggcgcguauagaauaaagcagaggggcauuuuuggguacucccagaucggagcuggugucuauaaagaaggcaccuuccauacuauguggcacgugacacguggggccguuuuaaugcaucgcggaaagcggaucgagccgucaugggcagauguaaaaaaggaccugauuaguuacggcgguggguggaagcucgagggagaauggaaagagggcgaagaggugcagguccuggcccuugaaccaggcaagaaucccagagcugugcaaaccaaaccugggcuguuuaagacgaacacuggaaccaucggugccguuagcuuggauuucuccccaggcacaucugggucgcccauaguggacaggaaaggaaaggucgugggccuauacgguaaugggguagucacccgaagcggagcauaugugucagcuauugcccagacagagaaguccaucgaggauaacccugaaauugaggacgauaucuuccggaaaaagcgccugacuauaauggaccuccacccgggcgcgggcaaaaccaagagauaccugcccgccauuguuagggaagcaaucaaacgggggcuucgaacguuaauccuggcuccaacaagaguggucgccgcugagauggaagaggcacuccgcggauugccuauuagguaucagacucccgccauccgugccgagcauaccggucgggaaauuguggaccugaugugucacgcuacauuuaccaugagacuccugaguccaguuagggugccuaacuacaaucuuauaaucauggaugaggcgcacuucacugaccccgcaucuauugccgcucgcggcuauaucagcacccgagucgaaaugggggaggccgcaggaaucuuuaugacagccacgccaccgggcuccagagauccuuucccccagucaaacgcuccaauuauggacgaggaacgggagauacccgaaaggucuuggaauagcggucaugagugggugacugauuuuaaggggaagaccguaugguucgugccuaguaucaaagcgggaaacgacauugccgcaugccugcgcaagaauggcaaaaagguuauccaauugucccguaaaacauuugauagcgaauacgucaagaccagagcuaacgacugggauuucguggugacuacagacauuucugagaugggcgccaauuuucgggcagagagggucaucgauccacgccgauguaugaagcccguaauacuaaccgacggggaagagagagugauccuggccggaccuaugccgguuacgcacucauccgcugcccagcggaggggucgcauuggcagaaacccaaaaaaugaaaacgaccaguauaucuacaugggggagccccucgaaaaugaugaggacugcgcgcauuggaaggaggcaaaaauguuacuggauaacauuaauacuccugaaggaaucauacccaguauguucgagccagaaagggagaagguggacgccauugauggcgaauaccggcuucguggugaggcucgcaaaacauuugucgaccugaugcgaagaggggaucucccugugugguuggccuauaggguugcugcagagggcaucaacuacgccgaccggcgcugguguuucgauggaauuaagaauaaccaaauccuggaagagaacguggaagucgagauauggaccaaagagggcgaaagaaagaagcucaaacccagguggcuggacgcucggaucuauagcgauccacuugcccuaaaggaguucaaagaauuugcagcggggcgaaagucgcugaccuugaauuuaauuacugagaugggaagacugccuacauucaugacccagaaagcccgcgacgcucucgauaaccuggccgugcuucacacagcagaaguagguggcagggcuuacaaucacgcccugucugagcucccggagacuuuggaaacgcugcuacugcucacccuucuggcaacagugacugggggaaucuuuuuauucuugauguccggcaaggguauugggaagaugacccugggcaugugcugcaucauaacagccagcauucuccugugguaugcucagauccagccccauuggaucgcggccucaauuauccuugaguuuuuccugauaguucucuugauuccagaaccugagaaacaacggaccccccaggacaaccagcugacuuacgucgugaucgcaauuuuaacgguggucgcugccaccauggccaaugaaaugggauuucuagagaagacaaaaaaggaccugggccucgggaguaucacuacccaggagucugaauccaacauacuugauaucgaccugcguccagcaagcgcuuggacauuguaugccguugcgaccacuuucgugacaccuaugcugagacacucaauugagaauaguagcguaaacgugucccucacggcuaucgccaaucaagcaaccguccugaugggacuugguaggggcuggccccucucuaaaauggauauuggggugccgcuguuggccaucggauguuacagccagguuaacccaauuacucugacagcugcauuacuacugcucguggcccauuacgcgaucauaggcccuggucuucaggcuaaggccacccgcgaagcacagaagcggaccgccgcugggauuaugaaaaaucccacagucgacggcaucacuguaaucgaucuggagccaauucccuaugacccuaaguuugaaaaacaauugggacaggugaugcugcucguucugugcgugacgcagguccuuaugaugcgaaccacaugggccuuaugugaggcacugacucucgcuaccggcccgauauccacauugugggaggggaaccccggaagauucuggaauaccacuaucgccgugucaauggcgaacauuuuuaggggcucuuaccuggccggugcagggcuacuguucaguaucaugaagaauacgacaaacacccgccggggaacuggcaauauuggugaaacccucggcgagaaauggaagucgagacuuaacgcucuggggaagagcgaauuucagaucuauaaaaaguccggaauacaagaggucgaucguacauuggccaaagagggcaucaagaggggggaaacugaccaccaugcagugucucggggaucagcuaaacugcgcugguucguugagcgaaacauggugaccccagaaggcaagguaguggaucucgguugcgggagaggaggcuggagcuacuauugugguggccugaaaaaugucagggagguuaagggguuaacaaagggaggcccugggcacgaagagcccauuccuauguccacguacggauggaaccuugugcggcugcagaguggcgucgacguguucuuuaccccacccgagaaaugcgauacucuccuaugugacaucggugaaucuagcccuaauccaacaauugaggccgggcgcacccugagaguauugaaccugguggaaaauuggcucaacaauaacacucaguucugcaucaagguucuuaaucccuauaugccgucagugauagagaaaauggaaacacugcaaaggaaguacggaggcgccuugguccgaaacccucugucccggaauaguacccacgagauguacugggugagcaacgcgacgggcaauauugucucuuccgugaacaugaucucacguaugcucaucaauagauuuaccaugaaacauaagaaggcuacauaugagccagauguugacuuagggagcggaacucgcaacauugguauagaaaacgagauccccaaucuggacauuaucggcaaaaggauugaaaagaucaaacaggagcacgaaaccucguggcauuacgaucaggaccacccuuauaagacaugggcauaccacgggucuuaugagacuaaacagaccggaagugccuccagcaugguaaacggcguggucaagcuucugacaaagccaugggaugugguucccauggugacccaaauggcuaugacugacacgacaccguucggucagcagcgggucuuuaaagagaagguggauaccagaacucaggaaccuaaagaggggaccaagaaacuaaugcgcauaacagccgaauggcucuggaaggagcugggaaagaaaaagacgcccaggauguguacccgagaggaauucacucggaaaguaagaucaaaugcagccuugggcgcuaucuuuacagacgagaacaaguggaaauccgcgagggaagccguggaggauucucgcuucugggaacugguugaccgugagcggaaucuccaucuugagggcaagugcgaaaccugugucuacaacaugauggggaaaagagagaagaagcugggagaauuugguaaagcaaagggcagcagggcuauuugguauaugugguuaggggcccgcuuccuggaguuugaagcauugggauuccucaaugaggaucacugguuuagucgaggcaacucccugagcgguguggagggggaaggacuacauaaacuuggcuacauccugcgggacgugucuaagaaagagggcggggccauguacgcugaugacacugccggaugggacacaagaauuacccucgaagaucugaagaaugaggaaauggucacaaaccacaugaagggugagcauaaaaaguuggcggaggcaaucuucaaacugacuuaucaaaauaagguugugaggguacagcgcccaaccccuagaggcacggugauggacauuauaucacggaaagaucagagggggaguggacaggucggcaccuacggucucaacacauucacuaauauggaagcccaacuuauccgucagauggagggggaaggaauuuuuaaguccauccagcgacugaccgugacagaggagaucgcuguucaaaacugguuagcccgcgugggcagagaacggcugagcaggauggcaauuucuggcgacgauugcgucgugaagcccuuggacgaucgcuucgcuucggcccucacugcucugaaugacauggggaaaguaagaaaggauauacagcagugggagccaucacggggauggaacgacuggacccagguucccuuuugcagccaccacuuccaugaacuagugaugaaagaugguaggguccuuguggugccuugucgaaaccaagacgagcugaucggccgugccagaauuucccagggggcaggauggagucucaaggaaacggcgugccugggcaaaucuuaugcccagauguggacauugauguacuuucaccgccgggauuuaaggcuggcugccaaugcaaucuguagcgcugucccaucccauuggguuccgaccucaagaacuacauggaguauucacgccaagcacgaguggaugaccacugaggacaugcucgcaguguggaaccgcguauggauccaggaaaaucccuggauggaggacaagaccccuguggaaucuugggaggaagucccauaucuugguaaacgggaggaucaauggugcgggagccugauaggacuaacauccagggccacgugggcgaagaacauccagaccgcuauuaaucaggugcgaucacugaucggcaacgaggaauacacugacuauaugcccagcaugaaaagauuccggaaggaggaagaggaagccggcguucucugguga

SEQ ID NO: 14704 - RNA, 9876 nt, Artificial Sequence
  derived and/or modified CDS sequence (opt3) from DENV-2__EU687241__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacuccaucggcaccacgcacuuucagcgcgcucucauuuucauccugcugacugcaguugccccaucuaugacaaugagaugcauagggauuucgaacagggauuuuguggaaggagucucagguggcagcuggguggacaucguacucgagcacgggaguuguguuaccacuauggcuaagaauaagcccacauuagauuucgaacugaccaaaacggaggccaagcagccugcgacccuucggaaauauugcauugaagcaaaguugacaaacacuaccacagagucccgcuguccaacucaaggagagcccucucugaaugaagagcaggacaaacgauuuaucugcaagcauagcaugguggauagaggcugggguaacggguguggacuauucggcaagggcgggaucgucaccugcgccauguuuacaugcaaaaagaauauggaaggaaaaguggugcucccugagaaccuggaauacaccauugucauaacuccacacuccggugaggagcaugcuguuggcaaugacacggggaagcacggaaaagaaaucaagauuacaccgcagucaaguaucaccgaggccgaacuuacuggcuaugguaccgugacaauggaguguagccccaggaccgggcuggauuucaacgaaaugguauugcuccagauggaggacaaagcauggcuggugcaccggcaaugguuuuuagaucugccucucccauggcuucccggcgcugacacucagggaucuaauuggauacagaaggagacacuggucacguucaagaacccucaugccaaaaagcaggacgugguuguguugggcucccaagaaggggcgaugcacaccgcccuaacuggagcaacagagauucagaugucaagcgguaaucugcucuuuaccggccaucugaaaugccgucuucgcauggauaagcugcaguugaaagggaugaguuacucuauguguacaggaaaguucaagaucgucaaagaaaucgcugagacucaacacggcaccauugugaucagaguacaguaugagggugacggguccccaugcaagauucccuucgaaauaauggaucucgagaaaaggcauguucugggccgguuaaucacggugaacccgauugucaccgaaaaggacagcccugugaacaucgaggccgaacccccauuuggagauucguacaucauuauaggcgucgagccugggcagcugaaacuaaauugguucaagaagggaucuuccaucggucagauguuugagacaacuaugcgaggcgcuaaacgcauggccauucucggggacaccgcaugggauuucggaucacugggcgguguguuuacaaguaucgggaaggcccuucaccaaguuuucggcgcuauuuacggagcggcauuuagcggcguguccuggacuaugaaaaucuugauagggguaaucauuaccuggaucggaaugaacucuagaagcacgucacugagugucucccucgugcugguuggcguggucacacuuuaucugggugugaugguacaggccgacaccgggugugugguuagcuggaagaauaaagaauugaagugcggaucuggcauuuucaucacugauaacguccacacauggaccgagcaguacaaguuucagcccgaaucaccaaguaaacucgcuagcgccauacaaaaggcacaugaggaagguauuuguggcaucagguccgugacucggcuggagaauuuaauguggaaacagauuacccccgagcugaaccacauccuaucugaaaaugaggugaagcucacaauaaugacgggggacaucaaaggaauuaugcaggccggcaagcgcucgcugagaccucagccaaccgaacuuaaauauagcuggaagacuugggggaaggcuaaaauguuguccacagagucacauaaccaaaccuuccugaucgauggaccggaaacagccgagugccccaauacuaacagggcauggaauagucucgaggucgaagacuacggcuuugguguuuucucuaccaacauuuggcugaaguuacgugagaaacaggacguguuuugugauagcaagcugauguccgcggcuaucaaagacaaucgggccgugcacgcagauaugggguauuggauagaaucagcccuuaacgacacguggaagauggagaaggcuagcuucauugagaucaaaucuugccacuggccuaagucccauacauuguggaguaauggaguacucgaaagcgagaugaucauuccaaaaaacuucgccggccccgucucucagcacaacuaccgaccugguuaucauacccagacugcaggcccauggcaccuggggaagcuagaaauggauuuugacuucugugagggaaccacagugguugugacugaagauugcggcaauagagggcccucccugaggaccacaacggcuucaggaaaacucaucaccgaguggugcugucgcaguugcacucugccgccucuucgguacagaggcgaggacgguuguugguacgggauggaaauuaggccauugaaggagaaggaagagaaccuggucaauagcuuagugacagccggacauggccaaauagauaacuuuucgcucgguguucugggcauggcgcuuuuccuggaagagauguugcgcacccgaguggggacuaaacacgccauccuccugguagcugucuccuuugugacacuaauuaccggaaauaugucuuuccgggaccugggccgugugauggucaugguuggggcaacgaugacugaugacaucggaaugggcgugaccuaucucgcccugcuugcugccuuuaagguaagacccacauucgcagcggguuugcuguuaaggaaacucaccagcaaggagcugaugauggccacuauugggaucgcucuucugucacagaguacaauaccugaaaccauccuagagcucacagaugcccuggcauugggaaugauggugcugaaaauuguccgcacuauggaaaaguaccaguuagcugugaccaucauggccauuuccugcguucccaacgcagugauccuccaaaaugccuggaaggucucuuguacgauacuggcugcggugagcguuuccccacuucuguugacaucaagccagcagaaagccgacuggauuccucucgcacugaccaucaagggccuaaaccccacugcuaucuuucugaccacacuuagucggacuucuaaaaagagauccuggccacucaaugaggccgugauggccgucggcaugguaagcauucuggcuucgucauugcugaaaaacgacauaccgaugaccgggccuuuaguggcaggaggucuccugacgguuugcuaugugcuuacaggcaggucugccgaucuggaauuggagcgagcggcugacgucaagugggaggaucaggccgaaaucaguggguccagccccauucucucuaucaccauuagcgaggacggauccaugucaaucaaaaaugaagaggaggaacacacucugacaauacuaauccgcaccggccugcuugugauuagugguguauucccagugagcauccccauuacugcagccgcuugguaccucugggaggucaagaagcaacgggcagggguucugugggaugugccuucuccacccccugugggaaaagccgaauuggaggacggcgcguauagaaucaagcagaggggcauauuuggguacucccagauuggagcuggugucuauaaagaaggcacauuccauaccauguggcacgugacgcguggggccguuuuaaugcaucgcggaaagcggaucgagccgucaugggcagauguaaaaaaggaccugaucaguuacggcgguggguggaagcucgagggagaauggaaagagggcgaagaggugcagguccuggcccuugaaccaggcaagaaccccagagcugugcaaacuaaaccugggcuguuuaagaccaauacaggaaccauuggugccguuagcuuggauuucuccccaggcacaucugggucgcccaucguggacaggaaaggaaaggucgugggccuauacgguaacgggguagucacucgaagcggagcauaugugucagcuauagcccagaccgagaaguccauugaggauaauccugaaaucgaggacgauauuuuccggaaaaagcgccugacgaucauggaccuccacccgggcgcgggcaaaacaaagagauaccugcccgccauaguuagggaagcaauuaaacgggggcuucgaacuuuaauccuggcuccaaccagaguggucgccgcugagauggaagaggcacuccgcggauugccuaucagguaucagacacccgccauucgugccgagcauaccggucgggaaaucguggaccugaugugucacgcuacuuuuaccaugagacuccugaguccaguuagggugccuaacuacaaccuuauuauaauggaugaggcgcacuucacagaccccgcaucuaucgccgcucgcggcuauauuagcacgcgagucgaaaugggggaggccgcaggaaucuuuaugacugccaccccaccgggcuccagagauccuuucccccagucaaaugcuccaaucauggacgaggaacgggagauucccgaaaggucuuggaacagcggucaugagugggugacagauuuuaaggggaagaccguaugguucgugccuaguauaaaagcgggaaaugacaucgccgcaugccugcgcaagaacggcaaaaagguuauucaauugucccguaaaacuuuugauagcgaauacgucaagacaagagcuaaugacugggauuucguggugaccacggacaucucugagaugggcgccaacuuucgggcagagagggucauugauccacgccgauguaugaagcccguaauccuaacugacggggaagagagagugauacuggccggaccuaugccgguuacacacucauccgcugcccagcggaggggucgcaucggcagaaauccaaaaaacgaaaaugaccaguauauuuacaugggggagccccucgaaaacgaugaggacugcgcgcauuggaaggaggcaaaaauguuacuggauaauaucaacaccccugaaggaauuauccccaguauguucgagccagaaagggagaagguggacgccauagauggcgaauaccggcuucguggugaggcucgcaaaaccuuugucgaccugaugcgaagaggggaucucccugugugguuggccuauaggguugcugcagagggcauuaauuacgccgaccggcgcugguguuucgauggaaucaagaacaaucaaauucuggaagagaacguggaagucgagaucuggacuaaagagggcgaaagaaagaagcucaaacccagguggcuggacgcucggauauauagcgauccacuugcccuaaaggaguucaaagaauuugcagcggggcgaaagucgcugacauugaacuuaaucaccgagaugggaagacugccuacauucaugacucagaaagcccgcgacgcucucgauaaucuggccgugcuucacacggcagaaguagguggcagggcuuacaaccacgcccugucugagcucccggagaccuuggaaacacugcuacugcucacucuucuggcaaccgugacagggggaauuuuuuuauucuugauguccggcaaggguaucgggaagaugacccugggcaugugcugcauuaucacugccagcauacuccugugguaugcucagauucagccccauuggaucgcggccucaaucauucuugaguuuuuccugaucguucucuugauaccagaaccugagaaacaacggacgccccaggacaaucagcugaccuacgucgugauugcaaucuuaacaguggucgcugccacuauggccaacgaaaugggauuucuagagaagaccaaaaaggaccugggccucgggaguauuacaacccaggagucugaauccaauauccuugauauagaccugcguccagcaagcgcuuggacuuuguaugccguugcgacaacguucgugaccccuaugcugagacacucaaucgagaacaguagcguaaaugugucccucacugcuauugccaaccaagcaacaguccugaugggacuugguaggggcuggccccucucuaaaauggauaucggggugccgcuguuggccauuggauguuacagccagguuaauccaaucacccugaccgcugcauuacuacugcucguggcccauuacgcgauuaucggcccuggucuucaggcuaaggccacacgcgaagcacagaagcggacugccgcugggauaaugaaaaaccccacggucgacggcauuaccguaaucgaucuggagccaauccccuaugacccuaaguuugaaaaacaauugggacaggugaugcugcucguucugugcgugacacagguccuuaugaugcgaacuaccugggccuuaugugaggcacugacacucgcuaccggcccgauuuccacuuugugggaggggaaucccggaagauucuggaacacgacaauagccgugucaauggcgaauaucuuuaggggcucuuaccuggccggugcagggcuacuguucaguauuaugaagaacaccacuaauacccgccggggaacaggcaacaucggugaaacucucggcgagaaauggaagucgagacuuaaugcucuggggaagagcgaauuucagauuuauaaaaaguccggaauccaagaggucgaucguaccuuggccaaagagggcauaaagaggggggaaacagaccaccaugcagugucucggggaucagcuaaacugcgcugguucguugagcgaaacauggugacgccagaaggcaagguaguggaucucgguugcgggagaggaggcuggagcuacuauugugguggccugaaaaacgucagggagguuaagggguuaaccaagggaggcccugggcacgaagagcccaucccuauguccacuuacggauggaaucuugugcggcugcagaguggcgucgacguguucuuuacaccacccgagaaaugcgauacccuccuaugugacauuggugaaucuagcccuaacccaacuaucgaggccgggcgcacacugagaguauugaaucugguggaaaacuggcucaauaacaauacccaguucugcguuaaggugcuuaaccccuauaugccgucagucauugagaaaauggaaacgcugcaaaggaaguacggaggcgccuuggugcgaaauccucugucccggaacaguacccacgagauguacugggucagcaaugcgacaggcaacaucgugucuuccguuaauaugauaucacguaugcucauuaacagauuuacuaugaaacauaagaaggcuaccuaugagccagauguagacuuagggagcggaacacgcaauaucgguaucgaaaacgagauucccaaccuggacauaaucggcaaaaggauugaaaagaucaaacaggagcacgaaacuucguggcauuacgaucaggaccacccuuauaagaccugggcauaccacgggucuuaugagacaaaacagaccggaagugccuccagcauggugaauggcgucgugaagcuucugacuaagccaugggauguugugcccauggucacgcaaauggcuaugacagacaccacuccguucggucagcagcggguguuuaaagagaagguagauaccagaacacaggaaccuaaagaggggacgaagaaacuaaugcgcauuaccgccgaauggcucuggaaggagcugggaaagaaaaagacucccaggauguguacacgagaggaauucacccggaaagugagaucaaacgcagccuugggcgcuaucuuuacugacgagaauaaguggaaauccgcgagggaagccguugaggauucucgcuucugggaacuggucgaccgugagcggaaccuccaucuugagggcaagugcgaaacauguguguacaauaugauggggaaaagagagaagaagcugggagaauuugguaaagcaaagggcagcagggcuauaugguauaugugguuaggggcccgcuuccuggaguuugaagcauugggauuccucaacgaggaucacugguuuagucgaggcaauucccugagcgguguggagggggaaggacuacauaaacuuggcuacauccugcgggacgucucuaagaaagagggcggggccauguacgcugaugacaccgccggaugggacacaagaauuacucucgaagaucugaagaacgaggaaaugguuaccaaucacaugaagggugagcauaaaaaguuggcggaggcaaucuucaaacugacguaucaaaacaaggugguaagggugcagcgcccaaccccuagaggcacagucauggacauuaucucacggaaagaucagagggggaguggacaggugguuacuuacggccucaauaccuucacaaacauggaagcccaacuuauucgucagauggagggugaagggauauuuaaguccauccagcgacugacugugaccgaggagauugcuguccaaaauugguuagcccgcgugggaagagaacggcugagcaggauggcaaucucuggcgacgauugcguaguuaagcccuuggacgaucgcuucgcuucggcccucacggcucugaacgacaugggcaaagugagaaaggauauccagcagugggagccaucacggggguggaaugacuggacacagguccccuuuugcagccaccacuuccaugaacuagugaugaaagauggaagggugcuugucguuccuugucgaaaccaagacgagcugauuggucgugccagaauaucccagggcgcaggguggagucucaaggaaaccgcgugccugggaaaaucuuaugcccagauguggacuuugauguacuuucaccgccgggauuuaaggcuggcugccaacgcaaucuguagcgcugugccaucccauuggguaccgacaucaagaaccacuuggaguauucacgccaagcacgaguggaugaccacagaggacaugcucgcaguguggaaucgcgucuggauccaggaaaaccccuggauggaggacaagacgccuguggaaucuugggaggaaguuccauaucuuggcaaacgggaggaucaauggugcgguagccugauugggcuaaccuccagggccacuugggcgaagaauauccagacagcuauaaaccaggugcgaucacugaucggaaaugaggaauacaccgacuauaugcccagcaugaaaagauuccggaaggaggaagaggaagccggcguccucugguga

SEQ ID NO: 14705 - RNA, 9876 nt, Artificial Sequence
  derived and/or modified CDS sequence (opt3) from DENV-2__EU687242__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauucgcggaaucaugcaggccggcaaaagaucucugaggccucagccaaccgaacuuaaguauucguggaaaacuugggggaaggcuaagauguugagcacagagucccauaaccaaaccuuccugauugauggaccggaaacagccgagugccccaauacuaaccgugcauggaauucacucgaggucgaagacuacggcuuugguguuuucaguaccaacaucuggcugaaauuacgggagaagcaggacguguuuugugauucuaaacugaugagcgcggcuauaaaggacaaucgagccgugcacgcagauaugggguauuggauugaauccgcccuuaacgacacguggaaaauggagaaggcuucauucaucgagaucaagagcugcuacuggccuaaaucucacacauugugguccaauggaguacucgaaagugagaugauuaucccaaagaacuucgccggccccgucagccagcauaacuauagaccugguuaccacacccagacugcaggcccauggcaucuggggaaacuagaaauggauuuugacuucugugagggaaccacagugguugugacugaagauugcggcaauagggggcccucucugcgcaccacaacggcuuccggaaagcucauuaccgaguggugcugucggucaugcacucugccgccucuuagauacaggggcgaggacgguuguugguaugggauggaaauacgcccauugaaagagaaggaagagaaccuggucaauaguuuagugacagccggacacggccaaaucgauaacuuuagccucgguguucugggcauggcgcuuuuccuggaagagauguugcgaacccggguggggacuaagcaugccauucuccugguagcugucucguuugugacacuaaucaccggaaauauguccuuccgugaccugggcagagugauggucaugguuggggcaacgaugacugaugacauuggaaugggcgugaccuaccucgcccugcuugcugccuuuaaaguaaggcccacauucgcagcggguuugcuguuacgcaagcucaccucuaaagagcugaugauggccacuaucgggauagcucuucugagccagucaacaaucccugaaaccauucuagagcucacagaugcccuggcauugggaaugauggugcugaagaucguccggaacauggaaaaauaucaguuagcugugacuauuauggccaucaguugcguucccaaugcagugauacuccaaaacgccuggaaggucuccuguaccauucuggcugcggugucuguuagcccacuucuguugacguccucacagcagaaggccgacuggaucccucucgcacugacaaucaaaggccuaaaucccaccgcuauuuuucugacuacccuuagcagaacaaguaagaaaaggucuuggccacucaacgaggccgugauggccgucggcaugguauccauacuggcuagcucguugcugaagaaugacaucccgaugacugggccuuuaguggcaggaggucuccugaccguuugcuacgugcuuacgggccgaucagccgaucuggaauuggagcgcgcggcugacgucaaaugggaggaucaggccgaaauuucugggaguucccccauccucagcauuacaaucucugaggacggaagcauguccauaaagaacgaagaggaggaacacacccugacuauccuaauucggacaggccugcuugugaucucagguguauucccagugaguauucccaucaccgcagccgcuugguaucucugggaggucaaaaagcaaagagcagggguucugugggaugugccuagcccacccccugugggaaaggccgaauuggaggacggcgcguacaggauaaaacagcguggcauuuuuggguauucucagaucggagcuggugucuacaaggaaggcacuuuccacacaauguggcaugugacccgcggggccguuuuaaugcaccggggaaaaagaaucgagccguccugggcagauguaaagaaagaccugauuucauacggcgguggguggaagcucgagggagaauggaaggagggcgaagaggugcagguccuggcccuugaaccaggcaaaaaucccagggcugugcaaacgaagccugggcuguuuaaaacuaacaccggaacaaucggugccguuaguuuggauuucagcccaggcaccuccgggucucccauaguggaccgaaagggaaaagucgugggccuauaugguaaugggguagucacacggucgggagcauacgugagcgcuauugcccagacugagaagucaaucgaggauaacccugaaauugaggacgauaucuuccgcaagaaaagacugaccauaauggaccuccauccgggcgcgggcaagacgaaaagguaucugcccgccauuguucgggaagcaaucaagcgagggcuuagaacauuaauccuggcuccaacucgcguggucgccgcugagauggaagaggcacucaggggauugccuauucguuaccagacccccgccauccgggccgagcacacagguagagaaauuguggaccugaugugucaugcuaccuuuacuaugaggcuccuguccccaguucgcgugccuaacuauaaucuuauaaucauggaugaggcgcacuucaccgaccccgcaaguauugccgcucgaggcuacaucucuacaagagucgaaaugggggaggccgcaggaaucuuuaugacggccacuccaccgggcagccgggauccuuucccccaguccaacgcuccaauuauggacgaggaaagggagauacccgaacgcucauggaauucuggucacgagugggugaccgauuuuaaagggaagacaguaugguucgugccuagcaucaaggcgggaaacgacauugccgcaugccugcguaaaaauggcaagaaaguuauccaauugaguagaaagaccuuugauuccgaauaugucaaaacucgggcuaacgacugggauuucguggugacaaccgacauuagcgagaugggcgccaauuuuagggcagagcgcgucaucgauccacgaagauguaugaagcccguaauacuaacggacggggaagagcgggugauccuggccggaccuaugccgguuacucauucuucagcugcccagaggcgcgguagaauuggcaggaacccaaagaaugaaaacgaccaguacaucuacaugggggagccccucgaaaaugaugaggacugcgcgcacuggaaagaggcaaagauguuacuggauaacauuaauacaccugaaggaaucauacccuccauguucgagccagaacgggagaaaguggacgccauugauggcgaauaucgucuucgcggugaggcucgaaagaccuuugucgaccugaugagaaggggggaucucccugugugguuggccuaccggguugcugcagagggcaucaacuaugccgaccgcagaugguguuucgauggaauuaaaaauaaccaaauccuggaagagaacguggaagucgagauauggaccaaggagggcgaaaggaaaaagcucaagccccgguggcuggacgcucgaaucuacagugauccacuugcccuaaaagaguucaaggaauuugcagcggggagaaaaagccugacuuugaauuuaauuacagagaugggacgccugccuaccuucaugacacagaaggccagggacgcucucgauaaccuggccgugcuucauacugcagaaguagguggccgggcuuauaaucacgcccugaacgagcucccggagacguuggaaacccugcuacugcucacacuucuggcaacugugaccgggggaaucuuuuuauucuugaugucgggcaaagguauugggaagaugacacugggcaugugcugcaucauaaccgccucuauucuccugugguacgcucagauccagccccacuggaucgcggccuccauuauccuugaguuuuuccugauaguucucuugauuccagaaccugagaagcaacguacuccccaggacaaucagcugacguaugucgugaucgcaauuuuaaccguggucgcugccacaauggccaacgaaaugggauuucuagagaaaacuaagaaagaccugggccucgggagcaucaccacacaggagucagaaaguaauauacuugauaucgaccugagaccagcaucugcuuggaccuuguacgccguugcgacuacauucgugacgccuaugcugaggcauuccauugagaacagcucaguaaaugugagucucaccgcuaucgccaaccaagcaacuguccugaugggacuuggucgcggcuggccccucagcaagauggauauuggggugccgcuguuggccaucggauguuacucccagguuaauccaauuacacugaccgcugcauuacuacugcucguggcccacuaugcgaucauaggcccuggucuucaggcuaaagccacccgggaagcacagaagcgaacagccgcugggauuaugaagaaccccacugucgacggcaucacgguaaucgaucuggagccaauucccuacgacccuaaauuugaaaagcaauugggacaggugaugcugcucguucugugcgugacccagguccuuaugaugagaacaacuugggccuuaugugaggcacugacccucgcuacaggcccgauaucuaccuugugggaggggaaucccggaagguucuggaacacuacgaucgccgugagcauggcgaauauuuuucgcggcuccuaucuggccggugcagggcuacuguucucaaucaugaaaaacacaaccaauacucggagaggaaccggcaacauuggugaaacacucggcgagaaguggaaaucucgucuuaacgcucuggggaagagugaauuucagaucuacaagaaaucgggaauacaagaggucgauaggacuuuggccaaggagggcaucaaacggggggaaaccgaccaucacgcagugagccgcggauccgcuaagcugcgaugguucguugagagaaauauggugacaccagaaggcaaaguaguggaucucgguugcgggaggggaggcuggucuuauuacugugguggccugaagaacguccgggagguuaaaggguuaacgaagggaggcccugggcaugaagagcccauuccuaugucaaccuauggauggaaucuugugcgccugcagagcggcgucgacguguucuuuacuccacccgagaagugcgauacacuccuaugugacaucggugaauccaguccuaacccaaccauugaggccgggagaacucugaggguauugaaucugguggaaaacuggcucaauaacaauacacaguucugcguuaaagugcuuaaccccuacaugccgucugucaucgagaagauggaaacccugcaacgaaaauacggaggcgccuuggugcggaauccucugagccguaacucaacgcacgagauguauugggucuccaaugcgaccggcaacauagugaguagcguuaauaugauuucuagaaugcucaucaaccgcuuuacaaugaagcacaaaaaggcuacuuacgagccagauguagacuuaggguccggaaccaggaacaucgguauugaaaaugagauacccaaccuggacaucauuggcaagcggaucgaaaaaauuaagcaggagcaugaaacaucauggcacuaugaucaggaccauccuuacaaaacuugggcauaucacgggagcuacgagaccaagcagacaggaucggccucuaguauggugaauggcgucgugaaacuucugaccaagccaugggauguugugcccauggucacucaaauggcuaugacggacacaaccccguucggucagcagagaguguuuaaggagaaaguagauacucgcacccaggaaccuaaggaggggacaaaaaagcuaaugaggaucacggccgaauggcucuggaaagagcugggaaagaagaaaaccccccgaauguguacucgggaggaauucacaagaaaggugagguccaacgcagccuugggcgcuauauuuaccgacgagaauaaauggaagagcgcgcgcgaagccguugaggauucacguuucugggaacuggucgaccgggagagaaaccuccaccuugagggcaaaugcgaaacuuguguguauaauaugauggggaagagggagaaaaagcugggagaauuugguaaggcaaaaggcucccgcgcuaucugguacaugugguuaggggcccgauuccuggaguuugaagcauugggauuccucaacgaggaucauugguuuucucggggcaauagccugagugguguggagggggaaggacuacacaagcuuggcuacauucugagagacgucuccaaaaaggagggcggggccauguaugcugaugacacagccggaugggacaccaggaucacacucgaagaucugaaaaacgaggaaaugguuacuaaucauaugaagggugagcacaagaaauuggcggaggcaauuuucaagcugaccuaccaaaacaaagugguacgcgugcagagaccaacgccucggggcaccgucauggacaucauuagcaggaaggaucagcgugggucuggacaggugggcacauauggucucaauacuuucaccaacauggaagcccaacuuauacgacagauggagggggaaggaaucuuuaaaucaauucagcgccugacaguuacugaggagaucgcugugcaaaauugguuagccagagucggccgggaaaggcugagucgcauggcaaucuccggcgacgauugcgugguaaagcccuuggacgauagauucgcuagcgcccucaccgcucugaacgacauggggaagguucggaaagauauucagcagugggagccaucuaggggauggaacgacuggacgcaggugcccuuuugcucgcaucacuuccacgaacuagucaugaaggauggucgagugcuuguggucccuugucguaaucaagacgagcugauaggcagagcccgcaucucacagggggcaggauggagccucaaagaaacagcgugccugggcaaguccuacgcccagauguggaccuugauguauuuucaucggagggauuuaagacuggcugccaacgcaauuuguagugcuguuccaucucacugggugccgacuagccgcacaaccugguccauccaugccaaacacgaguggaugacuaccgaggacaugcucgcaguauggaaucggguguggauucaggaaaaccccuggauggaggacaagacaccugucgaaucaugggaggaagugccauaccuugguaagagggaggaucaauggugcgggagucugaucggacuaacgucucgagccaccugggcgaaaaauauacagacugcuaucaaccagguuagaagccugauuggcaaugaggaauauacagacuacaugcccuccaugaagcgguucaggaaagaggaagaggaagccggcgugcucugguga

SEQ ID NO: 14706 - RNA, 9876 nt, Artificial Sequence
  derived and/or modified CDS sequence (opt3) from DENV-2__EU687243__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauucgcggaaucaugcaggccggcaaaagaucucugaggccucagccaaccgaacuuaaguauucguggaaaacuugggggaaggcuaagauguugagcacagagucccauaaccaaaccuuccugauugauggaccggaaacagccgagugccccaauacuaaccgugcauggaauucacucgaggucgaagacuacggcuuugguguuuucaguaccaacaucuggcugaaauuacgggagaagcaggacguguuuugugauucuaaacugaugagcgcggcuauaaaggacaaucgagccgugcacgcagauaugggguauuggauugaauccgcccuuaacgacacguggaaaauggagaaggcuucauucaucgagaucaagagcugccacuggccuaaaucucauacauugugguccaauggaguacucgaaagugagaugauuaucccaaagaacuucgccggccccgucagccagcacaacuacagaccugguuaucauacccagacugcaggcccauggcaccuggggaaacuagaaauggauuuugacuucugugagggaaccacagugguugugacugaagauugcggcaauagggggcccucucugcgcaccacaacggcuuccggaaagcucauuaccgaguggugcugucggucaugcacucugccgccucuuagauacaggggcgaggacgguuguugguacgggauggaaauacgcccauugaaagagaaggaagagaaccuggucaauaguuuagugacagccggacauggccaaaucgauaacuuuagccucgguguucugggcauggcgcuuuuccuggaagagauguugcgaacccggguggggacuaagcacgccauucuccugguagcugucucguuugugacacuaaucaccggaaauauguccuuccgugaccugggcagagugauggucaugguuggggcaacgaugacugaugacauuggaaugggcgugaccuaucucgcccugcuugcugccuuuaaaguaaggcccacauucgcagcggguuugcuguuacgcaagcucaccucuaaagagcugaugauggccacuaucgggauagcucuucugagccagucaacaaucccugaaaccauucuagagcucacagaugcccuggcauugggaaugauggugcugaagaucguccggaacauggaaaaauaccaguuagcugugacuauuauggccaucaguugcguucccaaugcagugauacuccaaaacgccuggaaggucuccuguaccauucuggcugcggugucuguuagcccacuucuguugacguccucacagcagaaggccgacuggaucccucucgcacugacaaucaaaggccuaaaucccaccgcuauuuuucugacuacccuuagcagaacaaguaagaaaaggucuuggccacucaacgaggccgugauggccgucggcaugguauccauacuggcuagcucguugcugaagaaugacaucccgaugacugggccuuuaguggcaggaggucuccugaccguuugcuaugugcuuacgggccgaucagccgaucuggaauuggagcgcgcggcugacgucaaaugggaggaucaggccgaaauuucugggaguucccccauccucagcauuacaaucucugaggacggaagcauguccauaaagaacgaagaggaggaacacacccugacuauccuaauucggacaggccugcuugugaucucagguguauucccagugaguauucccaucaccgcagccgcuugguaccucugggaggucaaaaagcaaagagcagggguucugugggaugugccuagcccacccccugugggaaaggccgaauuggaggacggcgcguauaggauaaaacagcguggcauuuuuggguacucucagaucggagcuggugucuauaaggaaggcacuuuccauacaauguggcacgugacccgcggggccguuuuaaugcaucggggaaaaagaaucgagccguccugggcagauguaaagaaagaccugauuucauacggcgguggguggaagcucgagggagaauggaaggagggcgaagaggugcagguccuggcccuugaaccaggcaaaaaucccagggcugugcaaacgaagccugggcuguuuaaaacuaacaccggaacaaucggugccguuaguuuggauuucagcccaggcaccuccgggucucccauaguggaccgaaagggaaaagucgugggccuauacgguaaugggguagucacacggucgggagcauaugugagcgcuauugcccagacugagaagucaaucgaggauaacccugaaauugaggacgauaucuuccgcaagaaaagacugaccauaauggaccuccacccgggcgcgggcaagacgaaaagguaccugcccgccauuguucgggaagcaaucaagcgagggcuuagaacauuaauccuggcuccaacucgcguggucgccgcugagauggaagaggcacucaggggauugccuauucguuaucagacccccgccauccgggccgagcauacagguagagaaauuguggaccugaugugucacgcuaccuuuacuaugaggcuccuguccccaguucgcgugccuaacuacaaucuuauaaucauggaugaggcgcacuucaccgaccccgcaaguauugccgcucgaggcuauaucucuacaagagucgaaaugggggaggccgcaggaaucuuuaugacggccacuccaccgggcagccgggauccuuucccccaguccaacgcuccaauuauggacgaggaaagggagauacccgaacgcucauggaauucuggucaugagugggugaccgauuuuaaagggaagacaguaugguucgugccuagcaucaaggcgggaaacgacauugccgcaugccugcguaaaaauggcaagaaaguuauccaauugaguagaaagaccuuugauuccgaauacgucaaaacucgggcuaacgacugggauuucguggugacaaccgacauuagcgagaugggcgccaauuuuagggcagagcgcgucaucgauccacgaagauguaugaagcccguaauacuaacggacggggaagagcgggugauccuggccggaccuaugccgguuacucacucuucagcugcccagaggcgcgguagaauuggcaggaacccaaagaaugaaaacgaccaguauaucuacaugggggagccccucgaaaaugaugaggacugcgcgcauuggaaagaggcaaagauguuacuggauaacauuaauacaccugaaggaaucauacccuccauguucgagccagaacgggagaaaguggacgccauugauggcgaauaccgucuucgcggugaggcucgaaagaccuuugucgaccugaugagaaggggggaucucccugugugguuggccuaucggguugcugcagagggcaucaacuacgccgaccgcagaugguguuucgauggaauuaaaaauaaccaaauccuggaagagaacguggaagucgagauauggaccaaggagggcgaaaggaaaaagcucaagccccgguggcuggacgcucgaaucuauagugauccacuugcccuaaaagaguucaaggaauuugcagcggggagaaaaagccugacuuugaauuuaauuacagagaugggacgccugccuaccuucaugacacagaaggccagggacgcucucgauaaccuggccgugcuucacacugcagaaguagguggccgggcuuacaaucacgcccugaacgagcucccggagacguuggaaacccugcuacugcucacacuucuggcaacugugaccgggggaaucuuuuuauucuugaugucgggcaaagguauugggaagaugacacugggcaugugcugcaucauaaccgccucuauucuccugugguaugcucagauccagccccauuggaucgcggccuccauuauccuugaguuuuuccugauaguucucuugauuccagaaccugagaagcaacguacuccccaggacaaucagcugacguacgucgugaucgcaauuuuaaccguggucgcugccacaauggccaacgaaaugggauuucuagagaaaacuaagaaagaccugggccucgggagcaucaccacacaggagucagaaaguaauauacuugauaucgaccugagaccagcaucugcuuggaccuuguaugccguugcgacuacauucgugacgccuaugcugaggcacuccauugagaacagcucaguaaaugugagucucaccgcuaucgccaaccaagcaacuguccugaugggacuuggucgcggcuggccccucagcaagauggauauuggggugccgcuguuggccaucggauguuacucccagguuaauccaauuacacugaccgcugcauuacuacugcucguggcccauuacgcgaucauaggcccuggucuucaggcuaaagccacccgggaagcacagaagcgaacagccgcugggauuaugaagaaccccacugucgacggcaucacgguaaucgaucuggagccaauucccuaugacccuaaauuugaaaagcaauugggacaggugaugcugcucguucugugcgugacccagguccuuaugaugagaacaacuugggccuuaugugaggcacugacccucgcuacaggcccgauaucuaccuugugggaggggaaucccggaagguucuggaacacuacgaucgccgugagcauggcgaauauuuuucgcggcuccuaccuggccggugcagggcuacuguucucaaucaugaaaaacacaaccaauacucggagaggaaccggcaacauuggugaaacacucggcgagaaguggaaaucucgucuuaacgcucuggggaagagugaauuucagaucuauaagaaaucgggaauacaagaggucgauaggacuuuggccaaggagggcaucaaacggggggaaaccgaccaccaugcagugagccgcggauccgcuaagcugcgaugguucguugagagaaauauggugacaccagaaggcaaaguaguggaucucgguugcgggaggggaggcuggucuuacuauugugguggccugaagaacguccgggagguuaaaggguuaacgaagggaggcccugggcacgaagagcccauuccuaugucaaccuacggauggaaucuugugcgccugcagagcggcgucgacguguucuuuacuccacccgagaagugcgauacacuccuaugugacaucggugaauccaguccuaacccaaccauugaggccgggagaacucugaggguauugaaucugguggaaaacuggcucaauaacaauacacaguucugcguuaaagugcuuaaccccuauaugccgucugucaucgagaagauggaaacccugcaacgaaaauacggaggcgccuuggugcggaauccucugagccguaacucaacgcacgagauguacugggucuccaaugcgaccggcaacauagugaguagcguuaauaugauuucuagaaugcucaucaaccgcuuuacaaugaagcauaaaaaggcuacuuaugagccagauguagacuuaggguccggaaccaggaacaucgguauugaaaaugagauacccaaccuggacaucauuggcaagcggaucgaaaaaauuaagcaggagcacgaaacaucauggcauuacgaucaggaccacccuuauaaaacuugggcauaccacgggagcuaugagaccaagcagacaggaucggccucuaguauggugaauggcgucgugaaacuucugaccaagccaugggauguugugcccauggucacucaaauggcuaugacggacacaaccccguucggucagcagagaguguuuaaggagaaaguagauacucgcacccaggaaccuaaggaggggacaaaaaagcuaaugaggaucacggccgaauggcucuggaaagagcugggaaagaagaaaaccccccgaauguguacucgggaggaauucacaagaaaggugagguccaacgcagccuugggcgcuauauuuaccgacgagaauaaauggaagagcgcgcgcgaagccguugaggauucacguuucugggaacuggucgaccgggagagaaaccuccaucuugagggcaaaugcgaaacuuguguguacaauaugauggggaagagggagaaaaagcugggagaauuugguaaggcaaaaggcucccgcgcuaucugguauaugugguuaggggcccgauuccuggaguuugaagcauugggauuccucaacgaggaucacugguuuucucggggcaauagccugagugguguggagggggaaggacuacauaagcuuggcuacauucugagagacgucuccaaaaaggagggcggggccauguacgcugaugacacagccggaugggacaccaggaucacacucgaagaucugaaaaacgaggaaaugguuacuaaucacaugaagggugagcauaagaaauuggcggaggcaauuuucaagcugaccuaucaaaacaaagugguacgcgugcagagaccaacgccucggggcaccgucauggacaucauuagcaggaaggaucagcgugggucuggacaggugggcacauacggucucaauacuuucaccaacauggaagcccaacuuauacgacagauggagggggaaggaaucuuuaaaucaauucagcgccugacaguuacugaggagaucgcugugcaaaauugguuagccagagucggccgggaaaggcugagucgcauggcaaucuccggcgacgauugcgugguaaagcccuuggacgauagauucgcuagcgcccucaccgcucugaacgacauggggaagguucggaaagauauucagcagugggagccaucuaggggauggaacgacuggacgcaggugcccuuuugcucgcaccacuuccaugaacuagucaugaaggauggucgagugcuuguggucccuugucguaaucaagacgagcugauaggcagagcccgcaucucacagggggcaggauggagccucaaagaaacagcgugccugggcaaguccuaugcccagauguggaccuugauguacuuucaccggagggauuuaagacuggcugccaacgcaauuuguagugcuguuccaucucauugggugccgacuagccgcacaaccugguccauccacgccaaacacgaguggaugacuaccgaggacaugcucgcaguauggaaucggguguggauucaggaaaaccccuggauggaggacaagacaccugucgaaucaugggaggaagugccauaucuugguaagagggaggaucaauggugcgggagucugaucggacuaacgucucgagccaccugggcgaaaaauauacagacugcuaucaaccagguuagaagccugauuggcaaugaggaauacacagacuauaugcccuccaugaagcgguucaggaaagaggaagaggaagccggcgugcucugguga

SEQ ID NO: 14707 - RNA, 9876 nt, Artificial Sequence
  derived and/or modified CDS sequence (opt3) from DENV-2__EU687245__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauuaaaggaaucaugcaggccggcaagcgcucucugagaccucagccaaccgaacuuaaauauucguggaagacuugggggaaggcuaaaauguugagcacagagucccauaaccaaaccuuccugauugauggaccggaaacagccgagugccccaauacuaacagggcauggaauucacucgaggucgaagacuacggcuuugguguuuucaguaccaacaucuggcugaaguuacgugagaaacaggacguguuuugugauucuaagcugaugagcgcggcuauaaaagacaaucgggccgugcacgcagauaugggguauuggauugaauccgcccuuaacgacacguggaagauggagaaggcuucauucaucgagaucaaaagcugccacuggccuaagucucauacauugugguccaauggaguacucgaaagugagaugauuaucccaaaaaacuucgccggccccgucagccagcacaacuaccgaccugguuaucauacccagacugcaggcccauggcaccuggggaagcuagaaauggauuuugacuucugugagggaaccacagugguugugacugaagauugcggcaauagagggcccucucugaggaccacaacggcuuccggaaaacucauuaccgaguggugcugucgcucaugcacucugccgccucuucgguacagaggcgaggacgguuguugguacgggauggaaauaaggccauugaaggagaaggaagagaaccuggucaauaguuuagugacagccggacauggccaaaucgauaacuuuagccucgguguucugggcauggcgcuuuuccuggaagagauguugcgcacccgaguggggacuaaacacgccauucuccugguagcugucucguuugugacacuaaucaccggaaauauguccuuccgggaccugggccgugugauggucaugguuggggcaacgaugacugaugacauuggaaugggcgugaccuaucucgcccugcuugcugccuuuaagguaagacccacauucgcagcggguuugcuguuaaggaaacucaccucuaaggagcugaugauggccacuaucgggauagcucuucugagccagucaacaaucccugaaaccauucuagagcucacagaugcccuggcauugggaaugauggugcugaaaaucguccgcaacauggaaaaguaccaguuagcugugacuauuauggccaucaguugcguucccaaugcagugauacuccaaaacgccuggaaggucuccuguaccauucuggcugcggugucuguuagcccacuucuguugacguccucacagcagaaagccgacuggaucccucucgcacugacaaucaagggccuaaaucccaccgcuauuuuucugacuacccuuagccggacaaguaaaaagagaucuuggccacucaacgaggccgugauggccgucggcaugguauccauacuggcuagcucguugcugaaaaaugacaucccgaugacugggccuuuaguggcaggaggucuccugaccguuugcuaugugcuuacgggcaggucagccgaucuggaauuggagcgagcggcugacgucaagugggaggaucaggccgaaauuucugggaguucccccauccucagcauuacaaucucugaggacggaagcauguccauaaaaaacgaagaggaggaacacacccugacuauccuaauucgcacaggccugcuugugaucucagguguauucccagugaguauucccaucaccgcagccgcuugguaccucugggaggucaagaagcaacgggcagggguucugugggaugugccuagcccacccccugugggaaaagccgaauuggaggacggcgcguauagaauaaagcagaggggcauuuuuggguacucucagaucggagcuggugucuauaaagaaggcacuuuccauacaauguggcacgugacccguggggccguuuuaaugcaucgcggaaagcggaucgagccguccugggcagauguaaaaaaggaccugauuucauacggcgguggguggaagcucgagggagaauggaaagagggcgaagaggugcagguccuggcccuugaaccaggcaagaaucccagagcugugcaaacgaaaccugggcuguuuaagacuaacaccggaacaaucggugccguuaguuuggauuucagcccaggcaccuccgggucucccauaguggacaggaaaggaaaggucgugggccuauacgguaaugggguagucacacgaucgggagcauaugugagcgcuauugcccagacugagaagucaaucgaggauaacccugaaauugaggacgauaucuuccggaaaaagcgccugaccauaauggaccuccacccgggcgcgggcaaaacgaagagauaccugcccgccauuguuagggaagcaaucaaacgggggcuucgaacauuaauccuggcuccaacuagaguggucgccgcugagauggaagaggcacuccgcggauugccuauuagguaucagacccccgccauccgugccgagcauacaggucgggaaauuguggaccugaugugucacgcuaccuuuacuaugagacuccuguccccaguuagggugccuaacuacaaucuuauaaucauggaugaggcgcacuucaccgaccccgcaaguauugccgcucgcggcuauaucucuacacgagucgaaaugggggaggccgcaggaaucuuuaugacggccacuccaccgggcagcagagauccuuucccccaguccaacgcuccaauuauggacgaggaacgggagauacccgaaaggucauggaauucuggucaugagugggugaccgauuuuaaggggaagacaguaugguucgugccuagcaucaaagcgggaaacgacauugccgcaugccugcgcaagaauggcaaaaagguuauccaauugagucguaaaaccuuugauuccgaauacgucaagacuagagcuaacgacugggauuucguggugacaaccgacauuagcgagaugggcgccaauuuucgggcagagagggucaucgauccacgccgauguaugaagcccguaauacuaacggacggggaagagagagugauccuggccggaccuaugccgguuacucacucuucagcugcccagcggaggggucgcauuggcagaaacccaaaaaaugaaaacgaccaguauaucuacaugggggagccccucgaaaaugaugaggacugcgcgcauuggaaggaggcaaaaauguuacuggauaacauuaauacaccugaaggaaucauacccuccauguucgagccagaaagggagaagguggacgccauugauggcgaauaccggcuucguggugaggcucgcaaaaccuuugucgaccugaugcgaagaggggaucucccugugugguuggccuauaggguugcugcagagggcaucaacuacgccgaccggcgcugguguuucgauggaauuaagaauaaccaaauccuggaagagaacguggaagucgagauauggaccaaagagggcgaaagaaagaagcucaaacccagguggcuggacgcucggaucuauagugauccacuugcccuaaaggaguucaaagaauuugcagcggggcgaaagagccugacuuugaauuuaauuacagagaugggaagacugccuaccuucaugacacagaaagcccgcgacgcucucgauaaccuggccgugcuucacacugcagaaguagguggcagggcuuacaaucacgcccugaacgagcucccggagacguuggaaacccugcuacugcucacacuucuggcaacugugaccgggggaaucuuuuuauucuugaugucgggcaaggguauugggaagaugacacugggcaugugcugcaucauaaccgccucuauucuccugugguaugcucagauccagccccauuggaucgcggccuccauuauccuugaguuuuuccugauaguucucuugauuccagaaccugagaaacaacggacuccccaggacaaucagcugacguacgucgugaucgcaauuuuaaccguggucgcugccacaauggccaacgaaaugggauuucuagagaagacuaaaaaggaccugggccucgggagcaucaccacacaggagucagaaaguaauauacuugauaucgaccugcguccagcaucugcuuggaccuuguaugccguugcgacuacauucgugacgccuaugcugagacacuccauugagaacagcucaguaaaugugagucucaccgcuaucgccaaccaagcaacuguccugaugggacuugguaggggcuggccccucagcaaaauggauauuggggugccgcuguuggccaucggauguuacucccagguuaauccaauuacacugaccgcugcauuacuacugcucguggcccauuacgcgaucauaggcccuggucuucaggcuaaggccacccgcgaagcacagaagcggacagccgcugggauuaugaaaaaccccacugucgacggcaucacgguaaucgaucuggagccaauucccuaugacccuaaguuugaaaaacaauugggacaggugaugcugcucguucugugcgugacccagguccuuaugaugcgaacaacuugggccuuaugugaggcacugacccucgcuacaggcccgauaucuaccuugugggaggggaaucccggaagauucuggaacacuacgaucgccgugagcauggcgaauauuuuuaggggcuccuaccuggccggugcagggcuacuguucucaaucaugaagaacacaaccaaugcucgccggggaacuggcaacauuggugaaacccucggcgagaaauggaagucuagacuuaacgcccuggggaagagugaauuucagaucuauaaaaagucgggaauacaagaggucgaucguacauuggcaaaagagggcaucaagaggggggaaacugaccaccaugcugugagccggggauccgccaaacugcgcugguucguugagcgaaauauggugaccccagaaggcaagguaguggaucucgguugcgggagaggaggcuggucuuacuauugugguggccugaaaaacgucagggagguuaagggguuaacaaagggaggcccugggcacgaagagcccauuccuaugucaacguacggauggaaucuugugcggcugcagagcggcgucgacguguucuuuaccccacccgagaaaugcgauacucuccuaugugacaucggugaauccaguccuaacccaacaauugaggccgggcgcacccugagaguauugaaucugguggaaaacuggcucaauaacaauacucaguucugcguuaaggugcuuaaccccuauaugccgucugucaucgagaaaauggaaacacugcaaaggaaguacggaggcgcguuggugcgaaauccucugagccggaacucaacccacgagauguacugggucuccaaugcuacgggcaacauagugaguagcguuaauaugauuucucguaugcucaucaacagauuuaccaugaaacauaagaaggcaacauaugagccagauguagacuuaggguccggaacucgcaacaucgguauugaaaaugagauacccaaccuggacaucauuggcaaaaggaucgaaaagauuaaacaggagcacgaaaccucauggcauuacgaucaggaccacccuuauaagacaugggccuaccacgggagcuaugagacuaaacagaccggaucggcuucuaguauggugaauggcgucgugaagcuucugacaaagccaugggauguugugcccauggucacccaaauggccaugacugacacgacaccguucggucagcagcggguguuuaaagagaagguagauaccagaacucaggaaccuaaagaggggaccaagaaacuaaugcgcaucacagcagaauggcucuggaaggagcugggaaagaaaaagacgcccaggauguguacccgagaggaauucacucggaaagugagauccaacgccgcuuugggcgcgauauuuacagacgagaauaaguggaaaagcgccagggaagcaguugaggauucacgcuucugggaacuggucgaccgugagcggaaccuccaucuugagggcaagugcgaaaccuguguguacaauaugauggggaaaagagagaagaagcugggagaauuugguaaagcuaagggcuccagggccaucugguauaugugguuaggggcacgcuuccuggaguuugaagccuugggauuccucaacgaggaucacugguuuucucgaggcaauagccugagugguguggagggggaaggacuacauaaacuuggcuacauucugcgggacgucuccaagaaagagggcggggcuauguacgccgaugacacugcgggaugggacacaagaaucacccucgaagaucugaagaacgaggaaaugguuacaaaucacaugaagggugagcauaaaaaguuggcagaggccauuuucaaacugacuuaucaaaacaaggugguaagggugcagcgcccaaccagcagaggcacggucauggacaucauuucucggaaagaucagagggggucaggacaggugggcaccuacggucucaauacauucacuaacauggaagcucaacuuauacgucagauggagggggaaggaaucuuuaagaguauucagcgacugaccguuacagaggagaucgccgugcaaaauugguuagcacgcgucggcagagaacggcuguccaggauggcuaucagcggcgacgauugcgugguaaagccuuuggacgaucgcuucgccucugcucucacugcccugaacgacauggggaaaguuagaaaggauauucagcagugggagcccucgcggggauggaacgacuggacccaggugccauuuugcucacaccacuuccaugaacuagucaugaaagaugguagggugcuugugguccccugucgaaaucaagacgagcugauaggccgugcaagaaucagccagggggcgggauggucccucaaggaaacggccugccugggcaaaaguuaugcucagauguggacauugauguacuuucaccgccgggauuuaaggcuggccgcaaacgcuauuuguucugccguuccuagccauugggugccaaccuccagaacuacauggucaauccacgcaaagcacgaguggaugaccacugaggacaugcucgccguauggaaucgcguguggauucaggaaaacccguggauggaggacaagacccccgucgaaaguugggaggaagugccuuaucuugguaaacgggaggaucaauggugcgggucucugaucggacuaacaagcagggcgacgugggcuaagaauauacagaccgccguuaaccaggugcgaucccugaucggcaaugaggaauacacugacuauaugccaucaaugaaaagauuccggaaggaggaagaggaagcaggcguccucugguga

SEQ ID NO: 14708 - RNA, 9873 nt, Artificial Sequence
  derived and/or modified CDS sequence (opt3) from DENV-2__HQ541798__SS-prME
accgccggcaugaucuucaugcugauuccaacagugauggcuuuucaccucacuacgaggaacggggagccucauaugauagucagcaggcaggaaaagggaaaaucccuucuguucaagaccggugacggcguuaauaugugcacauugauggcaauggauuuaggggagcugugugaagacacuaucaccuacaaaugcccacuucuccggcaaaacgagccggaagauauugacuguuggugcaauucuacaucaaccugggugacuuauggaacauguaccacgacuggcgagcaccgccgagagaagcguagugucgcccuggugccccaugucgguauggggcuugaaaccagaacagagacuuggaugagcuccgaaggagcguggaaacacgcucagaggaucgagaccuggauucugcggcauccuggcuuuacaaucauggccgcaauauuggccuacaccaucggcacgacucacuuccagcgcgcucucauuuuuauccugcugacagcaguggccccaucuaugaccaugagaugcauugggaucucgaacagggauuucguugagggagugucagguggcagcugggucgacauagugcucgaacacgggaguuguguaacuacaauggcuaagaauaagcccaccuuagauuuugagcugauuaaaacggaagccaagcaguccgcgacccuucggaaauauugcaucgaggcaaaguugacaaacacuaccacagaaucucgcuguccuacucaaggagagccaagccugaaugaggaacaggacaaacgauucguuugcaagcauuccaugguggauagaggcugggguaacggguguggacuauuuggcaagggcgggauuguaaccugcgccauguucacaugcaaaaaggacaugaaaggagagguggugcagcccgaaaaucucgaguacaccaucgucaucacuccucacucaggugaagaacaugcuguuggcaacgauacggggaagcacggaaaagagauuaagauaacaccacagaguagcaucaccgaagccgagcugacuggcuaugguaccgugacaauggaauguucuccgaggaccgggcuugacuuuaaugagaugguacuguugcaaauggaaaacaaagcauggcucgugcaccggcagugguuccuggauuuaccccugccuuggcucccaggcgcugacacucagggauccaauuggauucagaaggagacacuugucacguuuaagaacccccaugccaaaaagcaagacgugguugugcugggcucacaggagggggcgaugcacaccgccuugacuggagcaacagaaauccagaugagcagugguaaucuacuguucaccggccaucucaaaugccgucugcgcauggauaaacuucaacugaaagggaugucuuacuccauguguacaggaaaguucaaggucgugaaagagauagcugaaacucagcacggcaccauuguaaucagaguucaguaugagggugacgggagcccuugcaagaucccauuugagauuauggauuuggagaagaggcaugugcucggccggcugaucacggucaaccccauugugaccgagaaggacucgccggucaacauagaagccgagccucccuucggagauucuuacaucauuaucggcguggaaccagggcaguuaaaacugaauugguuuaagaagggauccucaaucggucaaaugcuagagacaacuaugcgaggcgcuaaacgcauggccauucucggggacaccgcaugggauuucggaagucugggcgguguuuuuacaagcauagggaaggcccuucaccagguguucggcgcuaucuacggagcggcauuuuccggcguaucuuggacuaugaaaauuuugaucggggucauuaucaccuggauaggaaugaacagcagaucaacgagucuguccgugagccucguucuggugggcgucgugacacuuuaucuggguguaauggugcaggccgacucuggguguguugucucauggaagaauaaagaguugaagugcggaaguggcaucuucauuaccgauaacgugcacacuuggacagaacaguacaaguuucaaccugagagccccuccaaacucgcuucugccauccagaaggcacaugaagaggguauuuguggcaucaggucggugacccggcuggaaaauuuaauguggaaacagauaacuccagagcugaaccacauucuaagcgagaaugaagucaagcucaccaucaugacaggggacauuaaaggaaucaugcaggccggcaagcgcucccugagaccccaaccuacggagcuuaaauauucauggaagaccugggggaaggcuaaaauguugaguacugaaucucauaaccagacauuccugauagauggaccagagaccgccgaaugcccgaauacaaacagggcauggaauagccucgagguugaggacuacggcuuugguguguucacuaccaacaucuggcugaaguuacgugaaaaacaggacguguuuugugauuccaagcugaugucagcggcuauuaaagacaaucgggccguacacgcagauaugggguauuggaucgagagcgcccuuaacgacacguggaagauugaaaaggcuucuuucaucgaggucaaauccugccacuggcccaagccucauacauuguggaguaaugaggugcucgaaagcgagaugauaauucccaagaacuucgccggacccguuucucagcacaacuaccgaccuggcuaucauacccaaacugcagguccauggcaccugggcaagcuagaaauggauuuugacuucugugaggggaccacaguggucgugacugaagauugcggaaauagaggccccucccugaggaccacaacggcuucagggaaacucaucaccgaguggugcugucgcaguugcacucugccgccucuucgguacagaggagaggacggcuguugguacgguauggaaaucaggccauugaaggagaaggaagagaaccugguuaauagcuuagugacagccgggcauggacagauugauaacuuuucgcucggcguacuggguauggcgcuuuuccuggaagagauguugcgcacccgagucggcacuaaacacgccauccuccugguggcuguguccuuugucacacuaauuaccgggaauaugucuuuccgggaccugggacguguuauggugaugguaggcgcaacgaugacugaugacauagggaugggagugaccuaucucgcccugcuugcugccuuuaaggucagacccacauucgcagcgggcuugcuguuaaggaaacucaccagcaaggagcugaugaugacuacaaucgguauugugcuucugucacagaguaccaucccugaaacaauucuagagcucacugaugcccuggcuuuggggaugaugguucugaaaauggugcgcaagauggaaaaguaccaauuagccgucaccaucauggcaauacucugcgugcccaacgcuguuauccugcagaaugccuggaaaguguccuguacgauucuugcagucguaucugugagcccacuguuuuugacauccucacagcagaaggccgacuggaucccucucgcucugaccauuaaaggacuaaaccccacugcgaucuuccugaccacacuuagccggacuaauaagaaaagaaguuggccacucaacgaggccauaauggcaguuggcauggugucuauucuggcuuccagcuugcugaagaaugacaucccgaugaccggcccuuuagucgccgggggacuccugacggugugcuauguacuuacagguaggucggccgaucuggaauuggagcgagcugcagacgugaaaugggaggaucaagccgaaaucucaggcucuagucccauucucuccauaaccaucagcgaggacgggucuaugagcauuaagaacgaagaggaggaacagacucugacaauccuaauucgcaccggacugcuugucaucuccggccucuuuccaguuucacugcccauaacugcggcugccugguacuugugggaggugaagaaacagcgggccgguguguuaugggaugucccuaguccacccccuguggggaaggccgaacuggaggacggagcuuauagaaucaaacagaagggcauucucggcuacagccaaaucggggcaggaguuuauaaagaagguacauuccacaccauguggcauguaacgaggggcgccgugcugaugcacaaggggaagcguauugagccgucuugggcggaugucaaaaaggaccuuaucuccuacggaggcgguuggaaacuggagggggaauggaaggagggagaagaggugcagguuuuggcucuagaaccaggcaaaaauccccgcgccgugcagacuaagccuggccuguuuaagaccaacgcagggacaauaggagccgucucacucgauuucaguccagguaccagcggcucccccauuaucgacaaaaaggggaaagugguaggacuguacggcaauggugucgugacacggucuggggcuuauguuucggccaucgcacagacugaaaagagcauugaggauaacccugaaaucgaggacgauauauucagaaaaaggaaacuuaccauuauggacuuacauccgggagcuggcaagacgaagcgauaccugcccgccaucgugcgggaagcgauuaagcgcggccucagaacauugauccuggccccaacuagggucguggcagcugagauggaagaggcccuccgggggcugccuauacgauaucaaacccccgcuauuagagcagagcacacaggacgcgaaaucguugaccuuaugugucaugccaccuuuacuaugaggcuguugucaccagugcgugucccuaacuacaaucuaaucauuauggaugaggcccacuucaccgaccccgcuuccaucgcggcacgggguuauauuaguacaagaguggaaaugggcgaggccgcugggauauuuaugacggccacuccaccgggaucuagggauccuuucccccagagcaacgcaccaaucauggacgaggaacgcgagauucccgaacgauccuggucaucuggccacgaguggguaaccgauuuuaaagguaagacagugugguucguuccuagcaucaaagccgggaaugacaucgcugcgugccugagaaagaacggaaagaaagucauucagcucagucggaagaccuuugauuccgaauacgugaaaacuaggacaaaugacugggauuucguggucaccacggacauaagcgagaugggcgccaacuuuaaggcagagcgcguaaucgauccacguagauguaugaaacccgugauuuuaacugacggcgaagaacggguuauccuggcugggccuaugccggugacacauucuucagccgcacaaaggcgcggacgaauugguagaaauccaaagaacgaaaaugaccaguauaucuacaugggcgagccccuugaaaacgaugaggacugcgcccacuggaaagaggcuaagaugcugcucgauaauauaaacaccccugaagggaucauucccuccauguucgagccagaacgggagaaggucgacgccaucgauggagaauacagguugcgcggcgaggcgagaaaaaccuuuguggaccugaugaggcggggugaucucccuguuuggcuggcauaucguguggccgcugaggggauuaauuacgccgaccgccgaugguguuucgauggcaucaagaacaaucagauacuugaagagaacgucgaaguggagauuuggacuaaagagggagaaagaaagaaacuaaagcccagguggcuggacgcucggaucuauagugauccauuggcauuaaaggaguucaaagaauuugccgcuggccgcaagagccugacacucucgcugauuaccgagauggggagacuuccuacauucaugacucagaaagccagggacgcacuggauaaccucgcgguauugcauacggccgaagcuggaggucgggccuacaaucacgcacugucugagcuaccggagacccuggaaacacuccuucuguuaacuuugcuggcuaccgugacaggcgggaucuuucucuuccugauguccggacgaggcauagguaagaugacccuugggaugugcugcaucauuacugccagcauccugcucugguaugcacaaauucagccccacuggaucgccgcuucaauaauuuuggaguuuuuccugaucguuuuacuaaucccagaaccugagaaacagagaacgccccaggacaaccaacugaccuacgucgugauugcgauccucacaguggucgccgcaacuauggcuaaugaaaugggcuuucuugagaagaccaagaaagaccugggauugggcaguauaacaacccagcagccagagucuaacauucuggauaucgaccuccgcccugccuccgccuggacucuguaugcaguugcuacaacguucgugacccccaugcuuaggcauagcauugaaaauucaaguguaaacgugagccucacugccaucgcgaaucaggcuacaguccugaugggguugggaaaggguuggccgcuguccaaaauggauauaggcgugccauuacuagccaucggguguuacucucaaguuaacccuauuacccugaccgcagcccucuuucuucugguggcucacuacgcaaucauuggacccggcuugcaggccaaggcgacacgggaggcucagaaacgugccgcagccgguaucaugaagaauccaacugucgacgggauuacgguaaucgaucuggaccccauaccuuaugauccgaaguucgaaaaacagcucggccaagugaugcugcuuguuuuaugcgugacccagguccugaugaugagaacaacuugggcucucugugaggccuugacccuggcaacaggacccauuagcacccuaugggaaggcaacccagggagguuuuggaauacuacgaucgcuguguccauggccaacaucuuccgcggaucauaccuggcgggcgccggucuccuauuuucuauuaugaagaauacaaccaacacucggcgagggaccggaaauauaggcgagacacugggugagaaauggaagaguagauugaacgcacugggcaaaucggaguuccagaucuauaagaaaagcgggauucaagaggucgacaggacucucgcuaaggaaggaaucaagcgcggcgagaccgaucaucacgccgugucccgggggucugcaaaacugagaugguucguugagcguaauauggugacaccugaaggaaagguaguggacuuaggcugcgguagaggaggguggucauacuauuguggcggucuuaaaaacguccgggagguuaagggccugacgaaagggggacccggccaugaggaaccuauuccaaugagcaccuacggguggaaccucgugcgccuacaguccggagucgauguguuuuucacucccccugaaaagugcgacacacuguugugugauaucggcgagaguucuccaaaucccaccguagaggcuggucgaacucugagagugcucaaccuuguugaaaauuggcugaacaauaacacacaguuuugcauaaagguguugaauccguauaugccuagcgucaucgagaaaauggaagcccugcagaggaaguacgggggagcccucgugcggaacccauuaucacgcaauuccacccacgagauguacugggucaguaacgcgagcggcaauauugugucuuccguuaacaugaucucaagaaugcugauuaauagguucacgaugcgacacaaaaaggcuaccuaugaacccgacguagaccuuggcagcgggacacggaacaucggaauagagucggagauuccuaaucuggauaucaucgguaaacguauuaagauaaagcaagaacaugagacuucuuggcacuacgaccaggaucauccauauaaaaccugggcauaccacggcaguuaugaaacaaagcagacuggguccgccagcucaauggugaacggagucgugagacuacucaccaaacccugggacguugugccgauggucacacagauggcuaugaccgauacuacgccuuuuggccaacagcgcguguucaaggagaaaguagacacaaggacccaggaacccaaggaggguacuaagaaacugaugaagaucaccgccgagugguuguggaaagaacuggggaagaaaaagacaccacggauguguacgagagaggaauuuacccgcaaagugagguccaacgcagcccucggagcuauuuucacugaugagaauaaguggaagucugcgcgagaggccguugaagacagccgguuuugggagcuugucgauaaagaaagaaaccugcacuuagagggcaagugcgaaacauguguguacaauaugaugggcaaaagggagaagaaacugggggaguucggaaaggcaaaggguagucgcgcuaucugguauaugugguugggcgcccguuuucucgaguucgaggcacugggguuucuaaacgaagaccauugguucucccgggagaauagccuuucuggaguggaaggcgagggucugcacaaacucggguacauucugagagaugucucaaagaaagagggaggcgccauguacgcugacgacaccgccggcugggauacuaggaucacauuggaagaccugaagaacgaggaaaugguuaccaaucauauggagggggaacacaaaaagcucgcggaggcaauauucaaacuuacauaucagaacaaagugguacgcgugcaacgaccuacuccccggggaaccgucauggauaucauuaguagaagggaccagcgcgguuccggccagguggggacguacggacugaauaccuuuacaaacauggaggcccaauuaaucagacagauggaaggcgaggguguuuucaagagcauucagcaucugacugugaccgaagagaucgcuguccagaauugguuggcccggguggggagggagcgucucucucgaauggcaauuucgggagaugacugcguaguuaaaccacuggaugaccgcuuugcuucagcccuaacagcucuuaacgauaugggcaaggugagaaaagacauacaacagugggaacccagccggggcuggaaugauuggacucaggucccuuucugcucccaccacuuucaugagcugaucaugaaggacgggagggugcucguggucccaugucgcaaccaggaugaacugauugggagagcacggaucagucaaggugcaggcuggucuuugagggagaccgcgugcuuaggaaagagcuaugcccagauguggucccugauguacuuccaccgacgugaccucagacuugcugccaaugcaaucuguucagcuguuccgagucauugggugcccacgucucgcacaaccuggagcauucacgccaaacacgaauggaugacugcagaggacaugcugacaguauggaaccggguguggauacaggagaacccuuggauggaagauaagaccccagucgaguccugggaagagauccccuaucuaggaaaaagggaagaccaguggugcggcucacugauuggucucacuagcagagccaccugggcgaagaauauccaaacagcuauuaaccaggugcgcucuuugaucgggaaugaggaguacacggauuauaugccuuccaugaaacgguuuaggcgagaagaggaagaggccggaguucugugguga

SEQ ID NO: 14709 - RNA, 9876 nt, Artificial Sequence
  derived and/or modified CDS sequence (opt3) from DENV-2__JF730053__SS-prME
accgccggcaugaucauuaugcugauacccacagugauggcuuuccaccucacuacgagaaacggggagccucauaugaucgucagcaggcaggaaaagggaaaaucccuucuguuuaagaccggugacggcguuaauaugugcacauugauggcaauggauuuaggggagcugugugaagacacuauuaccuacaaaugcccacuacuccggcaaaacgagccggaagauaucgacuguuggugcaauucuacaucaaccugggugacuuauggaacauguaccacgacuggcgagcaccgccgagagaagcguaguguagcccuggugccccaugucgguauggggcuugaaaccagaacagagacuuggaugagcuccgaaggagcguggaaacacgcucagaggauugagaccuggauccugcggcauccuggcuucacaauaauggccgcaaucuuggccuacaccauuggcacgacucacuuucagcgcgcucucaucuucauucugcugacagcaguggccccaucuaugaccaugagaugcaucgggauaucgaacagggauuuuguugagggagugucagguggcagcugggucgacauugugcucgaacacgggaguuguguaacuacaauggcuaagaauaagcccaccuuagauuucgagcugaucaaaacggaagccaagcaguccgcgacccuucggaaauauugcauugaggcaaaguugacaaacacuaccacagaaucucgcuguccuacucaaggagagccaagccugaaugaggaacaggacaaacgauuuguuugcaagcauuccaugguggauagaggcugggguaacggguguggacuauucggcaagggcgggaucgucaccugcgccauguuuacaugcaaaaagaauaugaaaggaaagguggugcagcccgagaaccucgaauacaccaucgucauuacuccucacucaggugaggaacaugcuguuggcaaugacacggggaaacacggaaaggagauaaaaaucacaccacagaguagcauuaccgaggccgaacugacuggcuaugguaccgugacaauggaguguucuccgaggaccgggcuugauuucaacgaaaugguacuguugcaaauggagaauaaggcauggcucgugcaccggcagugguuucuggacuuaccccugccuuggcucccaggcgcugauacucagggauccaacuggauccagaaggaaacacuugucacguucaaaaauccccaugccaagaaacaagacgugguugugcugggcucacaggagggggcgaugcacaccgccuugacuggagcaacagagauacagaugagcagugguaaccuacuguuuaccggccaucucaagugccgucugcgcauggacaaacuucaacugaaggggaugucuuacuccauguguacaggaaaguucaaagucgugaaggaaauugcugagacucagcacggcaccaucguaaucagaguucaguaugaaggugaugggagcccuugcaaaauuccauucgagaucauggacuuggagaagaggcaugugcucggccggcugauuacggucaaccccauagugaccgaaaaagauucgccggucaauaucgaggccgaaccucccuuuggagacucuuacauuaucaucggcguggagccagggcaguuaaagcugaacugguucaagaaaggauccucaauuggucaaaugcuagaaacaacuaugcgaggcgcuaagcgcauggccauacucggggauaccgcaugggacuuuggaagucugggcgguguuuucacaagcaucgggaaagcccuucaccagguguuuggcgcuauuuacggagcggcauucuccggcguaucuuggacuaugaagaucuugauuggggucaucauaaccuggaucggaaugaauagcagaucaacgagucuguccgugagccucguucuggugggcgucgugacacuuuaucuggguguaauggugcaggccgauucuggguguguugucucauggaaaaacaaggaguugaagugcggaaguggcauuuuuaucaccgacaaugugcacacuuggacagagcaguacaaauuccaaccugaaagccccuccaagcucgcuucugccauucagaaagcacaugaggaagguaucuguggcauaaggucggugacccggcuggagaacuuaauguggaagcagauuacuccagaacugaaucacauccuaagcgagaacgaggucaaacucaccauuaugacaggggauaucaagggaauaaugcaggccggcaaacgcucccugagaccccaaccuacggaacuuaaguauucauggaagaccugggggaaagcuaagauguugaguacugagucucauaaucagacauuucugaucgacggaccagaaaccgccgagugcccgaacacaaauagggcauggaacagccucgaaguugaggauuacggcuucgguguguuuacuaccaauauuuggcugaaauuacgugagaagcaggacguguucugugacuccaaacugaugucagcggcuaucaaggauaaccgggccguacacgcagacaugggguauuggauugaaagcgcccuuaaugauacguggaagaucgagaaagcuucuuuuauagaagucaaguccugccacuggcccaaaagucauacauuguggagcaacgaggugcucgagucugaaaugauuaucccuaagaacuucgccggaccaguuucccagcacaauuaccgacccggcuaucauacccaaacugcagguccuuggcaccugggcaaacuagagauggacuucgauuuuugugaagggaccacaguggucgugacugaggacugcggaaacagaggcccaucacugaggaccacaacggcuagugggaagcucaucaccgaauggugcugucgcagcugcacucugcccccgcuucgguacagaggagaggauggcuguugguacgguauggagauuaggccuuugaaggaaaaagaggaaaaucugguuaacucguuagugacagccgggcauggacagaucgacaauuucucccucggcguacuggguauggcgcuuuuucuggaggaaauguugcgcacccgagucggcacuaagcacgccauucuccugguggcugugucuuucgucacacuaauaaccgggaacaugagcuuucgggaucugggacguguuauggugaugguaggcgcaacgaugacugacgauaucgggaugggagugaccuaucucgcccugcuugcugccuucaaagucagaccaacauuugcagcgggcuugcuguuaaggaagcucaccucaaaagagcugaugaugacuacaauugguaucgugcuucugagucaguccaccauucccgagacaauccuagaacucacugacgcccuggcuuuggggaugaugguucugaagauggugcgcaagauggagaaauaccaauuagccgucaccauaauggcaauccucugcgugccuaaugcuguuauucugcagaacgccuggaaggugucuuguacgauccuugcagucguaagcguguccccccuguucuugacaucaagccagcagaaagccgauuggauuccacucgcucugaccaucaagggacuaaauccuacugcgauauuucugaccacacuuagucggacuaacaaaaagagaucuuggccccucaaugaagccauuauggcaguuggcaugguguccauccuggcuagcucguugcugaaaaacgacaucccaaugaccggcccguuagucgccgggggacuccugacggugugcuauguacuuacagguaggucagccgaccuggaguuggaacgagcugcagaugugaagugggaggaccaagccgagauuucuggcaguuccccuauacucagcaucaccauuucugaagaugggagcauguccaucaagaaugaggaagaggagcagacucugacaauucuaauccgcaccggacugcuugucauaucaggccucuuccccguuagucugccaaucacugcggcugccugguacuugugggaagugaaaaagcagcgggcagguguguuaugggacguccccagcccuccacccguggggaaagccgagcuggaagauggagcuuauagaauuaagcagaaaggcauccucggcuacucucaaauuggggcaggaguuuauaaggaggguacauuucacaccauguggcauguaacgaggggcgccgugcugaugcacaaggggaaacguaucgaaccuuccugggcggacgucaagaaagaucuuauaucauacggaggcgguuggaagcuggagggggaguggaaagaaggagaggaagugcagguuuuggcucuagagccgggcaagaacccacgcgccgugcagacuaagcccggccuguucaaaaccaaugcagggacaauuggagccgucagucucgacuuuagcccugguaccuccggcucuccaaucaucgauaagaaagggaaggugguaggacuguacggcaacggugucgugacacggucgggggcuuauguuagcgccauugcacagacugaaaaaucaaucgaggacaaccccgagauagaagaugacauuuucagaaagaggaagcuuaccaucauggauuuacauccuggagcuggcaaaacgaagcgauaccugccggccauugugcgggaggcgaucaaacgcggccucagaacauugauacuggcccccacuagggucguggcagcugaaauggaggaagcccuccgggggcugccaauucgauaucaaaccccugcuaucagagcagagcacacaggacgcgagaucguugaccuuaugugucaugccaccuucacuaugaggcuguugucccccgugcgugucccaaauuacaaccuaauuaucauggacgaagcccacuuuaccgauccugcuaguauugcggcacgggguuauauaucuacaagaguggagaugggcgaagccgcugggaucuucaugacggccacucccccaggaagcagggacccguuuccucaguccaaugcacccauuauggaugaggagcgcgaaaucccagagcgaucauggucuagcggccacgaauggguaaccgacuucaaggguaaaacagugugguuuguucccaguaucaaggccgggaacgauauugcugcgugccugagaaagaauggaaaaaaggucauacagcucucccggaaaaccuucgacagcgaguacgugaagacuaggacaaacgauugggacuuuguggucaccacggauaucucugaaaugggcgccaauuucaaagcagagcgcguaauugacccucguagauguaugaagccagugaucuuaacugauggcgaggaacggguuauucuggcugggcccaugccugugacacauucauccgccgcacaaaggcgcggacgaaucgguagaaacccgaaaaaugagaacgaccaguauauauacaugggcgaaccacuugagaaugacgaagauugcgcccacuggaaggaggcuaagaugcugcucgacaacaucaauacccccgaggggauuaucccuaguauguuugaacccgagcgggaaaaagucgaugccauugacggagaguacagguugcgcggcgaagcgagaaagaccuucguggaucugaugaggcggggugaccucccaguuuggcuggcauaucguguggccgcugaggggaucaacuacgccgaucgccgaugguguuuugacggcauaaaaaauaaccagauucuugaggaaaacgucgagguggaaaucuggacuaaggagggagagagaaaaaagcuaaagccuagguggcuggaugcucggauuuauagcgaccccuuggcauuaaaagaauucaaggaguucgccgcuggccgcaaaucgcugacacucucucugaucaccgaaauggggagacuuccaacauuuaugacucagaaggccagggaugcacuggacaaucucgcgguauugcauacggccgaggcuggaggucgggccuacaaccacgcacuguccgaacuaccugagacccuggagacacuccuucuguuaacuuugcuggcuaccgugacaggcgggauauuccucuuucugaugagcggacgaggcaucgguaaaaugacccuugggaugugcugcauuaucacugccucaauucugcucugguaugcacaaauccagccgcacuggauagccgcuaguauuaucuuggaauucuuucugaucguuuuacuaauucccgagccagaaaagcagagaacgccucaggauaaucaacugaccuacgucgugaucgcgauacucacaguggucgccgcaacuauggcuaacgagaugggcuuccuugaaaagaccaaaaaggaccugggauugggcucuauuacaacccagcagcccgaguccaauauccuggacauugaucuccgcccagccagcgccuggacucuguaugcaguugcuacaacguuugugaccccuaugcuuaggcauucaaucgagaacaguagcguaaaugugucccucacugccauagcgaaccaggcuacaguccugaugggguugggaaaagguuggccccugucuaagauggacaucggcgugccguuacuagccauuggguguuacagccaaguuaauccaaucacccugaccgcagcccucuuccuucugguggcucacuacgcaauuaucggaccuggcuugcaggccaaagcgacacgggaagcucagaagcgugccgcagccgguauuaugaagaaccccacugucgaugggaucacgguaauagaccuggauccaauucccuaugacccuaaauuugagaagcagcucggccaagugaugcugcuuguuuuaugcgugacccagguccugaugaugagaacaacuugggcucucugugaagccuugacccuggcaacaggaccgaucuccacccuaugggagggcaaucccgggagguucuggaacacuacgaucgcugugucaauggccaauauuuuucgcggaucuuaccuggcgggcgccggucuccuuuucaguauaaugaaaaacacaaccaauacucggcgagggaccggaaacaucggcgaaacacugggugagaaguggaaaucgagauugaaugcacugggcaagagcgaguuucagauuuauaaaaaguccgggauccaagaagucgauaggacucucgcuaaggagggaauuaaacgcggcgaaaccgaccaucacgccgugucucgggggucagcaaagcugagaugguucguugagcguaacauggugacaccagagggaaaaguaguggauuuaggcugcgguagggggggauggagcuacuauuguggcggucuuaagaacguccgggaaguuaaaggccugacgaaggggggaccuggccaugaggaacccaucccuauguccaccuacggguggaaucucgugcgccuacagaguggagucgacguguucuuuacuccacccgagaagugcgauacacuguugugugacauaggcgaaucuagcccuaacccaaccguagaggcuggucgaacucugagagugcucaaucuuguugagaacuggcugaauaacaauacacaguucugcaucaaaguguugaaccccuauaugccgucagucauugaaaagauggaggcccugcagaggaaauacgggggagcccucgugcggaauccuuuaucccgcaacaguacccacgaaauguacugggucagcaaugcgucuggcaacaucguguccucaguuaauaugauuagcagaaugcugaucaacagguuuacgaugcgacacaagaaagcuaccuaugagccagauguagaccuuggcucggggacacggaauauaggaauugaaucugagauccccaaccuggacaucauugguaagcguauagagaagaucaaacaagaacaugagacuaguuggcacuacgaucaggaccauccuuauaagaccugggcauaccacggcuccuaugaaacaaaacagacugggagcgccucauccauggugaacggagucgugagacuacucaccaagccaugggauguugugcccauggucacacagauggcuaugaccgacacuacgccguucggccaacagcgcguguuuaaagagaagguagauacaaggacccaggaaccuaaggaggguacuaaaaagcugaugaaaauuaccgccgagugguuguggaaggaacuggggaaaaagaaaacaccccggauguguacgagagaggaauucacccgcaaggugaggucuaaugcagcccucggagcuaucuuuacugacgagaacaaguggaaaagcgcgcgagaggccguugaagauagucgguucugggagcuugucgacaaggaaagaaaucugcacuuagagggcaaaugcgaaacauguguguacaacaugaugggcaagagggagaaaaagcugggggaguuuggaaaggcaaaagguucccgcgcuauuugguauaugugguugggcgcccguuuccucgaauuugaggcacugggguuccuaaaugaagaucauugguuuagccgggagaacucucuuucaggaguggaaggcgagggucugcacaagcucggguacauccugagagacgucaguaaaaaggagggaggcgccauguacgcugaugacaccgccggcugggacacuaggauaacauuggaagaucugaaaaaugaggaaaugguuaccaaccauauggagggggaacacaagaagcucgcggaggcaaucuucaaacuuacauaucagaauaaggugguacgcgugcaacgaccaacuccucggggaaccgucauggacauuaucuccagaagggaucagcgcgguagcggccagguggggacguacggacugaacaccuucacaaauauggaggcccaauuaauuagacagauggaaggcgaggguguuuuuaaaucuauccagcaucugacugugaccgaagagauugcuguccagaacugguuggcccggguggggagggagcgucucucgcgaauggcaauaucaggagacgauugcguaguuaagccccuggacgaucgcuucgcuagcgcccuaacagcucuuaaugacaugggcaaagugagaaaggauauccaacagugggaaccaucccggggcuggaacgacuggacucagguccccuuuugcagucaccacuuccaugagcugauuaugaaggaugggagggugcucguggucccuugucgcaaucaggacgaacugaucggaagagcccggaucucucaaggugcaggcuggagcuugagggagaccgcgugcuuagggaaauccuaugcccagauguggucacugauguacuuucaccgacgugaucucagacuugcugccaacgcaauuuguagugcuguuccaucucauugggugccgacgagccgcacaaccugguccauacacgccaagcacgaauggaugacugcagaggacaugcugacaguauggaaccggguguggauccaggagaaucccuggauggaagacaaaaccccugucgagucaugggaagagauuccauaucuaggaaagagggaagaucaguggugcggcagccugaucggucucacuucuagagccaccugggcgaaaaacauucaaacagcuaucaaucaggugcgcuccuugauagggaacgaggaguacacggacuauaugcccaguaugaagcgguucaggcgagaagaggaagaggccggaguucugugguga

SEQ ID NO: 14710 - RNA, 9876 nt, Artificial Sequence
  derived and/or modified CDS sequence (opt3) from DENV-2__EU529706__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucauggauuuggagaaaaggcauguucucggccggcugauuacggugaacccgaucgucaccgaaaaggacuccccugugaacaucgaggccgaacccccauuuggagauagcuacauuauaaucggcgucgagccugggcaguuaaaacugaauugguucaagaagggaucgucuauuggucaaauguuugagacaacuaugcgaggcgcuaaacgcauggccauccuaggggacaccgcaugggauuucggaucccucggcgguguguuuacaucaauugggaaggcccugcaccagguuuucggcgcuaucuacggagcggcauuuaguggcgugagcuggacuaugaaaauacuuaucgggguaauuaucaccuggauuggaaugaacuccagaucuacgagcuugucagucagucuggugcucguuggcguggucacacuguaucuuggugugaugguacaggccgacaccgggugugugguuuccuggaagaauaaagaacugaagugcggaagcggcaucuucauaacugauaacguccacacauggaccgagcaguacaaguuucaacccgaaucuccaucaaaauuggcuagugccauucagaaggcacaugaggaagguaucuguggcauuaggagcgugacucggcucgagaaucugauguggaaacagaucacccccgaguuaaaccacauacuguccgaaaaugaggugaagcuaacaaucaugacgggggacauuaaaggaaucaugcaggccggcaagcgcucucucagaccucaaccaaccgaacugaaauauucguggaagacuugggggaaggcuaaaaugcuuagcacagagucccauaaccagaccuucuugauugauggaccggaaacagccgagugccccaauacuaacagggcauggaauucacuggaggucgaagacuacggcuuugguguuuucaguaccaacaucuggcucaagcugcgugagaaacaggacguguuuugugauucuaaguuaaugagcgcggcuauaaaagacaaucgggccgugcacgcagauaugggguauuggauugaauccgcccugaacgacacguggaagauggagaaggcuucauucaucgagaucaaaagcugccacuggccuaagucucauacacuuugguccaauggaguauuggaaagugagaugauuaucccaaaaaacuucgccggccccgucagccagcacaacuaccgaccugguuaucauacccaaacugcaggcccauggcaccucgggaagcuggaaauggauuuugaccuaugugagggaaccacagugguugugacugaagauugcggcaauagagggcccucucugaggaccacaacggcuuccggaaaacucauuaccgaguggugcugucgcucaugcacucugccgccucuucgguacagaggcgaggacgguuguugguacgggauggaaauaaggccauugaaggagaaggaagagaaccuggucaauaguuuagugacagccggacauggccagaucgauaacuucagccucgguguucugggcauggcgcuuuuucuggaagagauguugcgcacccgaauugggacuaaacacgccauccuccugguggcuguaucguucgucacacuaauuaccggaaauauguccuuucgggaccugggccgugugauggugauggucggggcaacgaugacugaugacaucggaaugggcguuaccuaucucgcccugcuugcugccuucaaggugagacccacauuugcagcggguuugcuguuaaggaaacucaccucuaaggagcugaugauggccacuauagggaucgcucuucugagccagucaacaauuccugaaaccauccuagagcucacagaugcccuggcauugggaaugaugguacugaaaauugugcgcaacauggaaaaguaccaauuagcugucacuaucauggccauaaguugcgugcccaaugcaguuauucuccagaacgccuggaagguguccuguaccauccuggcugcggucucugugagcccacuucuguugacguccucacagcagaaagccgacuggaucccucucgcacugacaauuaagggccuaaaucccaccgcuauauuccugacuacccuuagccggacaaguaaaaagagaucuuggccacucaacgaggccguuauggccgugggcauggucuccauccuggcuagcucguugcugaaaaaugacauuccgaugacugggccuuuaguagcaggaggucuccugaccgugugcuauguucuuacgggcaggucagccgaucuggaauuggagcgagcggcugacgugaagugggaggaucaagccgaaaucucugggaguucccccauucucagcaucacaauaucugaggacggaagcauguccaucaaaaacgaagaggaggaacacacccugacuauucuaauccgcacaggccugcuugucauuucagguguguuuccaguaaguauccccauaaccgcagccgcuugguaccucugggaggugaagaagcagcgggcagggguccugugggauguuccuagcccacccccugugggaaaagccgaauuggaggacggcgcguauagaauuaagcagaggggcaucuucggguacucucagaucggagcugguguguauaaagaaggcacuuuucauacaauguggcacgucacccguggggccguguuaaugcaucgcggaaagcggauugagccguccugggcagauguuaaaaaggaccugaucucauacggcgguggguggaagcucgagggagaauggaaagagggcgaagagguacaagugcuggcccuugaaccaggcaagaaucccagagcuguccagacgaaaccugggcuguucaagacuaacaccggaacaauaggugccgugaguuuggauuuuagcccaggcaccuccgggucucccauuguugacaggaaaggaaagguggucggccuauacgguaauggggugguaacacgaucgggagcauaugucagcgcuaucgcccagacugagaagucaauugaggauaacccugaaaucgaggacgauauauuccggaaaaagcgccugaccauuauggaccuccacccgggcgcgggcaaaacgaagagauaccugcccgccaucgugagggaagcaaucaaacgggggcuucgaacauuaauucuggcuccaacuagaguuguggccgcugagauggaagaggcacuccgcggauugccuaucagguaucagacccccgccauucgugccgagcauacaggucgggaaauagucgaccugaugugucacgcuaccuucacuaugagacuccuguccccagugaggguuccuaacuacaaucuuaucauuauggaugaggcgcacuuuaccgaccccgcaaguaucgccgcucgcggcuauaucucuacacgaguggaaaugggggaggccgcaggaauuuucaugacggccacuccaccgggcagcagagauccuuuuccccaauccaacgcuccaauaauggacgaggaacgggagauccccgaaaggucauggaauucuggucaugagugggucaccgauuucaaggggaagacagugugguuuguaccuagcauuaaagcgggaaacgacaucgccgcaugccugcgcaagaauggcaaaaaggugauucaguugagucguaaaaccuucgauuccgaauacguuaagacuagagcuaacgacugggauuuugucgugacaaccgacaucagcgagaugggcgccaauuuccgggcagagagggugauagauccacgccgauguaugaagcccgucauccuaacggacggggaagagagaguaauucuggccggaccuaugccggugacucacucuucagcugcccagcggaggggucgcaucggcagaaacccaaaaaaugaaaacgaccaauauauuuacaugggggagccccucgaaaaugaugaggacugcgcgcauuggaaggaggcaaaaauguuacuggauaacaucaauacaccugaaggaauaauucccuccauguuugagccagaaagggagaagguugacgccaucgauggcgaauaccggcuucguggugaggcucgcaaaaccuucguggaccugaugcgaagaggggaucucccugucugguuggccuauaggguggcugcagagggcauuaacuacgccgaccggcgcugguguuuugauggaaucaagaauaaccagauacuggaagagaacguugaaguggagaucuggaccaaagagggcgaaagaaagaagcucaaacccagguggcuggacgcucggauuuauagugauccacuugcccuaaaggaguucaaagaauucgcagcggggcgaaagagccugacuuugaauuuaaucacagagaugggaagacugccuaccuuuaugacacagaaagcccgcgacgcucucgauaaccuggccguccuucacacugcagaaguggguggcagggcuuacaaucacgcccugucggagcucccggagacguuggaaacccugcuacugcucacacuucuggcaacuguaaccgggggaauuuucuuauuuuugaugucuggcaaggguaucgggaagaugacacugggcaugugcugcauaauuaccgccuccauccuccugugguaugcucagauccaaccccauuggauugcggccagcaucauacuugaguucuuucugauugugcucuugaucccagaaccugagaaacagcggacuccccaggacaaccagcugacguacguugucauugcaaucuuaaccgugguggcugccacaauggccaaugaaaugggauuccuagagaagacuaaaaaggaccugggccucgggucaauaaccacacaagagagugaaucuaacauccuugauauugaccugcguccagcauccgcuuggaccuuguaugccgucgcgacuacauuuguuacgccuaugcugagacacagcaucgagaauucaagugugaacguaagccucaccgcuauugccaaucaggcaacugugcugaugggacuugguaggggcuggccccucuccaaaauggauaucggggucccgcuguuggccauuggauguuacucucaggugaacccaaucacacugaccgcugcauuacuacugcucguugcccauuacgcgauaauuggcccuggucuucaggcuaaggccacccgcgaagcacaaaagcggacagccgcugggaucaugaaaaaucccacuguggacggcaucacggucauugaucuggagccaauacccuaugacccuaaguucgaaaaacaguugggacagguaaugcugcucgugcugugcguuacccaggugcuuaugaugcgaacaacuugggccuuaugugaggcacugacccucgcuacaggcccgaucagcaccuugugggaggggaaccccggaagauuuuggaauacuacgauugccgucuccauggcgaacaucuucaggggcucauaccuggccggugcagggcuacuguuuucuauuaugaagaauacaaccaacacucgccggggaaccggcaauaucggugaaacacucggcgagaaauggaagaguagacuuaacgcucuggggaagucggaauuccaaauauauaaaaagagcggaauccaggagguggaucguacuuuggccaaagagggcauuaagaggggggaaaccgaccaccaugcagucucccggggaucugcuaaacugcgcugguuuguggagcgaaacaugguuacaccagaaggcaaggugguagaucucgguugcgggagaggaggcuggucauacuauugugguggccugaaaaaugugagggaggucaagggguuaacgaagggaggcccugggcacgaagagcccaucccuaugagcaccuacggauggaaccuuguucggcugcaguccggcguggacgucuucuucacuccacccgagaaaugcgauacacuccuaugugacauuggugaaaguucuccuaauccaaccguggaggccgggcgcacucugagaguauugaaccugguggaaaauuggcucaacaauaacacacaauuuugcguuaaggugcuuaaucccuauaugccgagcgucaucgagaaaauggaagcccugcagaggaaguacggaggcgcguuggugcgaaacccucugucacggaauuccacccacgagauguacugggucaguaacgcuacgggcaauauagugagcucuguuaacaugauuucccguaugcucaucaauagauucaccaugaaacauaagaaggcaacauaugagccagauguagacuuagggucaggaacucgcaacaucgguauugaaagcgagauacccaaccuggacaucauuggcaaaaggaucgaaaagauuaaacaggagcacgaaaccucguggcauuacgaucaggaccacccuuauaagacaugggccuaccacgggucuuaugagacuaaacaaaccggaagugcuuccagcauggugaauggcgucgugaagcuucugacaaagccaugggauguugugcccauggucacccagauggccaugacugacacgacaccguuuggucagcagcggguguucaaagagaagguagauaccagaacucaagaaccuaaagaggggaccaagaaacuaaugcgcaucacagcagaauggcucuggaaggagcugggaaggaagaaaacgccccgaauguguacccgggaggaauuuacuagaaaggugaggucaaacgccgcuuugggcgcgauauucacagacgagaauaaauggaaguccgcccgcgaagcaguugaggauucucguuuuugggaacuggucgaccgggagagaaaccuccaucuugagggcaaaugcgaaaccuguguguacaauaugauggggaagagggagaaaaagcugggagaauucgguaaggcuaaaggcagccgcgccaucugguauaugugguuaggggcacgauuucuggaguucgaagccuugggauuucucaacgaggaucacugguucagucggggcaauucccugagcgguguggagggggaaggacuacauaagcuuggcuacauucugagagacgucucuaaaaaggagggcggggcuauguacgccgaugacacugcgggaugggacacaaggaucacccucgaagaucugaaaaacgaggaaaugguuacaaaucacaugaagggugagcauaagaaauuggcagaggccauuuuuaagcugacuuaucagaacaaagugguacgcgugcagagaccaaccccucggggcacggucauggacaucauuucaaggaaggaucagcgugggaguggacaagugggcaccuacggucucaauacauucacuaacauggaagcucagcuuauacgacagauggagggggaaggaaucuucaaauccauucaacgccugaccguuacagaggagaucgccgugcagaauugguuagcaagagucggccgggaaaggcugagccgcauggcuaucucuggcgacgauugcgugguaaagcccuuggacgauagauuugccucggcucucacugcccugaacgacauggggaagguucggaaagauauucagcagugggagccaucaaggggauggaaugacuggacccaagugcccuucugcagccaccacuuucaugaacuagucaugaaggauggucgagugcuuguggucccuugucguaaccaggacgagcugauaggcagagcacgcaucucccagggggcgggauggagucucaaagaaacggccugccugggcaagucuuaugcucagauguggacauugauguacuuccaccggagggauuuaagacuggccgcaaacgcuauuuguagcgccguuccaucccauugggugccgaccucacgcacuacauggaguauccacgcaaaacacgaguggaugaccacugaggacaugcucgccguauggaaucggguguggauucaagaaaaccccuggauggaggacaagaccccugucgaaucuugggaggaagugccauaucuugguaagagggaggaucaguggugcgggagccugaucggacuaacaucccgagcgacgugggcuaaaaauauacagaccgccaucaaccagguuagaucacugauuggcaaugaggaauacacugacuauaugcccagcaugaagcgguuuaggaaagaggaagaggaagcaggcgugcucugguga

SEQ ID NO: 14711 - RNA, 9876 nt, Artificial Sequence
  derived and/or modified CDS sequence (opt3) from DENV-2__EU482720__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaccauggccgcaaucuuggccuacacgauuggcacuacacacuuucagcgcgcucucaucuucauucugcugaccgcaguugccccauccaugacuaugagaugcaucgggauaucuaacagggauuuuguggaaggagucucggguggcucauggguggacauuguacucgagcacgggagcuguguuacaaccauggcuaagaauaagcccacguuagauuucgaacugaucaaaaccgaggccaagcagccugcgacacuucggaaauauugcauugaagcaaaguugacuaacaccacaacugagagucgcuguccaacccaaggagagcccucccugaaugaagagcaggacaaacgauuuaucugcaagcauucuaugguggauagaggcugggguaacggguguggacuauucggcaagggcgggaucgucacaugcgccauguuuaccugcaaaaagaauauggaaggaaaaguggugcucccugagaaccuggaauacacuauugucauaacgccacacagcggugaggagcaugcuguuggcaaugacacagggaagcacggaaaagaaaucaagauuaccccgcaguccucaaucacugaggccgaacuuaccggcuaugguacagugaccauggaguguagucccaggacugggcuggauuucaacgaaaugguauugcuccagauggaggacaaagcauggcuggugcaccggcaaugguuuuuagaucugccucucccauggcuucccggcgcugacacacagggaagcaauuggauacagaaggagacgcuggucaccuucaagaacccucaugccaaaaagcaggacgugguuguguugggcucucaagaaggggcgaugcacacugcccuaacaggagcaaccgagauucagauguccucagguaaucugcucuuuacaggccaucugaaaugccgucuucgcauggauaagcugcaguugaaagggaugagcuacaguauguguacuggaaaguucaagaucgucaaagaaaucgcugagacccaacacggcacgauugugaucagaguacaguaugagggugacgggucuccaugcaagauucccuucgaaauaauggaucucgagaaaaggcauguucugggccgguuaaucaccgugaacccgauugccacagaaaaggacuccccugucaacaucgaggcugaacccccauuuggagauagcuacaucauuauaggcguggagccugggcagcugaaacuaaauugguucaagaagggaucgucuaucggucagauguuugagacuaccaugcgaggcgccaaacgcauggcaauucucggggacacagccugggauuucggaucccugggcggugucuuuacuucaaucgggaaggcucuucaccaaguguucggcgcgauuuacggagcagccuuuaguggcguuagcuggaccaugaaaaucuugauaggggugaucauuacguggaucggaaugaacuccagaucuacaagccugucaguaagucucguccuggugggcauuguuacccuuuaucugggugugaugguccaggcugacacugggugugugguauccuggaagaauaaagaauugaagugcggaagcggcaucuucauaacagauaacgugcacaccuggacugagcaguacaaguuucagcccgaaucuccaucaaaacucgccagugcaauucaaaaggcccaugaggaagguaucuguggcauuaggagcguuacccggcuggagaauuuaauguggaaacagaucacacccgagcugaaccacauacuauccgaaaaugaggucaagcucacgaucaugaccggggacauuaaaggaaucaugcaggcuggcaagcgcucucugagaccucagccaacugaacuuaaauauucguggaagacaugggggaaggccaaaauguugagcaccgagucccauaaccaaacauuccugauugauggaccggaaacugcagagugccccaauaccaacagggcguggaauucacucgagguggaagacuacggcuuugguguguucaguacgaacaucuggcugaaguuacgugagaaacaggacgucuuuugugauucuaagcugaugagcgcugccauaaaagacaaucgggcaguucacgccgauaugggguauuggauugaauccgcucuuaacgacacauggaagauggagaaggccucauucaucgagaucaaaagcugccacuggccuaagucucauaccuugugguccaauggagugcucgaaagugagaugauuaucccaaaaaacuucgcaggccccgugagccagcacaacuaccgaccugguuaucauacucagaccgcuggcccauggcaccuggggaagcuagaaauggauuuugacuucugugagggaacaacuguagucgugaccgaagauugcggcaauagagggcccucucugaggacaacgaccgccuccggaaaacucauuacugaguggugcugucgcucaugcacacugccgccucuucgguacagaggcgaggacgguuguugguacgggauggaaauaaggccauugaaggagaaggaagagaaccugguuaauaguuuagugaccgcgggacauggccaaaucgauaacuuuagccucgguguccugggcauggcccuuuuccuggaagagauguugcgcacucgaguggggacaaaacacgcuauucuccugguugcagugucguuuguaacccuaaucacgggaaauauguccuuccgggaccugggccgugucauggugauggugggggccacuaugaccgaugacauuggaaugggcgucacauaucucgcucugcuugccgcauuuaagguuagacccaccuucgcggccgguuugcuguuaaggaaacucacuucuaaggagcugaugauggcuacaaucgggauagcccuucugagccagucaaccaucccugaaacaauucuagagcucacugaugcacuggcuuugggaaugauggugcugaaaaucguacgcaacauggaaaaguaccaguuagccgugaccauuauggcaaucaguugcguccccaaugccgugauacuccaaaacgcuuggaagguuuccuguacgauucuggcggccgugucugucagcccacuucuguugacauccucacagcagaaagcagacuggaucccucucgcucugaccaucaagggccuaaaucccacugccauuuuucugaccacacuuagccggacuaguaaaaagagaucuuggccacucaacgaggccgugauggcuguuggcaugguguccauacuggcaagcucguugcugaaaaaugacaucccgaugaccgggccuuuagucgccggaggucuccugacgguaugcuaugugcuuacaggcaggucagcggaucuggaauuggagaaggcugccgacguuaaaugggaggaucaggcagaaauuucugggaguucccccauccucagcauuaccaucucugaggacggaagcauguccauaaagaacgaagaggaggaacacacucugacaauccuaauucgaaccggccugcuugugaucucaggugucuucccagugaguauucccaucacugccgcugcaugguaccucugggagguaaagaaacaacgcgccggggugcugugggaugucccuagcccacccccuguuggaaaggcggaauuggaggacggcgcuuaucggauaaaacagagaggcauuuuuggguacucucagaucggagccgguguguauaaggaaggcacauuccauaccauguggcacgugacgaggggggcagucuuaaugcaucguggaaaacgcaucgagccguccugggccgaugugaagaaggaccugauuucauacggcgguggguggaaacucgagggagaauggaaggagggcgaagagguucagguacuggcucuugaaccaggcaaaaauccccgggccgugcaaacuaagccugggcuguuuaaaaccaacacaggaaccaucggugcagucaguuuggauuucagcccaggcacauccgggucucccauaguggacagaaagggaaagguugugggccuauacgguaauggggucgugacuaggucgggagcuuauguaagcgccauugcgcagaccgagaaaucaaucgaggauaacccugaaauugaggacgauaucuuccgaaagaaacggcugacgauaauggaccuccacccgggcgccggcaagacaaaacgcuaccugcccgcaauugucagagaagcuaucaagagggggcuucggacuuuaauccuggccccaacccgagugguugcugcagagauggaagaggcccucagaggauugccuauucgcuaucagacacccgccaucagggcugagcauaccggucgugaaauuguggaccugaugugucacgcgacuuuuaccaugcggcuccuguccccagucagagugccuaacuacaaucuuauaaucauggaugaggcacacuucacagaccccgccaguauugcugccaggggcuauaucucuacgcgcguugaaaugggggaggcagccggaaucuuuaugacugcuaccccaccgggcagccgagauccuuucccccaguccaacgcgccaauuauggacgaggaaagagagauacccgaacggucauggaauucuggucaugagugggugacagauuuuaaggggaaaaccgucugguucgugccuagcaucaaggccggaaacgacauugcagcuugccugaggaaaaauggcaagaaaguaauccaauugagucgcaagacuuuugauuccgaauacgugaagacacgugccaacgacugggauuucguugucaccacggacauuagcgagaugggcgcaaauuuuagagccgagcgggugaucgauccaaggcgcuguaugaaacccgugauacuaacugacggggaagagcgagucauccuggcuggaccuaugccgguaacacacucuucagccgcgcagagacgggguaggauuggccgcaacccaaagaaugaaaacgaccaguauaucuacaugggggagccccucgaaaaugaugaggacugcgcacauuggaaagaggccaagauguuacuggauaacauuaauaccccugaaggaaucauacccuccauguucgagccagaaagagagaaaguggacgcuauugauggcgaauacaggcuucggggugaggcccguaagaccuuuguugaccugaugcgccgaggggaucucccugugugguuggcuuauagagucgcagccgagggcaucaacuacgcugacaggcggugguguuucgauggaauuaaaaauaaccaaauccuggaagagaacguggaaguugagauauggacuaaggagggcgaacgcaagaaacucaagcccagauggcuggacgccaggacauauagugauccacuugcacuaaaagaguucaaggaauuugcggccgggcggaaaagccugaccuugaauuuaaucacagagaugggacgacugccuacuuucaugacgcagaaggcuagagacgcccucgauaaccuggcagugcuucacaccgcugaagucgguggccgcgccuacaaucacgcacugucggagcucccggagacauuggaaacucugcuacugcucacccuucuggccacagugaccgggggaauuuuuuuauucuugaugucuggcaaggguaucgggaaaaugacucugggcaugugcugcauuaucacggcuuccauacuccugugguaugcgcagauucagccccauuggaucgccgcaagcaucauucuugaguuuuuccugaucguacucuugauaccagaaccugagaagcaaaggaccccccaggacaaccagcugacauacgugguuauugcuaucuuaacugucguggccgccaccauggcaaaugaaaugggauuucuagagaaaacaaagaaagaccugggccucgggucaauuaccacucaggagagugaaucuaacauccuugauauagaccugcggccagcuuccgccuggacauuguaugcgguggcuacgaccuucgucacuccuaugcugcgucacagcaucgagaauucaaguguuaacgugagccucacagccauugcaaaucaagccaccguacugaugggacuugguagaggcuggccccucuccaagauggauaucggggugccgcuguuggcuauuggauguuacucucaggucaacccaaucacccugacagcagccuuacuacugcucguggcgcauuacgcuauuaucggcccuggucuucaggccaaggcaacuagggaagcccagaaacgcacggcugccgggauaaugaagaaucccaccguugacggcauuacagugaucgaucuggagccaauccccuaugacccuaaauuugaaaagcaauugggacaggucaugcugcucguacugugcgugacucagguucuuaugaugcggaccacaugggcauuaugugaggcucugacccucgccacuggcccgauuagcacguugugggaggggaaccccggacgauucuggaauacaaccauagcgguguccauggccaacaucuuuagaggcucauaccuggcaggugcugggcuacuguucucuauuaugaaaaauacuaccaacacaaggcgcggaacuggcaauaucggugaaacccucggcgagaaguggaagagucggcuuaacgcccuggggaaaucggaauuucagauuuauaagaaaagcggaauccaagaggucgauagaacauuggcaaaggagggcauaaaacguggggaaacggaccaccaugcuguguccaggggaucugccaagcugcggugguucgucgagcgcaacauggugaccccagaaggcaaaguuguggaucucgguugcgggcgaggaggcuggucauacuauugugguggccugaagaauguaagagaggugaagggguuaacuaaaggaggcccugggcacgaagagcccaucccuaugagcacauacggauggaaccuugucaggcugcaguccggcguugacguguucuuuaccccacccgagaagugcgauacucuccuaugugacauuggugaaaguucuccuaauccaacaaucgaggccgggcggacccugcgcgucuugaaccugguggaaaauuggcucaacaauaacacgcaguucugcguaaaagugcuuaaucccuauaugccgagcguuauugagaagauggaaacccugcaaagaaaauacggaggcgcguuggugaggaacccucugucacgaaauuccacacacgagauguacugggucaguaacgcuacuggcaauaucgugagcucugucaacaugauaucccggaugcucauuaaucguuuuaccaugaagcauaagaaagcaacauaugagccagauguggacuuagggucaggaacuagaaacaucgguaucgaaaacgagauucccaaucuggacauaaucggcaagcgcauugaaaaaaucaagcaggagcacgaaaccagcuggcauuacgaucaggaccacccuuauaaaacaugggccuaccacgggucguaugagaccaagcagacuggaucugcuaguuccaugguuaacggcguagugaagcuucugacgaaaccaugggaugucgugcccaugguuacacaaauggccaugaccgacacuaccccguucggucagcagaggguguuuaaggagaaagucgauacacggacgcaggaaccuaaggaggggaccaaaaagcuaaugagaauuacugcagaauggcucuggaaggagcugggaaaaaagaaaacaccccgcauguguaccagggaggaauucacucgaaaggugcggagcaaugccgcuuugggcgcgaucuuuacagacgagaacaaauggaagucagccagagaagcaguagaggauuccagguucugggaacugguggaccgcgagcguaaucuccaucuugagggcaaaugcgaaaccuguguuuacaacaugauggggaagcgggagaagaaacugggagaauuugguaaggcuaaaggcucuagagccauaugguauaugugguuaggggcaagguuccuggaguuugaagccuugggauuccucaaugaggaucacugguuuagccgcggcaacagucuguccggugucgagggggaaggacuacauaagcuuggcuacauccugcgagacgugagcaaaaaggagggcggggcuauguacgccgaugacacagcgggaugggacacucggauuacccucgaagaucugaagaaugaggaaauggugacgaaccacaugaaaggugagcauaagaaauuggcagaggccaucuucaagcugaccuaucaaaauaaagucguuagagugcagaggccaacaccucgcggcacuguaauggacauuaucucuagaaaggaucagcgggggucaggacaggugggcaccuacggucucaacacauucacuaauauggaagcucaacuuauuaggcagauggagggggaaggaauauuuaagaguauccagcgucugaccgucacggaggagauugccgugcaaaacugguuagcacgaguuggccgcgaaagacugucccggauggcuaucagcggcgacgauugcguggucaaacccuuggacgauagguucgccucugcucucacagcccugaaugacauggggaaggugcgcaaagauauccagcagugggagccaucgagaggauggaacgacuggacccagguacccuuuugcucacaccacuuccaugaacuaguuaugaaggauggucggaugcuuguggucccuuguaggaaccaagacgagcugauuggccgagcacguauaagccagggggcgggauggucccucaaagaaacugccugccugggcaagaguuaugcucagauguggacauugauguacuuucacagacgcgauuuacggcuggccgcaaaugcuaucuguucugccgugccaagccauugggugccgaccuccaggacuaccuggucaauucacgcaaagcacgaguggaugacaacggaggacaugcucgccgucuggaacagaguuuggauccaggaaaaucccuggauggaggacaaaaccccuguggaaaguugggaggaaguaccauaucuugguaagcgcgaggaucaauggugcgggucucugauuggacuaacuagccgggcgacaugggcuaaaaacauccagaccgccauaaaucaggugaggucccugaucggcaacgaggaauacacugacuauaugcccucaaugaagcgauucagaaaagaggaagaggaagcaggcguccucugguga

SEQ ID NO: 14712 - RNA, 9876 nt, Artificial Sequence
  derived and/or modified CDS sequence (opt3) from DENV-2__EU482721__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaccauggccgcaaucuuggccuacacgauuggcacuacacacuuucagcgcgcucucaucuucauucugcugaccgcaguugccccauccaugacuaugagaugcaucgggauaucuaacagggauuuuguggaaggagucucggguggcucauggguggacauuguacucgagcacgggagcuguguuacaaccauggcuaagaauaagcccacguuagauuucgaacugaucaaaaccgaggccaagcagccugcgacacuucggaaauauugcauugaagcaaaguugacuaacaccacaacugagagucgcuguccaacccaaggagagcccucccugaaugaagagcaggacaaacgauuuaucugcaagcauucuaugguggauagaggcugggguaacggguguggacuauucggcaagggcgggaucgucacaugcgccauguuuaccugcaaaaagaauauggaaggaaaaguggugcagccugagaaccucgaauacacuauugucauaacgccacacagcggugaggagcaugcuguuggcaaugacacagggaagcacggaaaagaaaucaagauuaccccgcaguccucaaucacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaagcuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaauggauuuggagaaaaggcauguucucggccggcugaucaccgugaacccgauugucacagaaaaggacuccccugugaacaucgaggccgaacccccauuuggagauagcuacaucauuauaggcgucgagccugggcaguuaaaacugaauugguucaagaagggaucgucuaucggucaaauguuugagacuaccaugcgaggcgcuaaacgcauggccauucuaggggacacagcaugggauuucggaucccucggcgguguguuuacuucaaucgggaaggcccugcaccagguuuucggcgcuauuuacggagcggcauuuaguggcgugagcuggaccaugaaaauccuuauagggguaaucauuacguggaucggaaugaacuccagaucuacaagcuugucagucagucuggugcucguuggcauugugacccuguaucuuggugucauggugcaggccgacacuggguguguaguguccuggaagaauaaagaacugaagugcggaagcggcaucuucauaacagauaacguucacaccuggacugagcaguacaaguuucaacccgaaucuccaucaaaauuggcuagugccauucagaaggcacaugaggaagguaucuguggcauuaggagcgucacccggcucgagaaucugauguggaaacagaucacacccgaguuaaaccacauacuguccgaaaaugaggugaagcuaacgaucaugaccggggacauuaaaggaaucaugcaggccggcaagcgcucucucagaccucaaccaacugaacugaaauauucguggaagacaugggggaaggcuaaaaugcuuagcaccgagucccauaaccagacauucuugauugauggaccggaaacugccgagugccccaauaccaacagggcauggaauucacuggagguggaagacuacggcuuuggugucuucaguacgaacaucuggcucaagcugcgugagaaacaggacguuuuuugugauucuaaguuaaugagcgcggcuauaaaagacaaucgggccgugcacgcagauaugggguauuggauugaauccgcccugaacgacacauggaagauggagaaggcuucauucaucgagaucaaaagcugccacuggccuaagucucauacccuuugguccaauggaguguuggaaagugagaugauuaucccaaaaaacuucgccggccccguaagccagcacaacuaccgaccugguuaucauacucaaaccgcaggcccauggcaccucgggaagcuggaaauggauuuugacuucugugagggaacaacugucgugguuaccgaagauugcggcaauagagggcccucucuaaggacaacgaccgcuuccggaaaacugauuacugaguggugcugucgcucaugcacacucccgccucugcgguacagaggcgaggacgguuguugguacgggauggaaauaaggccacuuaaggagaaggaagagaacuuggugaauagucuggucaccgccggacauggccagaucgauaacuuuagcuuaggugugcucggcauggcgcuguuccuugaagagaugcugcgcacucgaauugggacaaaacacgccaucuugcucguugcugugucguuuguaacccugauuacgggaaauauguccuuccgggaccuaggccgugucauggugauggugggggcaacuaugaccgaugacaucggaaugggcgucacauaucuggcccuccuggcugccuuuaagguuagacccaccuucgcagcgggucuuuugcugaggaaauuaacuucuaaggagcucaugauggccacaauagggaucgcucugcuuagccagucaaccauuccugaaacaauccuggagcuaacugaugcccucgcacugggaaugaugguguugaaaauuguacgcaacauggaaaaguaccaacuggcugugaccaucauggccauaaguugcguccccaaugcagugauuuuacagaacgccuggaagguuuccuguacgauccucgcugcggugucugucagcccacugcuucugacauccucacagcagaaagccgacuggaucccuuuggcacucaccauuaagggccugaaucccacugcuauauuucuaaccacacugagccggacuaguaaaaagagaucuuggccacuuaacgaggccaucauggccgugggcaugguuuccauucucgcuagcucgcuguugaaaaaugacaucccgaugaccgggccucugguggcaggagguuuacucacggucugcuauguacugacaggcaggucagccgaucuugaacuggagcgagcggcugacgugaagugggaggaucaagccgaaauuucugggaguucccccaucuugagcauaaccaucucugaggacggaagcauguccauuaaaaacgaagaggaggaacacacucucacaauccugauucgcaccggccuacugguuaucucagguguguucccagucaguauacccauuacugcagccgcuugguaccuuugggaggugaagaagcagcgggcagggguacucugggaugugccuagcccacccccugucggaaaagccgaacuggaggacggcgcguauagaaucaagcagaggggcaucuuuggguacucucagauuggagcugguguuuauaaagaaggcacauuccauaccauguggcacgugacgcguggggccguguugaugcaucgcggaaagcggaucgagccguccugggcagaugucaaaaaggacuuaauaucauacggcgguggguggaagcuggagggagaauggaaagagggcgaagaggugcaaguucucgcccuggaaccaggcaagaaucccagagcuguacagacuaaaccugggcuuuuuaagaccaacacaggaaccauuggugccgugagucuggauuucagcccaggcacauccgggucucccaucgucgacaggaaaggaaaggugguuggcuuguacgguaaugggguggucacucgaucgggagcauaugugagcgcuauugcccagaccgagaagucaaucgaggauaacccugaaauagaggacgauauuuuccggaaaaagcgccuaacgaucauggaccugcacccgggcgcgggcaaaacaaagagauaccuccccgccaucguaagggaagcaauuaaacgggggcugcgaacucuuaucuuagcuccaaccagagucguggccgcugagauggaagaggcacugcgcggacucccuauuagguaucagacacccgccauacgugccgagcauaccggucgggaaaucguugacuugaugugucacgcuacuuuuaccaugagacugcucuccccagugagggucccuaacuacaaucugauuaucauggaugaggcgcacuucacagaccccgcaaguaucgccgcucgcggcuauauuucuacgcgaguggaaaugggggaggccgcaggaauauuuaugacugccaccccaccgggcagcagagauccuuucccccaauccaacgcuccaaucauggacgaggaacgggagauucccgaaaggucauggaauucuggucaugaguggguuacagauuuuaaggggaagaccgugugguucgucccuagcaucaaagcgggaaacgacauugccgcaugccuucgcaagaauggcaaaaaggugauccagcugagucguaaaacuuuugauuccgaauacguaaagacaagagcuaacgacugggauuucgugguuaccacggacauaagcgagaugggcgccaauuuucgggcagagagggucaucgauccacgccgauguaugaagcccgugauuuugacugacggggaagagagagugauccuagccggaccuaugccggucacacacucuucagcugcccagcggaggggucgcauuggcagaaacccaaaaaaugaaaacgaccaauauaucuacaugggggagccccuggaaaaugaugaggacugcgcgcauuggaaggaggcaaaaaugcucuuagauaacauaaauaccccugaaggaauuauccccuccauguucgagccagaaagggagaagguagacgccauugauggcgaauaccggcugcguggugaggcucgcaaaaccuuuguggaccuuaugcgaagaggggaucugccuguuuggcucgccuauaggguggcugcagagggcaucaacuacgccgaccggcgcugguguuucgauggaauaaagaauaaccagaucuuggaagagaacgucgaaguggagauuuggacuaaagagggcgaaagaaagaagcugaaacccagguggcucgacgcucggaucuauagugauccacuggcccuuaaggaguucaaagaauuugcagcggggcgaaagagccuaacacugaauuugauuaccgagaugggaagauuaccuacauucaugacucagaaagcccgcgacgcucuggauaaccucgccguucugcacacggcagaagcugguggcagggccuacaaucacgcacuuucggagcugccggagacccucgaaacauugcugcuacugacucuccuugccaccgugacagggggaaucuuucuguucuuaaugucuggcaaggguauagggaagaugaccuugggcaugugcugcauuaucacugcuuccauccugcucugguaugcgcagauucaaccccauuggaucgccgcaagcauaauucuggaguuuuuccuuaucguccugcucauuccagaaccugagaaacagcggacgccccaggacaaccaguugaccuacgugguaaucgcuauacugacagugguugccgccacuauggcaaaugaaaugggauuuuuagagaagaccaaaaaggaccuaggccuggggucaaucacaacccaagagagugaaucuaacauucucgauaucgaccuucguccagcuuccgccuggacucuguaugcggucgcuacaacguucgugaccccuauguugagacacagcauugagaauucaagugugaacgucagccugacugccaucgcaaaucaggccacaguucucaugggacuggguaaaggcuggccccuuuccaagauggauauuggggugccgcuccuggcuaucggauguuacucucagguaaacccaauaaccuugaccgcagcccuguuacuacugguggcgcauuacgcuauuaucggcccuggucuccaggccaaggcaacaagggaagcccaaaaacgcgcugccgcagggaucaugaagaaucccacugucgacggcauuacggugauagaucuugagccaauccccuaugacccuaaauuugaaaagcagcugggacagguuauguugcugauucucugcgugacccagguccugaugaugcggacaacuugggcucuuugugaggccuuaacccuggcgacaggcccgaucagcacccucugggaggggaaccccggacgauucuggaauacuacgauugccguauccauggcaaacaucuuuagaggcucauacuuggcuggugccgggcugcuauucucuauaaugaaaaauacaaccaacacuaggcgcggaaccggcaauaucggugaaacacugggcgagaaguggaagagucggcucaacgcacuugggaaaucggaauuucaaauuuauaagaaaagcggaauccaggagguggauagaacucuggcuaaggagggcauuaaacguggggaaaccgaccaccaugccguuuccaggggaucugccaaguugcggugguucguggagcgcaacauggucacaccagaaggcaaaguggucgaucuggguugcgggcgaggaggcuggucauacuauugugguggccucaagaaugugagagagguuaaggggcugacgaaaggaggcccugggcacgaagagcccaucccuaugagcaccuacggauggaacuuagugaggcuucaguccggcguagacguguucuuuacuccacccgagaagugcgauacacugcucugugacauaggugaaaguucuccuaauccaaccauugaggcggggcggacucuacgcguccugaacuugguugaaaauuggcugaacaauaacacacaauucugcaucaaagugcucaaucccuauaugccgagcgucaucgagaagauggaagcucuucagagaaaauacggaggcgcacuggugaggaacccuuugucacgaaauuccacccacgagauguacuggguaaguaacgccacgggcaauauugugagcucuguuaacaugauaucccggaugcugaucaaucguuuuaccaugaagcauaagaaagcuacauaugagccagauguggaccucgggucaggaacuagaaacauugguaucgaaagcgagauucccaacuuagacaucauaggcaagcgcaucgaaaaaauuaagcaggagcacgaaaccucguggcauuacgaucaggaccacccuuauaaaacaugggccuaccacgggucuuaugagacuaagcaaaccggaagugcauccagcauggucaauggcguggucaggcugcuuacaaagccaugggaugugguucccaugguaacccagauggccaugacugacacgacaccguucggucagcagcggguguuuaaagagaaggucgauaccagaacucaagaaccuaaagaggggaccaagaaacugaugaagaucacagcugaauggcuauggaaggagcucggaaaaaagaaaacgccccgcauguguaccagggaggaauucacucgaaaggugcggucaaacgcggcccugggcgcaauuuuuacagacgagaauaaauggaaguccgcuagagaagccguugaggauggcagguucugggaauugguggaccgcgagcguaaccugcaucucgaggggaaaugcgaaaccugugucuacaauaugaugggaaagcgggagaagaaacuuggugaauuuggcaaggcaaaagggucuagagccaucugguauauguggcugggagcuagguucuuagaguuugaagcccugggcuucuugaacgaggaucacugguuuagccgcgguaauagucucuccgggguggagggagaaggccugcaucgacuaggcuacauucuucgggacguaagcaagaaagaggggggagcgauguacgcagaugacacugccgguugggacacaagaauaacccuggaagaucucaagaacgaggaaauggugacaaaucacaugaagggcgagcauaaaaagcuggcugaggccaucuucaaauugacuuaucagaacaagguugucagggugcagcgcccaaccccuagagggacggugauggacauuaucucucggaaagaucagaggggaucaggccaagucgguaccuacgggcugaauacauucacuaacauggaagcacagcucauccgucagauggagggagaaggcauuuuuaagaguauacaacgacuuaccguuacagaggagaucgcugugcagaauuggcuggcccgcguaggcagagaacgguuauccaggauggcuauuagcggggacgauugcguggucaagccccuggacgaucgcuucgccucugcauugacugcgcucaacgacaugggaaaagugagaaaggauauccagcagugggagccaucgcgggguuggaaugacuggacccaaguucccuuuugcucacaccacuuccaugaacuggugaugaaagauggcaggaugcuagucgugccuugucgaaaccaggacgagcuuauugggcgugccagaaucagccagggagcuggcuggucccugaaggaaacggccugccucgguaaaaguuaugcacagauguggacacugauguacuuucaccgccgggauuugagguuagcugccaacgcaauauguucugccguaccaagccauuggguuccgaccuccagaacuacauggucaauccacgcgaagcacgaguggaugaccacugaggacaugcuggcuguguggaaucgcgucuggauucaagaaaaccccuggauggaggacaagaccccuguggaaaguugggaggaagugccauaucucgggaaacgggaggaucaguggugcggaucucuuaucggccugacaagcagggccacgugggcaaagaauauucagaccgccaucaaccagguccgaucccuaauaggcaaugaggaauacacugacuauaugcccucaaugaaaagauuccggaaggaggaagaggaagcugggguucugugguga

SEQ ID NO: 14713 - RNA, 9876 nt, Artificial Sequence
  derived and/or modified CDS sequence (opt3) from DENV-2__EU482722__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagaucaaaucuugccacuggccuaagucccauacguuguggaguaauggaguacucgaaagcgagaugauuaucccaaaaaacuucgccggccccgucucucagcacaacuaccgaccugguuaucauacacagaccgcaggcccauggcaccuggggaagcuagaaauggauuuugacuucugugagggaacuaccgugguugugacagaagauugcggcaauagagggcccucccugaggacuaccacagcuucaggaaaacucauuacggaguggugcugucgcaguugcacccugccgccucuucgguacagaggcgaggacgguuguugguacgggauggaaauaaggccauugaaggagaaggaagagaaccuggucaauagcuuagugacugccggacauggccaaaucgauaacuuuucgcucgguguucugggcauggcgcuuuuccuggaagagauguugcgcacacgaguggggaccaaacacgccauucuccugguagcugucuccuuugugacucuaaucacaggaaauaugucuuuccgggaccugggccgugugauggucaugguuggggcaaccaugacggaugacauuggaaugggcgugacuuaucucgcccugcuugcugccuuuaagguaagacccaccuucgcagcggguuugcuguuaaggaaacucacaagcaaggagcugaugauggccaccaucgggauagcucuucugucacagaguacuaucccugaaacaauucuagagcucaccgaugcccuggcauugggaaugauggugcugaaaaucguccgcaacauggaaaaguaccaguuagcugugacaauuauggccaucuccugcguucccaaugcagugauacuccaaaacgccuggaaggucucuuguacuauucuggcugcggugagcguuuccccacuucuguugaccucaagccagcagaaagccgacuggaucccucucgcacugacgaucaagggccuaaaucccacagcuauuuuucugaccacucuuagucggaccucuaaaaagagauccuggccacucaacgaggccgugauggccgucggcaugguaagcauacuggcuucgucauugcugaaaaaugacaucccgaugacagggccuuuaguggcaggaggucuccugacuguuugcuaugugcuuaccggcaggucugccgaucuggaauuggagcgagucgcggacgugaagugggaggaucaggcugaaauuaguggguccagccccauccucucuauuacgaucagcgaggacggauccaugucaauaaaaaacgaagaggaggaacacacacugaccauccuaauucgcacuggccugcuuguaaucagugguguguucccagucagcauucccaucacagccgcagccugguaccucugggagguuaagaagcaacgggcuggggugcugugggaugugccuucuccacccccugucggaaaagcagaauuggaggacggcgccuauagaauaaagcagaggggcauuuuuggguacucccagaucggagcggguguguauaaagaaggcaccuuccauacuauguggcacguuacacguggggcuguauuaaugcaucgcggaaagcggaucgagccgucaugggccgaugugaaaaaggaccugauuaguuacggcgguggguggaagcucgagggagaauggaaagagggcgaagagguccaggugcuggcacuugaaccaggcaagaaucccagagccguucaaaccaaaccugggcuguuuaagacgaacacuggaaccaucggugcugugagcuuggauuucuccccaggcacaucugggucgcccauagucgacaggaaaggaaaggugguaggccuauacgguaauggggucgugacccgaagcggagccuauguuucagcaauugcucagacagagaaguccaucgaggauaacccugaaauugaggacgauaucuuccggaaaaagcgccugacuauaauggaccuccacccgggcgccggcaaaaccaagagauaccugcccgcgauugugagggaagccaucaaacgggggcuucgaacguuaauccuggcaccaacaagagucguggcugccgagauggaagaggcucuccgcggauugccuauuagguaucagacucccgcaauccgugccgagcauaccggucgggaaauuguugaccugaugugucacgccacauuuaccaugagacuccugaguccagugagggucccuaacuacaaucuuauaaucauggaugaggcucacuucacugaccccgcgucuauugcagcccgcggcuauaucagcacccgaguggaaaugggggaggcugccggaaucuuuaugacagcaacgccaccgggcuccagagauccuuucccccagucaaacgccccaauuauggacgaggaacgggagauacccgaaaggucuuggaauagcggucaugaguggguaacugauuuuaaggggaagaccgugugguucguuccuaguaucaaagcuggaaacgacauugcggccugccugcgcaagaauggcaaaaaggucauccaauugucccguaaaacauuugauagcgaauacgugaagaccagagcaaacgacugggauuucguggucacuacagacauuucugagaugggcgcuaauuuucgggccgagaggguaaucgauccacgccgauguaugaagcccgugauacuaaccgacggggaagagagaguuauccuggcaggaccuaugccggugacgcacucauccgccgcucagcggaggggucgcauuggcagaaacccaaaaaaugaaaacgaccaguauaucuacaugggggagccccucgaaaaugaugaggacugcgcccauuggaaggaggcgaaaauguuacuggauaacauuaauacuccugaaggaaucauacccaguauguucgagccagaaagggagaaggucgacgcaauugauggcgaauaccggcuucguggugaggcccgcaaaacauuuguggaccugaugcgaagaggggaucucccuguuugguuggcuuauaggguggccgcugagggcaucaacuacgcagaccggcgcugguguuucgauggaauuaagaauaaccaaauccuggaagagaacgucgaaguggagauauggaccaaagagggcgaaagaaagaagcucaaacccagguggcuggacgcccggaucuauagcgauccacuugcucuaaaggaguucaaagaauuugccgcagggcgaaagacccugacuuugaauuuaauuacagagaugggaagacugccuaccuucaugacacagaaagcgcgcgacgcccucgauaaccuggcuguacuucacacugccgaaguggguggcagggcauacaaucacgcucugucggagcucccggagacguuggaaacccugcuacugcucacacuucuggccacuguuaccgggggaaucuuuuuauucuugaugucuggcaaggguauugggaagaugacacugggcaugugcugcaucauaaccgcauccauucuccugugguaugcccagauccagccccauuggaucgcugcgagcauuauccuugaguuuuuccugauaguccucuugauuccagaaccugagaaacaacggacuccccaggacaaccagcugacguacguggugaucgccauuuuaaccgucguugcagcuacaauggccaaugaaaugggauuucuagagaagacuaaaaaggaccugggccucgggucaaucaccacacaggagagugaaucuaacauacuugauaucgaccugcguccagccuccgcauggaccuuguaugcuguggccacuacauucguaacgccuaugcugagacacagcauugagaauucaagugugaacgucagccucaccgcgaucgcuaaucaagccacugugcugaugggacuugguaggggcuggccccucuccaaaauggauauugggguuccgcuguuggcaaucggauguuacucucaggugaacccaauuacacugaccgccgcuuuacuacugcucgucgcacauuacgccaucauaggcccuggucuucaggcgaaggcuacccgcgaagcccagaagcggacagcagccgggauuaugaaaaaucccacuguagacggcaucacggugaucgaucuggagccaauucccuaugacccuaaguuugaaaaacaauugggacagguuaugcugcucgugcugugcgucacccaggugcuuaugaugcgaacaacuugggcuuuaugugaggcccugacccucgcaacaggcccgauaagcaccuugugggaggggaaccccggaagauucuggaauacuacgaucgcugucuccauggccaacauuuuuaggggcucauaccuggcgggugccgggcuacuguucucuaucaugaagaauacaaccaacacucgccggggaaccggcaauauuggugaaacacucggcgagaaauggaagaguagacuuaacgcacuggggaagucggaauuucagaucuauaaaaagagcggaauacaagagguggaucguacuuuggcuaaagagggcaucaagaggggggaaaccgaccaccaugccguuucccggggaucugcaaaacugcgcugguucguggagcgaaacaugguaacaccagaaggcaagguggucgaucucgguugcgggagaggaggcuggucauacuauugugguggccugaaaaauguuagggaggugaagggguuaacgaagggaggcccugggcacgaagagcccauuccuaugagcaccuacggauggaaccuuguccggcugcaguccggcguggacguauucuuuacuccacccgagaaaugcgauacacuccuaugugacaucggugaaaguucuccuaauccaaccauugaggcugggcgcacucugagaguguugaaccugguugaaaauuggcucaacaauaacacacaguucugcgugaagguccuuaaucccuauaugccgagcgugaucgagaaaauggaaacccugcaaaggaaguacggaggcgccuugguccgaaacccucugucacggaauuccacgcacgagauguacugggugaguaacgccaccggcaauauaguuagcucuguaaacaugauuucccguaugcucaucaauagauuuacaaugaaacauaagaaggcgacuuaugagccagauguggacuuagggucaggaacccgcaacaucgguauugaaaacgagauacccaaucuggacaucauuggcaaaaggaucgaaaagauuaaacaggagcacgaaacaagcuggcauuacgaucaggaccacccuuauaagacuugggcuuaccacgggucguaugagaccaaacagacaggaucugcaaguuccauggucaacggcgugguuaagcuucugaccaagccaugggaugugauccccauggucacucaaauggccaugacggacacaaccccguucggucagcagcggguguuuaaagagaagguagauacuagaacccaggaaccuaaagaggggacaaagaaacuaaugcgcauaacggcugaauggcucuggaaggagcugggaaagaaaaagacccccaggauguguacucgagaggaauucacacggaaagugagaagcaaugccgcauugggcgccaucuuuaccgacgagaacaaguggaaaucagcuagggaagcgguugaggauucccgcuucugggaacuggucgaccgugagcggaaucuccaucuugagggcaagugcgaaacuuguguguacaacaugauggggaaaagagagaagaagcugggagaauuugguaaagccaagggcucuagggcaauuugguauaugugguuaggggcucgcuuccuggaguuugaagccuugggauuccucaaugaggaucacugguuuagccgaggcaacagucuguccgguguggagggggaaggacuacauaaacuuggcuacauccugcgggacgucagcaagaaagagggcggggcaauguacgccgaugacacagcuggaugggacaccagaauuacacucgaagaucugaagaaugaggaaaugguuacuaaccacaugaagggugagcauaaaaaguuggccgaggcgaucuucaaacugaccuaucaaaauaaggugguaagggugcagcgcccaacgccuagaggcaccgucauggacauuauaucucggaaagaucagagggggucaggacaggugggcacauacggucucaacacuuucaccaauauggaagcacaacuuauccgucagauggagggggaaggaauuuuuaagaguauccagcgacugacaguuacugaggagaucgccgugcaaaacugguuagcucgcgucggcagagaacggcuguccaggauggccauuagcggcgacgauugcgugguaaagcccuuggacgaucgcuucgcaucugcucucaccgcccugaaugacauggggaaaguuagaaaggauauacagcagugggagccaucgcggggauggaacgacuggacgcaggugcccuuuugcucacaccacuuccaugaacuagucaugaaagaugguagggugcuuguggucccuugucgaaaccaagacgagcugaucggccgugcuagaauuagccagggggccggauggucccucaaggaaacagcaugccugggcaaaaguuaugcgcagauguggaccuugauguacuuucaccgccgggauuuaaggcuggccgcuaaugccaucuguucugcaguuccaagccauugggugccgacuuccagaacaaccuggucaauucacgcuaagcacgaguggaugacuaccgaggacaugcucgccguauggaaccgcguguggauccaggaaaaucccuggauggaggacaagacaccugucgaaaguugggaggaagugccauaucuugguaaacgggaggaucaauggugcgggucucugauaggacuaacgagcagggcaaccugggccaagaacauccagacugcgauuaaucagguucgaucccugaucggcaacgaggaauacacagacuauaugcccucaaugaaaagauuccggaaggaggaagaggaagcuggcgugcucugguga

SEQ ID NO: 14714 - RNA, 9876 nt, Artificial Sequence
  derived and/or modified CDS sequence (opt3) from DENV-2__EU482723__SS-prME
accgccggagugauaauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccaggacagaaacuuggaugaguagcgagagggcuuggaaacacgugcagcggaucgagaccuggauacugcgccauccuggauucacaaucauggccgcaauuuuggccuacaccaucggcacgacucacuuucagagagcucucauuuucauccugcugacagcaguugccccauccaugaccaugaggugcauaggcauuucuaaccgggauuuuguggaaggggucucgggagguucauggguggacaucguacucgagcacggcagcuguguuacuacaauggcuaagaauaagcccaccuuagauuucgaacugauuaaaacggaggccaagcagccugcgacccuucgcaaauauugcaucgaagcaaaguugacaaacacuaccacagagagucgauguccaacucaaggggagcccucccugaaugaagaacaggacaaaagauuuaucugcaagcauucuaugguggauaggggauggggcaacgguugugggcuauucggaaagggcggcauuguaacaugcgccauguuuacaugcaaaaagaauauggaagggaaaguggugcucccugagaaccuggaauacaccauagucaucacuccacacagcggagaggagcaugcuguugguaaugacacgggcaagcacgggaaagaaauuaagaucacaccgcaguccucaauaaccgaggccgaacuuacuggauauggcaccgugacaauggaguguaguccccggaccggucuggauuucaacgaaaugguauugcuccagauggaggacaaagcauggcuggugcaccgucaaugguuuuuagaucugccucucccauggcuucccggggcugacacucagggcagcaauuggauucagaaggagacacuggucacguucaagaacccucaugccaaaaagcaggacgugguuguguugggaucucaagaaggcgcgaugcacaccgcccuaacuggggcaacagagauccagauguccucaggaaaucugcucuuuaccggucaucugaaaugccgccuuagaauggauaagcugcaguugaaaggcaugagcuacaguauguguacagggaaguucaagaucgucaaagaaauugcugagacucaacacggaaccaucgugauuaggguacaguaugagggcgacgguucuccaugcaagauacccuucgaaaucauggaucucgagaaacggcauguucuggggcgauuaauuacggugaacccgaucgucaccgaaaaggacuccccugugaacaucgaggccgaacccccauuuggcgauagcuacauuauaaucggagucgagccuggccagcugaaacuaaauugguucaagaaggggucgucuauuggacagauguuugagacaacuaugcgcggugcuaaaagaauggccauccucggcgacaccgcaugggauuucgggucccugggaggcguguuuacaucaauugguaaggcccuucaccaaguuuucggggcuaucuacggcgcggcauuuaguggagugagcuggacuaugaaaauauugaucggcguaauuaucaccuggauugggaugaacuccaggucuacgagccugucagucagucucgugcugguuggaguggucacacuuuaucugggcgugaugguacaggccgacuccgguugugugguuagcuggaagaauaaagaauugaagugcgggucuggaaucuucauaaccgauaacguccacacuuggacagagcaguacaaguuucagcccgaaucaccaaguaaacucgcuagcgccauucaaaaggcacaugaggaaggcaucugugguauucgguccgugacccgccuggagaauuuaauguggaaacagaucacucccgagcugaaccacauacuaucugaaaaugaggugaagcucaccaucaugacaggcgacauuaaagggaucaugcaggccggaaagagaucgcugaggccucagccaacggaacuuaaauauagcuggaagaccuggggcaaggcuaaaauguuguccacugagucacauaaccaaacauuccugauugaugggccggaaaccgccgagugccccaauacaaaccgugcauggaauagucucgaggucgaagacuacggauuuggcguuuucucuacuaacaucuggcugaaguuacgggagaaacaggacguguuuugugauagcaagcugauguccgcggcuauaaaagacaaucgagccgugcacgcagauauggguuauuggauugaaucagcccuuaacgacaccuggaagauggagaaggcuagcuucaucgagaucaaaucuugccacuggccuaagucccauacguuguggaguaaugggguacucgaaagcgagaugauuauccccaagaacuucgccggacccgucucucagcacaacuacagaccuggcuaucauacacagaccgcagguccauggcaccugggcaagcuagaaauggauuuugacuucugugaggggacuaccgugguugugacagaagauugcggaaauaggggccccucccugcgcacuaccacagcuucagggaaacucauuacggaguggugcugucggaguugcacccugccgccucuuagauacaggggagaggacggcuguugguacgguauggaaauacgcccauugaaggagaaggaagagaaccuggucaauagcuuagugacugccgggcauggacaaaucgauaacuuuucgcucggcguucuggguauggcgcuuuuccuggaagagauguugcgaacacgggugggcaccaaacacgccauucuccugguagcugucuccuuugugacucuaaucacagggaauaugucuuuccgugaccugggaagagugauggucaugguuggcgcaaccaugacggaugacauugggaugggagugacuuaucucgcccugcuugcugccuuuaagguaaggcccaccuucgcagcgggcuugcuguuacgcaaacucacaagcaaggagcugaugauggccaccaucgguauagcacuucugucacagaguacuaucccugaaacaauucuagagcucaccgaugcccuggcauuggggaugauggugcugaaaaucguccggaacauggaaaaguaccaguuagcugugacaauuauggccaucuccugcguucccaaugcagugauacuccaaaacgccuggaaggucucuuguacuauucuggcugcggugagcguuuccccacuucuguugaccucaagccagcagaaagccgacuggaucccucucgcacugacgaucaagggacuaaaucccacagcuauuuuucugaccacucuuaguagaaccucuaaaaagagguccuggccacucaacgaggccgugauggccgucggcaugguaagcauacuggcuucgucauugcugaaaaaugacaucccgaugacaggcccuuuaguggcagggggacuccugacuguuugcuaugugcuuaccggucgaucugccgaucuggaauuggagcgcgcggcugacgucaagugggaggaucaggccgaaauuaguggcuccagccccauccucucuauuacgaucagcgaggacggguccaugucaaucaagaacgaagaggaggaacacacacugaccauccuaauucggacuggacugcuugugaucaguggcguauucccagugagcauucccaucacagcagccgcuugguaccucugggaggucaagaagcaaagagcugguguucugugggaugugccuucuccacccccuguggggaaagccgaauuggaggacggagcguauaggauaaagcagcguggcauuuuuggcuacucccagaucggggcuggagucuauaaagaagguaccuuccauacuauguggcacgugacacgcggcgccguuuuaaugcaucgggggaagagaaucgagccgucaugggcagaugucaaaaaggaccugauuaguuacggaggcgguuggaagcucgagggggaauggaaagagggagaagaggugcagguccuggcccuugaaccaggcaagaaucccagggcugugcaaaccaaaccuggccuguuuaagacgaacacugggaccaucggagccguuagcuuggauuucuccccagguacaucuggcucgcccauaguggaccgaaaagggaaggucgugggacuauacggcaaugguguagucacccggagcggggcauaugugucagcuauugcccagacagagaaguccaucgaggauaacccugaaauugaggacgauaucuuccgcaaaaagagacugacuauaauggaccuccacccgggagcgggcaaaaccaagagguaccugcccgccauuguucgggaagcaaucaaacgaggccuuagaacguuaauccuggcuccaacacgcguggucgccgcugagauggaagaggcacucaggggguugccuauucguuaucagacucccgccauccgggccgagcauaccggaagagaaauuguggaccugaugugucacgcuacauuuaccaugaggcuccugaguccaguucgcgugccuaacuacaaucuuauaaucauggaugaggcgcacuucacugaccccgcaucuauugccgcucgagguuauaucagcaccagagucgaaaugggcgaggccgcagggaucuuuaugacagccacgccaccgggaucccgggauccuuucccccagucaaacgcuccaauuauggacgaggaaagggagauacccgaacgcucuuggaauagcggccaugagugggugacugauuuuaaggguaagaccguaugguucgugccuaguaucaaagcggggaacgacauugccgcaugccugcguaagaauggcaaaaagguuauccaauuguccagaaaaacauuugauagcgaauacgucaagacccgggcuaacgacugggauuucguggugacuacagacauuucugagaugggcgccaauuuuagggcagagcgcgucaucgauccacgaagauguaugaagcccguaauacuaaccgacggcgaagaacgggugauccuggccgggccuaugccgguuacgcacucauccgcugcccagaggcgcggaagaauugguaggaaccccaaaaaugaaaacgaccaguauaucuacaugggcgagccccucgaaaaugaugaggacugcgcgcauuggaaggaggcaaaaauguuacuggauaacauuaauacuccugaagggaucauacccaguauguucgagccagaacgggagaagguggacgccauugauggagaauaccgucuucgcggcgaggcucgaaaaacauuugucgaccugaugagaaggggugaucucccugugugguuggccuaucggguugcugcagaggggaucaacuacgccgaccgcagaugguguuucgauggcauuaagaauaaccaaauccuggaagagaacguggaagucgagauauggaccaaagagggagaaaggaagaagcucaaaccccgguggcuggacgcucgaaucuauagcgauccacuugcccuaaaggaguucaaagaauuugcagcgggcagaaagucgcugaccuugaauuuaauuacugagauggggcgccugccuacauucaugacccagaaagccagggacgcucucgauaaccuggccgugcuucacacagcagaaguaggaggucgggcuuacaaucacgcccugucugagcucccggagacuuuggaaacgcugcuacugcucacccuucuggcaacagugacuggcgggaucuuuuuauucuugauguccggaaagggcauugguaagaugacccuggggaugugcugcaucauaacagccagcauucuccugugguaugcucagauccagccccauuggaucgcggccucaauuauccuugaguuuuuccugauaguucucuugauuccagaaccugagaaacaacguaccccacaggacaaccagcugacuuacgucgugaucgcaauuuuaacgguggucgcugccaccauggccaaugaaaugggcuuucuagagaagaccaaaaaggaccugggacucggcaguaucacuacccaggagucugaauccaacauacuugauaucgaccugagaccagcaagcgcuuggacauuguaugccguugcgaccacuuucgugacaccuaugcugaggcacucaauugagaauaguagcguaaacgugucccucacggcuaucgccaaucaagcaaccguccugauggggcuuggacgcgguuggccccucucuaaaauggauauuggcgugccgcuguuggccaucggguguuacagccagguuaacccaauuacucugacagcugcauuacuacugcucguggcccauuacgcgaucauaggaccuggccuucaggcuaaggccacccgggaagcacagaagcgaaccgccgcugguauuaugaaaaaucccacagucgacgggaucacuguaaucgaucuggagccaauucccuaugacccuaaguuugaaaaacaauugggccaggugaugcugcucguucugugcgugacgcagguccuuaugaugagaaccacaugggccuuaugugaggcacugacucucgcuaccggaccgauauccacauugugggagggcaaccccgggagguucuggaauaccacuaucgccgugucaauggcgaacauuuuucgcggaucuuaccuggccggcgcaggucuacuguucaguaucaugaagaauacgacaaacacccggagagggacuggaaauaugggcgaaacccucggugagaaauggaagucgcgucuuaacgcucugggcaagagcgaauuucagauuuauaaaaaguccgggauccaagaggucgauaggacauuggccaaagagggaauaaagcggggcgaaacugaccaccaugcagugucucgcgggucagcuaaacugcgaugguucguugagagaaacauggugaccccagaaggaaagguaguggaucucggcugcgguagagggggauggagcuacuauuguggcggucugaaaaauguccgggagguuaagggcuuaacaaaagggggaccuggccacgaggaaccaaucccuauguccacguacggguggaaccuugugcgccugcagaguggagucgacguguucuuuaccccacccgagaaaugcgauacucuccuaugugacauuggcgaaucuagcccuaauccaacaaucgaggccgguagaacccugaggguauugaaccugguggaaaauuggcucaacaauaacacucaguucugcauuaagguucuuaaucccuauaugccgucagugaucgagaaaauggaaacacugcaacgaaaguacgggggagccuugguccggaacccucugucccguaauaguacccacgagauguacugggugagcaacgcgacgggcaauauagucucuuccgugaacaugauuucaagaaugcucaucaaucgcuuuaccaugaaacauaagaaggcuacauaugagccagauguugacuuaggcagcgggacuaggaacaucggaauugaaaacgagauacccaaucuggacaucauugguaaacggaucgaaaagauuaaacaggagcacgaaaccucguggcauuacgaucaggaccacccuuauaagacaugggcauaccacggcucuuaugagacuaaacagaccgggagugccuccagcaugguaaacggaguggucaaacuucugacaaagccaugggaugugguucccauggugacccaaauggcuaugacugacacgacaccguucggccagcagagagucuuuaaagagaagguggauacccgcacucaggaaccuaaagaggguaccaagaaacuaaugaggaucacagccgaauggcucuggaaggagcuggggaagaaaaagacgccccgaauguguacccgggaggaguucacuagaaaaguaaggucaaaugcagccuugggagcuauauuuacagacgagaacaaguggaaauccgcgcgcgaagccguggaggauucucguuucugggaacugguugaccgggagagaaaucuccaucuugagggcaagugcgaaaccugugucuacaacaugaugggcaaaagggagaagaagcugggggaauuuggaaaagcaaaggguagccgcgcuaucugguauaugugguuaggcgcccgauuccuggaguuugaagcauugggguuccucaaugaggaucacugguuuagucggggaaacucccugagcggcguggagggugaagggcuacauaaacuuggauacauucugagagacgugucuaagaaagagggcggcgccauguacgcugaugacacugccgggugggacacaaggaucacccucgaagaucugaagaaugaggaaauggucacaaaccacaugaagggagagcauaaaaaguuggcggaggcaauuuucaaacugacuuaucaaaauaagguugugcgcguacagagaccaaccccucgggguacggugauggacaucauuucaaggaaagaucagcguggcagugggcaggucggaaccuacggccucaacacauucacuaauauggaagcccaacuuauacgacagauggagggugaagggaucuuuaaguccauucagcgccugaccgugacagaggagaucgcuguucaaaacugguuagccagagugggacgggaaaggcugagccgcauggcaaucucuggcgacgauugcgucgugaagcccuuggacgauagauucgcuucggcccucacugcucugaaugacaugggcaaaguacggaaggauauucagcagugggagccaucaaggggguggaacgacuggacccagguucccuuuugcagccaccacuuccaugagcuagugaugaaagauggacgaguccuuguggugccuugucguaaccaagacgagcugauagguagagcccgcaucucccagggcgcaggguggagucucaaggaaacggcgugccugggaaaaucuuaugcccagauguggacauugauguacuuucaccggagggauuuaagacuggcugccaaugcaauuuguagcgcugucccaucccauuggguuccgaccucacgcacuacauggaguauccacgccaagcacgaguggaugaccacugaggacaugcucgcaguguggaaccggguauggauucaggaaaaucccuggauggaggacaagaccccuguggaaucuugggaggaagucccauaucuuggcaaaagggaggaucaauggugcgguagccugaucgggcuaacaucccgagccacgugggcgaagaacauacagaccgcuaucaaucaggugagaucacugauuggaaacgaggaauacacugacuauaugcccagcaugaaacgguucaggaaggaggaagaggaagccggcguucucugguga

SEQ ID NO: 14715 - RNA, 9876 nt, Artificial Sequence
  derived and/or modified CDS sequence (opt3) from DENV-2__EU482724__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauuaaaggaaucaugcaggccggcaagcgcucucugagaccucagccaaccgaacuuaaauauucguggaagacuugggggaaggcuaaaauguugagcacagagucccauaaccaaaccuuccugauugauggaccggaaacagccgagugccccaauacuucaagggcauggaacagucucgaggucgaagacuacggcuuugguguuuucucuaccaauaucuggcugaaguuacgugagaaacaggacguguuuugugauagcaagcugauguccgcggcuauaaaagacaaccgggccgugcacgcagauaugggguauuggauugaaucagcccuuaaugacacguggaagauggagaaggcuagcuucaucgagaucaaaucuugccacuggccuaagucccauacauuguggaguaacggaguacucgaaagcgagaugauuaucccaaaaaauuucgccggccccgucucucagcacaacuaccgaccugguuaucauacccagacugcaggcccauggcaccuggggaagcuagaaauggauuuugacuucugugagggaaccacagugguugugacugaagauugcggcaacagagggcccucccugaggaccacaacggcuucaggaaaacucauuaccgaguggugcugucgcaguugcacucugccgccucuucgguacagaggcgaggacgguuguugguacgggauggaaauaaggccauugaaggagaaggaagagaaucuggucaacagcuuagugacagccggacauggccaaaucgauaauuuuucgcucgguguucugggcauggcgcuuuuccuggaagagauguugcgcacccgaguggggacuaaacacgccauucuccugguagcugucuccuuugugacacuaaucaccggaaacaugucuuuccgggaccugggccgugugauggucaugguuggggcaacgaugacugaugacauuggaaugggcgugaccuaucucgcccugcuugcugccuuuaagguaagacccacauucgcagcggguuugcuguuaaggaaacucaccagcaaggagcugaugauggccacuaucgggauagcucuucugucacagaguacaaucccugaaaccauucuagagcucacagaugcccuggcauugggaaugauggugcugaaaaucguccgcaauauggaaaaguaccaguuagcugugacuauuauggccaucuccugcguucccaacgcagugauacuccaaaaugccuggaaggucucuuguaccauucuggcugcggugagcguuuccccacuucuguugacgucaagccagcagaaagccgacuggaucccucucgcacugacaaucaagggccuaaaccccaccgcuauuuuucugacuacccuuagucggacaucuaaaaagagauccuggccacucaaugaggccgugauggccgucggcaugguaagcauacuggcuucgucauugcugaaaaacgacaucccgaugacugggccuuuaguggcaggaggucuccugaccguuugcuaugugcuuacgggcaggucugccgaucuggaauuggagcgagcggcugacgucaagugggaggaucaggccgaaauuaguggguccagccccauccucucuauuacaaucagcgaggacggauccaugucaauaaaaaaugaagaggaggaacacacccugacuauccuaauucgcacaggccugcuugugaucagugguguauucccagugagcauucccaucaccgcagccgcuugguaccucugggaggucaagaagcaacgggcagggguucugugggaugugccuucuccacccccugugggaaaagccgaauuggaggacggcgcguauagaauaaagcagaggggcauuuuuggguacucccagaucggagcuggugucuauaaagaaggcacuuuccauacaauguggcacgugacccguggggccguuuuaaugcaucgcggaaagcggaucgagccgucaugggcagauguaaaaaaggaccugauuaguuacggcgguggguggaagcucgagggagaauggaaagagggcgaagaggugcagguccuggcccuugaaccaggcaagaaccccagagcugugcaaacgaaaccugggcuguuuaagacuaauaccggaacaaucggugccguuagcuuggauuucuccccaggcaccucugggucgcccauaguggacaggaaaggaaaggucgugggccuauacgguaacgggguagucacacgaagcggagcauaugugucagcuauugcccagacugagaaguccaucgaggauaauccugaaauugaggacgauaucuuccggaaaaagcgccugaccauaauggaccuccacccgggcgcgggcaaaacgaagagauaccugcccgccauuguuagggaagcaaucaaacgggggcuucgaacauuaauccuggcuccaacuagaguggucgccgcugagauggaagaggcacuccgcggauugccuauuagguaucagacccccgccauccgugccgagcauacaggucgggaaauuguggaccugaugugucacgcuaccuuuacuaugagacuccugaguccaguuagggugccuaacuacaaccuuauaaucauggaugaggcgcacuucaccgaccccgcaucuauugccgcucgcggcuauaucagcacacgagucgaaaugggggaggccgcaggaaucuuuaugacggccacuccaccgggcuccagagauccuuucccccagucaaaugcuccaauuauggacgaggaacgggagauacccgaaaggucuuggaacagcggucaugagugggugaccgauuuuaaggggaagacaguaugguucgugccuaguaucaaagcgggaaaugacauugccgcaugccugcgcaagaacggcaaaaagguuauccaauugucccguaaaaccuuugauagcgaauacgucaagacuagagcuaaugacugggauuucguggugacaaccgacauuucugagaugggcgccaacuuucgggcagagagggucaucgauccacgccgauguaugaagcccguaauacuaacggacggggaagagagagugauccuggccggaccuaugccgguuacucacucauccgcugcccagcggaggggucgcauuggcagaaauccaaaaaacgaaaaugaccaguauaucuacaugggggagccccucgaaaacgaugaggacugcgcgcauuggaaggaggcaaaaauguuacuggauaauauuaacacaccugaaggaaucauacccaguauguucgagccagaaagggagaagguggacgccauugauggcgaauaccggcuucguggugaggcucgcaaaaccuuugucgaccugaugcgaagaggggaucucccugugugguuggccuauaggguugcugcagagggcaucaauuacgccgaccggcgcugguguuucgauggaauuaagaacaaucaaauccuggaagagaacguggaagucgagauauggaccaaagagggcgaaagaaagaagcucaaacccagguggcuggacgcucggaucuauagcgauccacuugcccuaaaggaguucaaagaauuugcagcggggcgaaagucgcugacuuugaacuuaauuacagagaugggaagacugccuaccuucaugacacagaaagcccgcgacgcucucgauaaucuggccgugcuucacacugcagaaguagguggcagggcuuacaaccacgcccugucugagcucccggagacguuggaaacccugcuacugcucacacuucuggcaacugugaccgggggaaucuuuuuauucuugauguccggcaaggguauugggaagaugacacugggcaugugcugcaucauaaccgccagcauucuccugugguaugcucagauccagccccauuggaucgcggccucaauuauccuugaguuuuuccugauaguucucuugauuccagaaccugagaaacaacggacuccccaggacaaucagcugacguacgucgugaucgcaauuuuaaccguggucgcugccacaauggccaacgaaaugggauuucuagagaagacuaaaaaggaccugggccucgggaguaucaccacacaggagucugaauccaauauacuugauaucgaccugcguccagcaagcgcuuggaccuuguaugccguugcgacuacauucgugacgccuaugcugagacacucaauugagaacaguagcguaaaugugucccucaccgcuaucgccaaccaagcaacuguccugaugggacuugguaggggcuggccccucucuaaaauggauauuggggugccgcuguuggccaucggauguuacagccagguuaauccaauuacacugaccgcugcauuacuacugcucguggcccauuacgcgaucauaggcccuggucuucaggcuaaggccacccgcgaagcacagaagcggacagccgcugggauuaugaaaaaccccacugucgacggcaucacgguaaucgaucuggagccaauucccuaugacccuaaguuugaaaaacaauugggacaggugaugcugcucguucugugcgugacccagguccuuaugaugcgaacaacuugggccuuaugugaggcacugacccucgcuacaggcccgauauccaccuugugggaggggaaucccggaagauucuggaacacuacgaucgccgugucaauggcgaauauuuuuaggggcucuuaccuggccggugcagggcuacuguucaguaucaugaagaacacaaccaauacucgccggggaaccggcaacauuggugaaacacucggcgagaaauggaagucgagacuuaaugcucuggggaagagcgaauuucagaucuauaaaaaguccggaauacaagaggucgaucguacuuuggccaaagagggcaucaagaggggggaaaccgaccaccaugcagugucucggggaucagcuaaacugcgcugguucguugagcgaaacauggugacaccagaaggcaagguaguggaucucgguugcgggagaggaggcuggagcuacuauugugguggccugaaaaacgucagggagguuaagggguuaacgaagggaggcccugggcacgaagagcccauuccuauguccaccuacggauggaaucuugugcggcugcagaguggcgucgacguguucuuuacuccacccgagaaaugcgauacacuccuaugugacaucggugaaucuagcccuaacccaaccauugaggccgggcgcacucugagaguauugaaucugguggaaaacuggcucaauaacaauacacaguucugcguuaaggugcuuaaccccuauaugccgucagucaucgagaaaauggaaacccugcaaaggaaguacggaggcgccuuggugcgaaauccucugucccggaacaguacgcacgagauguacugggucagcaaugcgaccggcaacauagugucuuccguuaauaugauuucacguaugcucaucaacagauuuacaaugaaacauaagaaggcuacuuaugagccagauguagacuuagggagcggaacccgcaauaucgguauugaaaacgagauacccaaccuggacaucauuggcaaaaggaucgaaaagauuaaacaggagcacgaaacaucguggcauuacgaucaggaccacccuuauaagacuugggcauaccacgggucuuaugagaccaaacagacaggaagugccuccagcauggugaauggcgucgugaagcuucugaccaagccaugggauguugugcccauggucacucaaauggcuaugacggacacaaccccguucggucagcagcggguguuuaaagagaagguagauacuagaacccaggaaccuaaagaggggacaaagaaacuaaugcgcaucacggccgaauggcucuggaaggagcugggaaagaaaaagacccccaggauguguacucgagaggaauucacacggaaagugagaucaaacgcagccuugggcgcuauauuuaccgacgagaauaaguggaaauccgcgagggaagccguugaggauucucgcuucugggaacuggucgaccgugagcggaaccuccaucuugagggcaagugcgaaacuuguguguacaauaugauggggaaaagagagaagaagcugggagaauuugguaaagcaaagggcagcagggcuaucugguauaugugguuaggggcccgcuuccuggaguuugaagcauugggauuccucaacgaggaucacugguuuagucgaggcaauucccugagcgguguggagggggaaggacuacauaaacuuggcuacauucugcgggacgucucuaagaaagagggcggggccauguacgcugaugacacagccggaugggacaccagaaucacacucgaagaucugaagaacgaggaaaugguuacuaaucacaugaagggugagcauaaaaaguuggcggaggcaauuuucaaacugaccuaucaaaacaaggugguaagggugcagcgcccaacgccuagaggcaccgucauggacaucauuucacggaaagaucagagggggaguggacaggugggcacauacggucucaauacuuucaccaacauggaagcccaacuuauacgucagauggagggggaaggaaucuuuaaguccauucagcgacugacaguuacugaggagaucgcugugcaaaauugguuagcccgcgucggcagagaacggcugagcaggauggcaaucucuggcgacgauugcgugguaaagcccuuggacgaucgcuucgcuucggcccucaccgcucugaacgacauggggaaaguuagaaaggauauucagcagugggagccaucacggggauggaaugacuggacgcaggugcccuuuugcagccaccacuuccaugaacuagucaugaaagaugguagggugcuuguggucccuugucgaaaccaagacgagcugauaggccgugccagaaucucccagggggcaggauggagucucaaggaaacagcgugccugggcaaaucuuaugcccagauguggaccuugauguacuuucaccgccgggauuuaaggcuggcugccaacgcaauuuguagcgcuguuccaucccauugggugccgacuucaagaacaaccuggaguauccacgccaagcacgaguggaugacuaccgaggacaugcucgcaguauggaaucgcguguggauucaggaaaaccccuggauggaggacaagacaccugucgaaucuugggaggaagugccauaucuugguaaacgggaggaucaauggugcgggagccugaucggacuaacguccagggccaccugggcgaagaauauacagacugcuaucaaccagguucgaucacugauuggcaaugaggaauacacagacuauaugcccagcaugaaaagauuccggaaggaggaagaggaagccggcgugcucugguga

SEQ ID NO: 14716 - RNA, 9876 nt, Artificial Sequence
  derived and/or modified CDS sequence (opt3) from DENV-2__EU482725__SS-prME
accgccggcgugauaauuaugcugauacccacagcuauggcuuuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucagucgcgcuggugccccaugucgguauggggcuugagaccaggacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugcggugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacaccgggugugugguuuccuggaagaauaaagaauugaagugcggaagcggcaucuucauaacugauaacguccacacauggaccgagcaguacaaguuucagcccgaaucuccaucaaaacucgcuagugccauucaaaaggcacaugaggaagguaucuguggcauuaggagcgugacucggcuggagaauuuaauguggaaacagaucacccccgagcugaaccacauacuauccgaaaaugaggugaagcucacaaucaugacgggggacauuaaaggaaucaugcaggccggcaagcgcucucugagaccucagccaaccgaacuuaaauauucguggaagacuugggggaaggcuaaaauguugagcacagagucccauaaccaaaccuuccugauugauggaccggaaacagccgagugccccaauacuaacagggcauggaacucacucgaggucgaagacuacggcuuugguguuuucaguaccaacaucuggcugaaguuacgugagaaacaggacguguuuugugauucuaagcugaugagcgcggcuauaaaagacaaucgggccgugcacgcagauaugggguauuggauugaauccgcccuuaacgacacguggaagauggagaaggcuucauucaucgagaucaaaagcugccacuggccuaagucucauacauugugguccaauggaguacucgaaagugagaugauuauccccaagaauuucgccggccccgucagccagcacaacuaccgaccugguuaucauacccagacugcaggcccauggcaccuggggaagcuagaaauggauuuugacuucugugagggaaccacagugguugugacugaagauugcggcaauagagggcccucucugaggaccacaacggcuuccggaaaacucauuaccgaguggugcugucgcucaugcacucugccgccucuucgguacagaggcgaggacgguuguugguacgggauggaaauaaggccauugaaggagaaggaagagaaccuggucaauaguuuagugacagccggacauggccaaaucgauaacuuuagccucgguguucugggcauggcgcuuuuccuggaagagauguugcgcacccgaguggggacuaaacacgccauucuccugguagcugucucguuugugacacuaaucaccggaaauauguccuuccgggaccugggccgugugauggucaugguuggggcaacgaugacugaugacauuggaaugggcgugaccuaucucgcccugcuugcugccuuuaagguaagacccacauucgcagcggguuugcuguuaaggaaacucaccucuaaggagcugaugauggccacuaucgggauagcacuucugagccagucaacaaucccugaaaccauucuagagcucacagaugcccuggcauugggaaugauggugcugaaaaucguccgcaacauggaaaaguaccaguuagcugugacuauuauggccaucaguugcguucccaaugcagugauacuccaaaacgccuggaaggucuccuguaccauucuggcugcggugucuguuagcccacuucuguugacguccucacagcagaaagccgacuggaucccucucgcacugacaaucaagggccuaaaucccaccgcuauuuuucugacuacccuuagccggacaaguaaaaagagaucuuggccacucaacgaggccgugauggccgucggcaugguauccauacuggcuagcucguugcugaaaaaugacaucccgaugacugggccuuuaguggcaggaggucuccugaccguuugcuaugugcuuacgggcaggucagccgaucuggaauuggagcgagcggcugacgucaagugggaggaucaggccgaaauuucugggaguucccccauccucagcauuacaaucucugaggacggaagcauguccaucaaaaaugaagaggaggaacacacccugacuauccuaauucgcacaggccugcuugugaucucagguguauucccagugaguauucccaucaccgcagccgcuugguaccucugggagguccggaagcaaagagcagggguucugugggaugugccuagcccacccccugugggaaaggccgaauuggaggacggcgcguauaggauaaaacagcguggcauuuuuggguacucucagaucggagcuggugucuauaaggaaggcacuuuccauacaauguggcacgugacccgcggggccguuuuaaugcaucggggaaaaagaaucgagccguccugggcagauguaaagaaagaccugauuucauacggcgguggguggaagcucgagggagaauggaaggagggcgaagaggugcagguccuggcccuugaaccaggcaaaaaucccagggcugugcaaacgaagccugggcuguuuaaaacuaacaccggaacaaucggugccguuaguuuggauuucagcccaggcaccuccgggucucccauaguggaccgaaagggaaaagucgugggccuauacgguaaugggguagucacacggucgggagcauaugugagcgcuauugcccagacugagaagucaaucgaggauaacccugaaauugaggacgauaucuuccgcaagaaaagacugaccauaauggaccuccacccgggcgcgggcaagacgaaaagguaccugcccgccauuguucgggaagcaaucaagcgagggcuuagaacauuaauccuggcuccaacucgcguggucgccgcugagauggaagaggcacucaggggauugccuauucguuaucagacccccgccauccgggccgagcauacagguagagaaauuguggaccugaugugucacgcuaccuuuacuaugaggcuccuguccccaguucgcgugccuaacuacaaucuuauaaucauggaugaggcgcacuucaccgaccccgcaaguauugccgcucgaggcuauaucucuacaagagucgaaaugggggaggccgcaggaaucuuuaugacggccacuccaccgggcagccgggauccuuucccccaguccaacgcuccaauuauggacgaggaaagggagauacccgaacgcucauggaacucuggucaugagugggugaccgauuuuaaagggaagacaguaugguucgugccuagcaucaaggcgggaaacgacauugccgcaugccugcguaaaaauggcaagaaaguuauccaauugaguagaaagaccuuugauuccgaauacgucaaaacucgggcuaacgacugggauuucguggugacaaccgacauuagcgagaugggcgccaauuuuagggcagagcgcgucaucgauccacgaagauguaugaagcccguaauacuaacggacggggaagaacgggugauccuggccggaccuaugccgguuacucacucuucagcugcccagaggcgcgguagaauuggcaggaacccaaagaaugaaaacgaccaguauaucuacaugggggagccccucgaaaaugaugaggacugcgcgcauuggaaagaggcaaagauguuacuggauaacauuaauacaccugaaggaaucauacccuccauguucgagccagaacgggagaaaguggacgccauugauggcgaauaccgucuucgcggugaggcucgaaagaccuuugucgaccugaugagaagaggggaucucccugugugguuggccuaucggguugcugcagagggcaucaacuacgccgaccgcagaugguguuucgauggaauuaaaaauaaccaaauccuggaagagaacguggaagucgagauauggaccaaggagggcgaaaggaaaaagcucaagccccgguggcuggacgcucgaaucuauagugauccacuugcccuaaaagaguucaaggaauuugcagcggggagaaaaagccugacuuugaauuuaauuacagagaugggacgccugccuaccuucaugacacagaaggccagggacgcucucgauaaccuggccgugcuucacacugcagaaguagguggccgggcuuacaaucacgcccugucggagcucccggagacguuggaaacccugcuacugcucacacuucuggcaacugugaccgggggaaucuuuuuauucuugaugucuggcaaagguauugggaagaugacacugggcaugugcugcaucauaaccgccuccauucuccugugguaugcucagauccagccccauuggaucgcggccagcauuauccuugaguuuuuccugauaguucucuugauuccagaaccugagaagcaacguacuccccaggacaaccagcugacguacgucgugaucgcaauuuuaaccguggucgcugccacaauggccaaugaaaugggauuucuagagaaaacuaagaaagaccugggccucgggucaaucaccacacaggagagugaaucuaacauacuugauaucgaccugagaccagcauccgcuuggaccuuguaugccguugcgacuacauucgugacgccuaugcugaggcacagcauugaaaauucaaguguaaacgugagccucaccgcuaucgccaaucaagcaacuguccugaugggacuuggucgcggcuggccccucuccaagauggauauuggggugccgcuguuggccaucggauguuacucucagguuaacccaauuacacugaccgcugcauuacuacugcucguggcccauuacgcgaucauaggcccuggucuucaggcuaaagccacccgggaagcacagaagcgaacagccgcugggauuaugaagaaucccacugucgacggcaucacgguaaucgaucuggagccaauucccuaugacccuaaauuugaaaagcaauugggacaggugaugcugcucguucugugcgugacccagguccuuaugaugagaacaacuugggccuuaugugaggcacugacccucgcuacaggcccgauaagcaccuugugggaggggaaccccggaagguucuggaauacuacgaucgccguguccauggcgaacauuuuucgcggcucauaccuggccggugcagggcuacuguucucuaucaugaaaaauacaaccaacacucggagaggaaccggcaauauuggugaaacacucggcgagaaguggaaaagucagcuuaacgcucuggggaagucggaauuucaaaucuauaagaaaagcggaauacaggaggucgaucguacuuuggccaaggagggcaucaaaagaggggaaaccgaccaccaugcagugucccggggaucugcuaagcugcgcugguucguugagcgaaacauggugacaccagaaggcaaaguaguggaucucgguugcgggagaggaggcuggucauacuauugugguggccugaagaaugucagggagguuaaaggguuaacgaagggaggcccugggcacgaagaaccaauuccuaugagcaccuacggauggaaccuugugcggcugcaguccggcgucgacguguucuuuacuccacccgagaagugcgauacacuccuaugugacaucggugaaaguucuccuaauccaaccauugaggccgggcgcacucugagaguauugaaccugguggaaaauuggcucaacaauaacacacaauucugcguuaaagugcuuaaucccuauaugccgagcgucaucgagaagauggaaacccugcagaggaaauacggaggcgccuuggugcgaaacccucugucaagaaauuccacgcacgagauguacugggucaguaacgcgaccggcaauauagugagcucuguuaacaugauuucccguaugcucaucaauagauuuacaaugaagcauaaaaaggcuacuuaugagccagauguagacuuagggucaggaacccgcaacaucgguauugaaaacgagauacccaaucuggacaucauuggcaagaggaucgagaaaauuaagcaggagcacgaaacaagcuggcauuacgaucaggaccacccuuauaaaacuugggcauaccacgggucguaugagaccaagcaaacaggaucugccaguuccauggugaacggcgucgugaaacuucugaccaagccaugggauguugugcccauggucacucagauggcuaugacggacacaaccccguucggucagcagcggguguuuaaggagaaaguagauacuagaacccaagaaccuaaggaggggacgaaaaagcuaaugcgcaucacagccgaauggcucuggaaagagcugggaaagaagaaaacccccaggauguguacucgagaggaguucacacggaaggugagaagcaaugcagccuugggcgcuauauuuaccgacgagaacaaauggaagucagcgagggaagccguugaggauucccgcuucugggaacuggucgaccgugagcggaaucuccaucuugagggcaaaugcgaaacuuguguguacaacaugauggggaagagagagaaaaagcugggagaauuugguaaggcaaaaggcucuagggcuaucugguauaugugguuaggggcccgcuuccuggaguuugaagcauugggauuccucaaugaggaucacugguuuagccgaggcaacagucuguccgguguggagggggaaggacuacauaaacuuggcuacauucugcgggacgucagcaaaaaggagggcggggccauguacgcugaugacacagccggaugggacaccagaaucacacucgaagaucugaaaaaugaggaaaugguuacuaaccacaugaagggugagcauaagaaauuggcggaggcaauuuucaagcugaccuaucagaauaaagugguaagggugcagcgcccaacgccuagaggcaccgucauggacaucauuucucggaaggaucagagggggucaggacaagugggcacauacggucucaacacuuucaccaauauggaagcccagcuuauacgucagauggagggggaaggaaucuuuaaaaguauucaacgacugacaguuacugaggagaucgcugugcagaacugguuagcccgcgucggcagagaacggcuguccaggauggcaaucagcggcgacgauugcgugguaaagcccuuggacgaucgcuucgcuucugcccucaccgcucugaaugacauggggaagguuagaaaagauauucagcagugggagccaucgcggggauggaacgacuggacgcaagugcccuuuugcucacaccacuuccaugagcuagucaugaaggaugguagggugcuuguggucccuugucgaaaccaggacgagcugauaggccgugccagaaucagccagggggcaggauggucccucaaagaaacagcgugccugggcaagaguuaugcccagauguggaccuugauguacuuucaccgccgggauuuaaggcuggcugccaaugcaauuuguucugcuguuccaagccauugggugccgacuuccagaacaaccuggucaauccacgccaaacacgaguggaugacuaccgaggacaugcucgcaguauggaaccgcguguggauucaagaaaaucccuggauggaggacaagacaccugucgaaaguugggaggaagugccauaucuugguaagcgggaggaucaguggugcgggucucugaucggacuaacgagcagggccaccugggcgaaaaacauacagacugcuaucaaucagguucgaucccugauuggcaacgaggaauacacagacuauaugcccucaaugaagagauuccggaaagaggaagaggaagccggcgugcucugguga

SEQ ID NO: 14717 - RNA, 9876 nt, Artificial Sequence
  derived and/or modified CDS sequence (opt3) from DENV-2__EU482726__SS-prME
accgcaggagugaucgucaugcugauucccacaguuauggcuuuccaccucacuacgaggaauggggagccucauaugauagugggaaggcaggaaaaggguaaaagccuucuguuuaagaccgaggacggcgugaauaugugcacauugauggcaaucgauuuaggggaacugugugaggacacuauuaccuacaaaugcccauuacuccggcaaaacgaaccggaggauaucgacuguuggugcaauuccacaucuaccugggugacuuauggaacauguaccacgacuggcgagcaccgccgagaaaagcguucagucgcccuggugccccauguugguauggggcuugagacccggacagaaacuuggaugaguagcgagggagcguggaaacacgugcagaggauugagaccuggauccugcggcauccuggcuucacaauaauggcugccaucuuggcauacaccauuggcacgacucacuuucagcgcgcccucaucuucauucugcugacagcugucgcaccauccaugaccaugagaugcaucgggauaucuaacagggauuuuguggaaggaguaucggguggcucauggguugacauugugcucgagcacgggagcugugucacuacaauggccaagaauaagcccaccuuagauuucgaacugaucaaaacggaggcuaagcagccugccacccuucggaaauauugcauugaagcgaaguugacaaacacuaccacagagagucgcuguccaacucaaggagagcccucccugaaugaagaacaggacaaacgauuuaucugcaagcauucuaugguggauagaggcugggguaacggguguggauuauucggcaagggcgggaucgugaccugcgcaauguuuacaugcaaaaagaauauggaaggaaaaauuguccagccugagaaccucgaauacaccauaguuaucacuccacacagcggugaggagcaugccgugggcaaugacacggggaagcacggaaaagaaauuaagaucacaccgcaguccucaaccacugaggcugaacugaccggcuaugguacaguaaccauggaguguagucccaggacugggcuugauuucaacgaaauggugcuguugcaaauggaggacaaagccuggcucguccaccggcagugguuucuggauuuaccucugccauggcuccccggcgcagacacacagggaagcaauuggauacagaaggagacgcuugugaccuucaagaacccucaugcuaaaaagcaagacguugugguccugggcucucaggaaggggccaugcacacugcguugacaggagccaccgagauucagauguccucagguaaucuacuguuuacaggccaucucaaaugccgucugcgcauggauaaacuucaacugaaagggaugagcuacaguauguguaucggaaaguucaagaucgugaaagaaauugcagagacucagcacggcaccaucguaauuagaguucaguaugagggugacgggucuccaugcaagauacccuucgaaaucacggauuuggagaaaaggcaugugcucggccggcugauuaccgucaacccgaucgugacagaaaaggacgcuccugucaacaucgaggccgaacccccauuuggagauuccuacauuauagugggcguugagccugggcaguuaaaacugaauugguucaagaagggaagcucgaucggucaaauguuugagacuaccaugcgaggcgcuaaacgcauggccauucuaggggacacagcaugggauuucggaucucucggcgguguguuuacuuccaucgggaaggcccugcaccagguauucggcgcuauuuacggagcggcauuuucaggcgucaguuggaccaugaaaauccuuauaggggugaucauuacguggaucggaaugaacagcagauccacaucuuugagcguuucacuggugcucgucggcgugguaacccuguaucuuggugccgugguucaggcugacagugggugugucguguccuggaagaauaaagaacugaagugcggaagcggcauuuucaucacugauaacgugcacacauggaccgagcaguacaaguuucaacccgaaucuccaucaaaauuggccagugcaauacagaaggcccaugaggaagguauuuguggcaucaggagcgucacucggcucgagaaucugauguggaaacagauuacccccgaguuaaaccacauccuguccgaaaaugagguuaagcuaacaauaaugacgggggacaucaaaggaauuaugcaggcuggcaagcgcucucucagaccucaaccaaccgaacugaaauauucguggaagacuugggggaaggccaaaaugcuuagcacagagucccauaaccagaccuucuugaucgauggaccggaaacagcagagugccccaauacuaacagggcguggaacucacuggagguggaagacuacggcuuugguguguucaccacgaacauuuggcucaagcugcgugagaaacaggacguauuuugugauaguaaguuaaugucugcugccaucaaagacaaucgggcaguccacgccgauaugggguauuggauagaaagcgcucugaacgacacauggaagauggagaaggccuccuucauugaggugaaaucaugccacuggccuaagagccauacccuuuggucuaauggaguuuuggaauccgagaugaucauccccaagaauuucgcaggccccgugagucagcacaacuaccgaccugguuaucauacucaaaccgcuggcccauggcaccucgggaagcuggaaauggauuuugacuucugugagggaacaacugucgugguuaccgaagauugcggcaauagagggcccagccuaaggacaacgaccgccucuggaaaacugauuacugaguggugcugucgcuccugcacacucccgccucugcgguacagaggcgaggacgguuguugguacgggauggaaaucaggccacuuaaggagaaggaagagaacuugguaaauucacugguaaccgcgggacauggccagauugauaacuuuaguuuagguguccucggcauggcccuguuccuugaagagaugcugcgcacucgaguggggacaaaacacgcuaccuugcucguggcacugagcuuugucacgcuaauaacuggaaauaugucguuccgggaccugggccguguuauggugaugguaggggccaccaugacagaugacaucggaaugggcgugaccuaucucgcucugcuugccgcauuuaaggucagacccacuuucgcggccgguuugcuguuaaggaaacucacauccaaggagcugaugauggcuaccauugggaucgcccuucugucucagagcacacuaccugaaacuauucucgagcugaccgaugcauuggcucugggaaugaugguguuaaaaaucguucgcaacauggaaaaguaccaacucgccgugacgauaauggcaaucucaugcguccccaaugccgugauucugcagaacgcuuggaagguuaguuguacaauccuugcggccguguccgucucuccacuguugcucaccagcucccagcagaaagcagacuggauuccucuggcucuaacuaucaagggccugaaucccaccgccauauuucuuacaacucucucacggaccagcaaaaagagaaguuggccacugaacgaggccauuauggcuguaggcauggugucuaucuuggcauccagccugcuaaagaaugacaucccgaugacggggccucucguugccggaggucugcuuacagugugcuauguccugaccggcaggucggcggauuuggaacucgagcgagcugccgacgugaagugggaggaucaagcagaaauuucagggucuagucccauacuguccaucacuauuagcgaggacggaucuaugagcaucaaaaacgaagaggaggaacagacacuaaccauucugauccgcacuggccuucucguaauauccgguguguucccagucucaauccccauuacagccgcugcaugguaccugugggagguuaagaagcagcgggccgggguguugugggaugugccuaguccacccccugucggaaaagcggaauuagaggacggcgcuuauagaaucaagcagaggggcauucugggguacagccaaaucggagccgguguguauaaagaaggcaccuuucacacgauguggcauguuacucguggggcaguacucaugcaccgcggaaagcggauagagccgucuugggccgaugugaaaaaggaccugauuuccuacggcgguggguggaaacuugagggagaauggaaagagggcgaagagguccaggugcuggcuuuggaaccaggcaagaaucccagagccguucagaccaaaccugggaucuucaagacaaacaccggaacaaucggugcagugucacuagauuuuaguccaggcacuagcgggucccccauugucgacaggaaaggaaaggugguaggccuguacgguaauggggucgugacccgaucuggagcuuauguuucggccaucgcgcagacggaaaagagcauagaggauaacccugaaauugaggacgauaucuuccggaaaaagcgccucacaauuauggaccugcauccgggcgccggcaaaacuaagagauaccuucccgcaaucgugagggaagcuauaaaacggggguuacgaacccugauucucgccccaacaagagucguggcugcagagauggaagaggccuugcgcggacugccuaucagguaucaaacccccgccauccgugcugagcacacuggucgggaaauuguugaccucaugugucaugcgaccuucacaaugagacugcuuucaccagugagggucccuaacuacaaucugaucauuauggaugaggcacacuuuacggaccccgccuccauagcugcccgcggcuauaucaguacucgaguggaaaugggggaggcagccggaauuuucaugaccgcuacaccaccgggcucuagagauccuuuuccccagagcaacgcgccaaucauggacgaggaacgggagauccccgaaagguccuggaacucaggucacgaguggguaaccgauuucaaggggaagacugugugguuuguuccuucuauuaaagccggaaacgacauagcagcuugcuugcgcaagaauggcaaaaaggucauccagcuaagccguaaaacauucgauagugaauacgugaagaccagagccaacgacugggauuuuguggucacgacugacauuuccgagaugggcgcaaauuuccgggccgagaggguaaucgauccacgccgauguaugaagcccgugauucugacagacggggaagagagaguuauccucgcuggaccuaugccggugacccauagcucugccgcgcaacggaggggucgcauaggcagaaaccccaaaaaugaaaacgaccaguauaucuacaugggggagcccuuagaaaaugaugaggacugcgcacacuggaaggaggccaaaaugcugcuugauaacauuaauaccccugaaggaaucauucccucaauguuugagccagaaagggagaaggucgacgcuaucgauggcgaauaccggcugcguggugaggcccgcaaaacuuucguggaccucaugcgaagaggggauuugccuguuuggcuggcuuauaggguggcagccgagggcauaaacuacgcugaccggcgcugguguuuugauggaauuaagaauaaccagauccucgaagagaacgucgaaguggagauuuggacaaaagagggcgaaagaaagaagcugaaacccagguggcuugacgcccggaucuauuccgauccacuagcacugaaggaguucaaagaguucgcggccgggcgaaagaguuugaccuuaaaucugauaacagagaugggaagacucccuacuuuuaugacgcagaaagcucgcgacgcccuggauaaccuugcaguacugcauaccgcugaaguggguggcagggccuacaaucacgcacucagcgaguugccggagacacuggaaacucuacugcuccuuacccuguuagccacaguuaccgggggaaucuucuuguuucugaugucgggcaaggguauugggaagaugacucucggcaugugcugcaucauuacggcuucuauccugcuuugguaugcgcaaauacagccccacuggauugccgcauccaucauccuggaguucuuucucauugucuugcugaucccagaaccugagaaacagcggacaccacaggacaaccaauuaacauacguggugauagcuauucuaacugucguugccgccaccauggcaaaugaaaugggauuccuggagaagaccaaaaaggaccucggccuugggagcaucaccacucaggagucagaaaguaacauucuggauaucgacuugcguccagcuucugccuggacacuguaugcgguggcuacgaccuuuguaacuccuaugcucagacauuccauagagaauagcucagugaacgucagucugacagccaucgcaaaucaggccaccgugcuuaugggacucgguaggggcuggccccugagcaaaauggauauugggguuccguugcuggcuaucggauguuacucccaggugaacccaauuaccuuaacagcagcccuacugcuccuugucgcgcacuacgcuaucauuggcccuggucugcaagccaaggcaacucgcgaagcccagaagcggacggcugccgggaucaugaaaaaucccaccguagacggcauaacagugauugauuuggagccaauccccuaugacccuaaguucgaaaaacagcugggacagguuaugcuccuggugcuuugcgucacucaaguguuaaugaugcgaaccacaugggcacugugugaggcucucaccuuggccacuggcccgaucucuacgcugugggaggggaaccccggaagauuuuggaauacaaccauugcggucagcauggccaacauauucaggggcuccuaccuagccggugcugggcugcucuuuucaaucaugaagaauacuaccaacacacgccggggaacuggcaauauuggugaaacccuuggcgagaaauggaagucuagacugaacgccuuggggaagagugaguuccagaucuauaaaaagucgggcauucaggagguggaucguacacuggcaaaagagggcaucaagagaggggaaacggaccaucacgcuguuagccggggauccgccaaacuccgcugguuuguggagcgaaacaugguaaccccagaaggcaagguggucgaucuggguugcgggagaggaggcuggucuuacuauugugguggccuuaaaaauguuagggaggugaaggggcuaacuaagggaggcccugggcaugaagaaccaauaccuaugucaacauacggauggaaccugguccggcuccaaagcggcguggacguauucuucaccccacccgagaaaugcgauacucuacugugugacaucggugaauccaguccuaauccaacaauugaggccgggcgcaccuugagagugcugaaccucguugaaaauuggcuuaacaauaacacgcaguuuugcaucaaggugcugaaucccuauaugccgucugucauugagaaaauggaaaccuugcagaggaaguacggaggcgcgcuggugcgaaacccucucagcagaaauucaacacacgagauguacugggucuccaacgcuacuggcaauaucgugaguagcguuaacaugauaucucguauguuaauuaauagauucaccaugaaacacaagaaggcaacauaugagccagauguagaccugggguccggaacucgcaacaucgguaucgaaucagagauucccaaccuugacauaaucggcaaaaggauugaaaagaucaaacaggagcaugaaaccagcuggcacuacgaucaagaccauccuuauaagacaugggccuaccacgggucguaugagaccaaacagacuggaucugcuaguuccauggugaauggcgucgugaagcugcuaacgaagccaugggauguugugcccauggucacacagauggccaugaccgacacuaccccguuuggucagcaacggguguucaaagagaagguagauacaagaacgcaggaaccuaaagaggggaccaagaaacucaugcgcauuacugcagaauggcuguggaaggaguugggaaagaaaaagacacccaggauguguacccgagaggaauuuacucggaaagugagaagcaacgccgcucugggcgcgaucuucacagacgagaauaaguggaaaucagccagggaagcaguugaggauucccgcuuuugggaacucgucgaccgugagcggaaccuucaccuggagggcaagugcgaaaccuguguguacaauaugauggggaaaagagagaagaaguuaggagaguucgguaaagcuaagggcucuagggccauaugguauauguggcugggggcacgcuuuuuggaguucgaagcccucggauuucugaacgaggaucauugguucagccgaggcaauagucuauccgguguggagggggaaggacuucaccggcugggcuacauccucagagaggucggcaaaaaggaagggggagcuauguacgccgacgauacagcggguugggacacuaggauuacccuggaggacuugaaaaacgaagagaugguuacgaaucauaugaagggcgagcacaagaaacuggcagaagccaucuuuaagcucaccuaucagaacaaagugguacgcgugcagagaccaacaccucgggggacugucauggauauuaucagcaggaaggaccaacguggaucuggccagguggguaccuacgggcuuaauacauucacuaacauggaggcucagcugauucgacaaauggaaggagagggcauauucaaaucaauccagcauuuaaccgccacggaggaaauugcaguucagaauuggcuggcucgcgugggcagagagcgguugaguaggauggccaucuccggggaugacugcgucgugaagcccaucgaugaccgcuuugcuagcgcccucacagcacugaacgauaugggaaagguaagaaaagacauucagcaaugggaaccaucucgggguuggaaugauuggacccagguucccuucugcucgcaccacuuucaugagcuagugaugaaggacggcaggguccuuguggugccuugucgaaaccaggaugaacugauagggcgugcgagaaucucacagggagccggcuggagccucaaagagacugcuugccuggguaaguccuaugcccaaauguggacauugauguacuuccaccgccgggacuuaaggcuggcagcuaacgccauuuguagugcagucccaucucauuggguuccgaccagcagaacuaccugguccauccacgccaaacacgaguggaugacaacggaagauaugcucgcgguguggaaucgcguauggauucaggagaaccccuggauggaagacaagaccccuguggagucaugggaagaggucccauaucuugggaagcgggaggaccaguggugcggaagucugaucggccuaacuucuagggcuacaugggccaaaaauauacagaccgcaaucaaccaagugcgaagccugauuggcaaugaagaguacacugauuauaugcccuccaugaagagauuucggagggaagaggaagaggccgggguucucugguga

SEQ ID NO: 14718 - RNA, 9876 nt, Artificial Sequence
  derived and/or modified CDS sequence (opt3) from DENV-2__EU482727__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauuccaaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcucuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacaaacacugaccauacuaauccgcacuggccugcuuguaauuagugguguguucccagucagcauccccauuacagcagccgcuugguaccucugggagguuaagaagcagcgggcaggggugcugugggaugugccuucuccacccccugucggaaaagccgaauuggaggacggcgcguauagaaucaagcagaggggcauauuuggguacucccagauuggagcugguguguauaaagaaggcaccuuccacacuauguggcauguuacacguggggccguauuaaugcaccgcggaaagcggaucgagccgucaugggcagaugugaaaaaggaccugaucaguuacggcgguggguggaagcucgagggagaauggaaagagggcgaagagguccaagugcuggcccuugaaccaggcaagaaucccagagcuguucagaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccauccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcacaccggucgggaaaucguugaccugaugugucaugcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccaaucaaacgcuccaaucauggacgaggaacgggagauucccgaaaggucuuggaauagcggucacgaguggguaacugauuuuaaggggaagaccgugugguucguuccuaguauaaaagcgggaaacgacaucgccgcaugccugcgcaagaauggcaaaaaggucauucaguugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcauucauccgcugcccagcggaggggucgcaucggcagaaacccaaaaaaugaaaacgaccaauauauuuacaugggggagccccucgaaaaugaugaggacugcgcguacuggaaggaggcaaaaauguuacuggauaacaucaauacuccugaaggaauuauccccaguauguucgagccagaaagggagaaggucgacgccauagauggcgaauaucggcuucguggugaggcucgcaaaacauuuguggaccugaugcgaagaggggaucucccuguuugguuggccuacaggguggcugcagagggcauuaacuaugccgaccggcgcugguguuucgauggaaucaagaauaaccagauucuggaagagaacgucgaaguggagaucuggaccaaagagggcgaaagaaagaagcucaaacccagguggcuggacgcucggauauacagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucacacagcagaaguggguggcagggcuuauaaucaugcccugucugagcucccggagacuuuggaaacgcugcuacugcucacccuucuggcaacaguuacugggggaauuuuuuuauucuugauguccggcaaggguaucgggaagaugacccugggcaugugcugcauuaucacagccagcauacuccugugguacgcucagauucaaccccacuggaucgcggccucaaucauucuugaguuuuuccugaucguccucuugauaccagaaccugagaaacagcggaccccccaggacaaccagcugacuuauguggugauugcaaucuuaacggucguugcugccaccauggccaaugaaaugggauuucuagagaagacaaaaaaggaccugggccucgggaguauuacuacccaagagucugaauccaacauccuugauauagaccugcguccagcaagcgcuuggacauuguacgccguggcgaccacuuucguaacaccuaugcugagacacucaaucgagaauaguagcgugaacgucucccucacggcuauugccaaucaggcaaccgugcugaugggacuugguaggggcuggccccucucuaaaauggauaucgggguuccgcuguuggccauuggauguuacagccaggugaacccaaucacucugacagcugcauuacuacugcucgucgcccauuaugcgauuaucggcccuggucuucaggcuaaggccacccgcgaagcacaaaagcgggccgcugccgggauaaugaaaaaucccaccguagacggcauuacagugaucgaucuggagccaauccccuacgacccuaaguuugaaaaacaguugggacagguuaugcugcucgugcugugcgucacucaggugcuuaugaugcgaacgaccugggcauuaugugaggcucugacacucgccacuggcccgauuuccaccuugugggaggggaaccccggaagauucuggaauacaaccauagcggucucaauggccaacaucuuuaggggcucuuaucuggcaggugcugggcuacuguucaguauuaugaagaauacuacgaacacacgccggggaaccggcaauaucggugaaacucucggcgagaaauggaagucgagacuuaacgcccuggggaagagcgaauuucaaauuuacaaaaaguccggaauccaggagguggaucguaccuuggcaaaagagggcauaaagaggggggaaacagaccaccaugcuguuucucggggaucagccaaacugcgcugguucguggagcgaaacaugguaacuccagaaggcaagguggucgaucucgguugcgggagaggaggcuggagcuauuacugugguggccugaaaaauguuagggaggugaagggguuaaccaagggaggcccugggcacgaagagcccaucccuauguccacauauggauggaaccuuguccggcugcagaguggcguggacguauucuuuacgccacccgagaaaugcgauacccuccuaugugacauuggugaaucuagcccuaauccaacuaucgaggccgggcgcacacugagaguguugaaccugguugaaaauuggcucaacaauaacacccaauucugcauuaaggugcuuaaucccuacaugccgucagucaucgagaaaauggaaacucugcagaggaaguacggaggcgcguuggugcgaaacccucugucccggaauaguacacaugagauguauugggucagcaacgcuaccggcaauauagugucuuccguuaacaugauuucacguaugcucaucaauagauuuacgaugaaacacaagaaggcaaccuacgagccagauguagacuuagggagcggaacacgcaacaucgguauugaaaacgagauacccaaucuggacaucauuggcaaaaggaucgaaaagauuaaacaggagcacgaaacuucguggcauuaugaucaggaccacccuuacaagaccugggccuaucaugggucuuacgagacaaaacaaacuggaagugcuuccagcauggugaacggcgucgugcggcuucugaccaagccaugggauguugugcccauggucacacagauggccaugaccgacacuacgccguucggucagcagagaguguuuaaggagaaaguagauacacgcacccaagaaccuaaggaggggacuaaaaagcuaaugaggaucaccgcagaauggcucuggaaagagcugggaaagaagaaaacaccccgaauguguacgcgggaggaauucaccagaaaggugaggucaaaugccgcuuugggcgcgauauuuacugacgagaacaaauggaaguccgcccgcgaagcaguugaggauucucguuucugggaacuggucgaccgggagagaaaucuccaccuugagggcaaaugcgaaacauguguguauaacaugauggggaagagggagaaaaagcugggagaauuugguaaggcuaaaggcagccgcgccaucugguacaugugguuaggggcacgauuccuggaguuugaagccuugggauuccucaaugaggaucacugguuuagucggagaaacucccugagcggcguggagggugaagggcuacauaagcuuggauacauucugagggacgucucuaaaaaggagggcggcgcuauguaugccgaugacaccgcggggugggacacucgcaucacacucgaagaucugaaaaaugaggaaaugguuaccaaccacaugaagggagagcauaagaaauuggcagaggccauuuucaagcugacauaccagaauaaagugguaagagugcagcggccaacuccuagggguaccgucauggacaucauuucacguaaggaucagcgaggcagugggcaagugggaacguauggccucaacaccuucacaaauauggaagcucagcuuauacgccagauggagggugaagggaucuuuaaauccauucaaagacugacuguuaccgaggagaucgccgugcagaacugguuagcacgggucggaagggaacgccugagcagaauggcuaucucuggcgacgauugcgugguaaagcccuuggacgaucgguucgccucggcucucacagcccugaaugacaugggcaagguuaggaaagauauucagcagugggagccaucacgaggguggaacgacuggacucaagugcccuuuugcagccaccauuuccacgaacuagucaugaaggauggacgugugcuuguggucccuuguagaaaccaggacgagcugauaggucgcgcacggaucucccagggcgcgggguggagucucaaagaaaccgccugccugggaaagucuuacgcucagauguggacguugauguauuuucacaggagagauuuacgccuggccgcaaaugcuauuuguagcgccguuccaucccauugggugccgacaucacggaccacuuggaguauccacgcaaaacaugaguggaugacaaccgaggacaugcucgccguauggaacaggguguggauucaagaaaaucccuggauggaggacaagacuccugucgaaucuugggaggaagugccauaccuuggcaagcgagaggaucaguggugcgguagccugaucgggcuaaccuccagagcgacaugggcuaaaaacauacagacggccaucaaucagguucggucacugauuggaaacgaggaauauaccgacuacaugcccagcaugaagagguuccgcaaagaggaagaggaagcaggcgugcucugguga

SEQ ID NO: 14719 - RNA, 9876 nt, Artificial Sequence
  derived and/or modified CDS sequence (opt3) from DENV-2__EU482728__SS-prME
accgcaggcgugaucauuaugcugauacccacagcuauggcauuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuuuaguggauagaggcugggguaacggguguggacucuucggcaagggcgggauugucacaugcgccauguuuacaugcaaaaagaauauggaaggaaaaguggugcugccugagaaccuugaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccggguuggauuucaacgaaaugguacuccugcagauggaggacaaagcaugguuagugcaccggcaaugguuucuggaucucccucuuccauggcugcccggcgcugacacucagggaagcaauuggauucagaaggagacauuggucacguucaagaacccucaugccaaaaagcaggacgugguugugcugggcucucaagaaggggcgaugcacaccgcccugacuggagcaacagagauccagauguccucagguaaucuccuguuuaccggccaucuuaaaugccgucugcgcauggauaaguugcagcucaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucuggagaaaaggcauguuuuaggccggcugauuacggugaacccgaucgucaccgaaaaggacuccccugugaacaucgaggccgaacccccauuuggagauagcuacauuauaaucggcgucgagccugggcagcuaaaacucaauugguucaagaagggaucgucuauuggucagauguuugagacaacuaugcgaggcgcuaaacgcauggccauccugggggacaccgcaugggauuucggaucccuuggcgguguguuuacaucaauugggaaggccuugcaccaaguuuucggcgcuaucuacggagcggcauuuaguggcgugagcuggacuaugaaaauacugaucgggguaauuaucaccuggauuggaaugaacuccagaucuacgagccucucagucagucuggugcuuguuggcguggucacacuguauuugggugugaugguacaggccgacuccgggugugugguuagcuggaagaauaaagaacucaagugcggaucuggcaucuucauaaccgauaacguccacacuuggacagagcaguacaaguuucagcccgaaucaccaaguaaacuggcuagcgccauucaaaaggcacaugaggaagguaucuguggcauuagguccgugacccgguuagagaaucugauguggaaacagaucacucccgagcuaaaccacauacucucugaaaaugaggugaagcugaccaucaugacaggggacauuaaaggaaucaugcaggccggcaagcgcucgcuuagaccucagccaacggaauugaaauauagcuggaagaccugggggaaggcuaaaaugcuguccacugagucacauaaccaaacauuccucauugauggaccggaaaccgccgagugccccaauacaaacagggcauggaauagucuggaggucgaagacuacggcuuugguguuuucucuacuaacaucugguuaaagcugcgugagaaacaggacguguuuugugauagcaaacuuauguccgcggcuauaaaagacaaucgggccgugcacgcagauaugggguauuggauugaaucagccuugaacgacaccuggaagauggagaaggcuagcuucaucgagguaaaaucuugccacuggccuaagucccauacgcucuggaguaauggaguccuggaaagcgagaugaucauucccaagaacuucgccggccccgugucucagcacaacuaccgaccugguuaucauacacagaccgcaggcccauggcaccuagggaagcuggaaauggauuuugacuucugugagggaacuaccguuguggucacagaagauugcggcaauagagggcccucccucaggacuaccacagcuucaggaaaacugaucacggaguggugcugucgcaguugcacccuuccgccuuugcgguacagaggcgaggacgguuguugguacgggauggaaauuaggccacugaaggagaaggaagagaacuuagugaauagccucguuacugccggacauggccaaauagauaacuuuucgcugggugugcuuggcauggcgcuguucuuggaagagaugcuccgcacacgaguagggaccaaacacgccauccugcuagucgcuguguccuuugugacucugauuacaggaaauaugucuuuccgggaccucggccgugucaugguuauggugggggcaaccaugacggaugacaucggaaugggcguaacuuaucuggcccuuuuggcugccuuuaaggugagacccaccuucgcagcgggucuguuacucaggaaacugacaagcaaggagcuuaugauggccaccauugggaucgcucugcuaucacagaguacuauaccugaaacaauccucgagcugaccgaugccuuggcacugggaaugauggucuuaaaaauugugcgcaacauggaaaaguaccagcucgcuguuacaaucauggccauuuccugcgugcccaaugcagucauccugcaaaacgccuggaaggugucuuguacuauacuugcugcgguuagcguguccccacuguugcucaccucaagccagcagaaagccgacuggauuccucuggcacuaacgaucaagggccugaaucccacagcuaucuuucuuaccacucucagucggaccucuaaaaagagauccuggccacugaacgaggccgucauggccguaggcauggugagcauuuuggcuucgucacugcucaaaaaugacauaccgaugacagggccucuaguugcaggaggucugcuuacugugugcuauguccugaccggcaggucugccgauuuggaacucgagcgagcggcugacgugaagugggaggaucaggccgaaaucaguggguccagccccauucugucuaucacgauuagcgaggacggauccaugucaaucaaaaacgaagaggaggaacaaacacuaaccauacugauccgcacuggccuucucguaauuagugguguguucccagucagcauccccauuacagcagccgcuugguaccugugggagguuaagaagcagcgggcagggguguugugggaugugccuucuccacccccugucggaaaagccgaauuagaggacggcgcguauagaaucaagcagaggggcauauuuggguacucccagauuggagcugguguguauaaagaaggcaccuuccacacuauguggcauguuacacguggggccguacugaugcaccgcggaaagcggaucgagccgucaugggcagaugugaaaaaggaccucaucaguuacggcgguggguggaagcuggagggagaauggaaagagggcgaagagguccaagugcuugcccuggaaccaggcaagaaucccagagcuguucagaccaaaccuggguuguuuaagacgaacacuggaaccauuggugccgugagccuagauuucuccccaggcacaucugggucgcccaucgucgacaggaaaggaaaggugguaggccuguacgguaauggggucgugacccgaagcggagcauauguuucagcuauagcccagacagagaaguccauugaggauaacccugaaaucgaggacgauauuuuccggaaaaagcgccucacuaucauggaccugcauccgggcgcgggcaaaaccaagagauaccuucccgccauagugagggaagcaauuaaacggggguuacgaacgcugauccucgcuccaacaagagucguggccgcugagauggaagaggcauugcgcggacugccuaucagguaucagacucccgccauucgugccgagcacaccggucgggaaaucguugaccucaugugucaugcuacauuuaccaugagacugcuuaguccagugagggucccuaacuacaaucugauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccaaucaaacgcuccaaucauggacgaggaacgggagauucccgaaaggucuuggaauagcggucacgaguggguaacugauuuuaaggggaagaccgugugguucguuccuaguauaaaagcgggaaacgacaucgccgcaugcuugcgcaagaauggcaaaaaggucauucagcuaucccguaaaacauuugauagcgaauacgugaagaccagagcuaacgacugggauuucguggucacuacagacaucucugagaugggcgccaauuuucgggcagagaggguaauugauccacgccgauguaugaagcccgugauccugaccgacggggaagagagaguuauacucgccggaccuaugccggugacgcauucauccgcugcccagcggaggggucgcaucggcagaaaccccaaaaaugaaaacgaccaauauauuuacaugggggagcccuuagaaaaugaugaggacugcgcgcacuggaaggaggcaaaaaugcugcuugauaacaucaauacuccugaaggaauuauccccaguauguucgagccagaaagggagaaggucgacgccauagauggcgaauaccggcugcguggugaggcucgcaaaacauuuguggaccucaugcgaagaggggauuugccuguuuggcuggccuauaggguggcugcagagggcauuaacuacgccgaccggcgcugguguuucgauggaaucaagaauaaccagauucucgaagagaacgucgaaguggagaucuggaccaaagagggcgaaagaaagaagcugaaacccagguggcuugacgcucggauauauagcgauccacuagcccugaaggaguucaaagaauuugcagcggggcgaaagucguugaccuuaaaucugaucacugagaugggaagacucccuacauucaugacccagaaagcccgcgacgcucuggauaaccuugccguacugcauacagcagaaguggguggcagggcuuacaaucacgcccucucugaguugccggagacucuggaaacgcuacugcuccuuacccuguuagcaacaguuacugggggaauauuuuuguuccugauguccggcaaggguaucgggaagaugacccucggcaugugcugcauuaucacagccagcauacugcuuugguaugcucagauucaaccccacuggaucgcggccucaaucauucuggaguuuuuccucaucgucuugcugauaccagaaccugagaaacagcggaccccacaggacaaccaguuaacuuacguggugauugcaauccuaacggucguugcugccaccauggccaaugaaaugggauuucuggagaagaccaaaaaggaccucggccuugggaguauuacuacccaagagucugaauccaacauccuggauauagacuugcguccagcaagcgcuuggacacuguaugccguggcgaccacuuucguaacaccuaugcucagacauucaaucgagaauaguagcgugaacgucucccugacggcuauugccaaucaggcaaccgugcuuaugggacucgguaggggcuggccccugucuaaaauggauaucgggguuccguugcuggccauuggauguuacagccaggugaacccaaucacuuuaacagcugcacuacugcuccuugucgcccacuacgcgauuaucggcccuggucugcaggcuaaggccacccgcgaagcacaaaagcgggccgcugccgggauaaugaaaaaucccaccguagacggcauuacagugaucgauuuggagccaauccccuaugacccuaaguuugaaaaacagcugggacagguuaugcuccuggugcuuugcgucacucagguguuaaugaugcgaacgaccugggcacugugugaggcucucacauuggccacuggcccgauuuccacccugugggaggggaaccccggaagauucuggaauacaaccauagcggucucaauggccaacaucuuuaggggcucuuaccuagccggugcugggcuacucuucaguauuaugaagaauacuacgaacacacgccggggaaccggcaauaucggugaaacucuuggcgagaaauggaagucgagacugaacgccuugggaaagagcgaauuucaaauuuauaaaaaguccggaauccaggagguggaucguacccuggcaaaagagggcauaaagagaggggaaacagaccaucacgcuguuucucggggaucagccaaacuccgcugguucguggagcgaaacaugguaacuccagaaggcaagguggucgaucuggguugcgggagaggaggcuggagcuacuauugugguggccuuaaaaauguuagggaggugaaggggcuaaccaagggaggcccugggcaugaggaaccaaucccuauguccacauacggauggaaccugguccggcuccagaguggcguggacguauucuuuacgccacccgagaaaugcgauacccuacugugugacauuggugaaucuagcccuaauccaacuaucgaggccgggcgcacauugagagugcugaaccucguugaaaauuggcuuaacaauaacacccaauucugcauuaaggugcugaaucccuauaugccgucagucaucgagaaaauggaaacuuugcagaggaaguacggaggcgcgcuggugcgaaacccucucucccggaauaguacacacgagauguacugggucagcaacgcuaccggcaauauagugucuuccguuaacaugauuucacguauguuaaucaauagauuuacgaugaaacacaagaaggcaaccuaugagccagauguagaccuggggagcggaacacgcaacaucgguauugaaaacgagauacccaaucuugacaucauuggcaaaaggaucgaaaagauuaaacaggagcaugaaacuucguggcacuacgaucaggaccauccuuauaagaccugggccuaccacgggucuuaugagacaaaacaaacuggaagugcuuccagcauggugaacggcgucgugcggcugcuaaccaagccaugggauguugugcccauggucacacagauggccaugaccgacacuacgccguucggucagcagagaguguuuaaggagaaaguagauacacgcacccaagaaccuaaggaggggacuaaaaagcucaugaggaucaccgcagaauggcuguggaaagaguugggaaagaagaaaacaccccgaauguguacgcgggaggaguucaccagaaaggugaggucaaaugccgcucugggcgcgauauuuacugacgagaacaaauggaaguccgcccgcgaagcaguugaggauucucguuucugggaacucgucgaccgggagagaaaucuucaccuggagggcaaaugcgaaacauguguguacaacaugauggggaagagggagaaaaaguuaggagaauuugguaaggcuaaaggcagccgcgccaucugguauauguggcugggggcacgauucuuggaguuugaagcccucggauuccugaaugaggaucauugguuuagucggggcaacucccuaagcgguguggagggggaaggacuucacaagcugggcuacauucucagagacgucucuaaaaaggagggcggggcuauguacgccgaugacaccgcgggaugggacacuaggaucacacuggaagauuugaaaaaugaggaaaugguuaccaaccauaugaagggugagcacaagaaacuggcagaggccauuuucaagcucacauaucagaauaaagugguacgcgugcagagaccaacuccucggggcaccgucauggacaucauuucaaggaaggaucagcgugggaguggacaagugggcacguacggucuuaacaccuucacaaauauggaagcucagcugauacgacagauggagggggaaggaaucuuuaaauccauucaacgcuuaacuguuaccgaggagaucgccgugcagaacuggcuggcaagagucggccgggaaagguugagccgcauggcuaucucuggcgacgauugcgugguaaagccccucgacgauagauucgccucggcucugacagcccuaaaugacauggggaagguucggaaagauauucagcagugggagccaucaaggggauggaacgacuggacucaagugcccuuuugcagccaucacuuccacgaacuugucaugaaggauggucgagugcugguggucccuugucguaaccaggacgagcucauaggcagagcacgcaucucccagggggcgggauggagucugaaagaaaccgccugcuugggcaagucuuaugcucagauguggacguuaauguacuuucaucggagggaucugagacucgccgcaaaugcuauuuguagcgccguuccaucccacugggugccgacaucacgcaccacuuggaguauccaugcaaaacacgaguggaugacaaccgaggacaugcuugccguauggaaccggguguggauucaagaaaaucccuggauggaggacaagacuccugucgaaucuugggaggaagugccauaucuggguaagagggaggaucaguggugcgggagccuaaucggacugaccucccgagcgacaugggcuaaaaacauacagacggccaucaaucagguuagaucacucauuggcaacgaggaauacaccgacuauaugcccagcaugaagcgguucaggaaagaggaagaggaagcaggcguguugugguga

SEQ ID NO: 14720 - RNA, 9876 nt, Artificial Sequence
  derived and/or modified CDS sequence (opt3) from DENV-2__EU482729__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggaaauuaaaggaaucaugcaggccggcaagcgcucgcugagaccucagccaacggagcuuaaauauagcuggaagaccugggggaaggcuaaaauguuguccacugaaucacauaaccaaacauuccugauugacggaccggagaccgccgagugccccaauacaaacagggcauggaauagucucgaagucgaggauuacggcuuugguguuuucucuacuaacaucuggcugaaguuacgugaaaaacaggacguguuuugugacagcaagcugauguccgcggcuauaaaagauaaucgggccgugcacgcagacaugggguauuggauugagucagcccuuaacgauaccuggaagauggagaaggcuagcuucaucgaaguaaaaucuugccacuggccuaagucccauacguuguggaguaauggaguccucgagagcgaaaugaucauuccaaaaaacuucgccggccccgugucucagcacaacuaccgaccugguuaucauacacagaucgcaggcccauggcaccuggggaagcuagagauggacuuugauuucugugaaggaaccacuguuguggucaccgaggacugcggcaauagagggcccucccugaggacaacuaccgcuucaggaaaacucauuacagaguggugcugucgcaguugcacgcugccgccucuucgguacagaggcgaagaugguuguugguacgggauggagauaaggccauugaaggaaaaggaggaaaaccuggugaauagcuuaguuaccgccggacauggccaaaucgacaacuuuucgcucggugugcugggcauggcgcuuuuccuggaggagauguugcgcacucgaguagggacaaaacacgccauucuccugaucgcugucuccuuugugacccuaauuacuggaaauaugucuuuccgggaucugggccgugugauggucaugguuggggcaacaaugaccgacgauaucggaaugggcgugacguaucucgcccugcuugcugccuuuaagguaagacccacuuucgcagcggguuugcuguuaaggaaacucaccagcaaggaacugaugauggccacaauagggaucgcucuucugucacagaguaccauuccugagacuauccuagaacucacagacgcccuggcauugggaaugauggugcugaaaauuguccgcaacauggagaaguaccaguuagcugugaccaucauggccauauccugcguucccaaugcagugauucuccaaaacgccuggaaggucucuuguacaauccuggcugcggugagcguuuccccacuucuguugacuucaagccagcagaaagccgauuggaucccucucgcacugaccauuaagggccuaaaucccacggcuauauuucugacaacccuuagucggacuucuaaaaagagauccuggccacucaacgaagccgugauggccgucggcaugguaagcauccuggcuucgucauugcugaaaaaugacauuccgaugaccgggccuuuaguggcaggaggucuccugacaguuugcuaugugcuuacuggcaggucugccgaccuggaguuggagcgagcggcugaugucaagugggaagaccaggccgagaucaguggguccagccccauucucucuaucaccauaagcgaagauggauccaugucaaucaaaaacgaggaggaagagcaaacgcugacaauucuaauccgcaccggccugcuugugauuagugguguauucccagugagcauccccauaacugcagccgcuugguaccucugggaagucaagaagcagcgggcagggguucugugggacgugccuucuccacccccugugggaaaagccgaguuggaagauggcgcguauagaauuaagcagaggggcaucuuuggguacucccagaucggagcuggugucuauaaagagggcacauuccacaccauguggcaugugacucguggggccguuuuaaugcaccgcggaaagcggauugagccgucaugggcagacguaaaaaaggaucugaucaguuacggcgguggguggaagcucgaaggagaguggaaagaaggcgaggaagugcaaguccuggcccuugagccaggcaagaaucccagagcugugcagacaaaaccugggcuguuuaagaccaacacgggaacuauaggugccguuagcuuggacuucuccccaggcaccucugggucgcccauuguggauaggaaaggaaaggucgugggccuauacgguaaugggguagucacacgaagcggagcauaugugucagcuaucgcccagaccgagaaguccauugaagacaacccugagaucgaagaugacauauuccggaaaaagcgccugacaauuauggaucuccauccgggcgcgggcaaaacuaagagauaccugcccgccaucguuagggaggcaaucaaacgggggcuucgaaccuuaauucuggcuccaacgagaguggucgccgcugaaauggaggaggcacuccgcggauugccuaucagguaucagacacccgccauucgugccgaacacacuggucgggagauaguggaccugaugugucaugcuaccuuuacaaugagacuccugaguccaguuagggugccuaacuacaaucuuaucauuauggacgaagcgcacuucaccgaucccgcaucuaucgccgcucgcggcuauaucagcacucgagucgagaugggggaggccgcaggaauuuuuaugaccgccacaccaccgggcuccagagacccuuucccccaaucaaacgcuccaauaauggaugaagagcgggaaauccccgagaggucuuggaauagcggucacgaaugggugacggacuuuaaggggaagacuguaugguucgugccuaguauuaaagcgggaaacgauaucgccgcaugccugcgcaagaauggcaaaaagguuauucaguugucccguaaaaccuuugacagcgaguacgucaagacaagagcuaacgauugggacuucguggugaccacugauaucucugagaugggcgccaauuuucgggcagaaagggucauagacccacgccgauguaugaagcccguaauccuaacagauggggaggaaagagugauucuggccggaccuaugccgguuacccauucauccgcugcccagcggaggggucgcaucggcagaaacccaaaaaaugagaacgaccaauauauuuacaugggggaaccccucgagaaugacgaggauugcgcguacuggaaggaagcaaaaauguuacuggacaacaucaauacgccugagggaauaauucccaguauguucgaaccagagagggaaaagguggaugccaucgacggcgaguaucggcuucguggugaggcucgcaaaacuuuugucgaucugaugcgaagaggggaccucccugugugguuggccuacaggguugcugcagaaggcauuaacuaugccgaucggcgcugguguuucgacggaaucaagaauaaccagauacuggaggaaaacguggaggucgagaucuggacaaaagaaggcgagagaaagaagcucaaacccagguggcuggaugcucggauuuacagcgacccacuugcccuaaaggaauucaaagaguuugcagcggggcgaaagucgcugaccuugaauuuaaucaccgaaaugggaagacugccuacuuucaugacacagaaagcccgcgaugcucucgacaaccuggccgugcuucacaccgcagagguagguggcagggcuuauaaucaugcccugucugagcucccggaaacauuggagacucugcuacugcucacgcuucuggcaaccgugacagggggaauuuuuuuauucuugauguccggcaaggguaucgggaagaugacucugggcaugugcugcauaauuaccgccagcauccuccugugguacgcucagauccaaccccacuggauugcggccucaaucauacuugaauuuuuccugauuguucucuugaucccagagccugaaaaacagcggacaccccaggauaaccagcugaccuaugucgugauugcaaucuuaacuguggucgcugccacgauggccaaugagaugggauuucuagagaagaccaaaaaggaccugggccucgggaguauaacaacucaagaaucugaguccaacauccuugacauugaucugcguccagcaagcgcuuggaccuuguacgccguugcgacaaccuucgugacuccuaugcugagacacucaaucgaaaauaguagcguaaacgugucccucacagcuauugccaaucaggcaacgguccugaugggacuugguaggggcuggccccucucuaaaauggacaucggggugccgcuguuggccauuggauguuacagccagguuaacccaaucacccugacugcugcauuacuacugcucguggcccauuaugcgauaauuggcccuggucuucaggcuaaggccacacgcgaggcacaaaagcgggccgcugccgggaucaugaaaaaucccaccgucgauggcaucaccguaauugaccuggaaccaauacccuacgauccuaaguuugagaaacaguugggacaggugaugcugcucguucugugcgugacacagguccuuaugaugcgaacuacgugggcauuaugugaggcucugacccucgccacaggcccgaucuccacuuugugggaagggaaccccggaagauucuggaauaccacaauugcggugucaauggccaacaucuuuaggggcucuuaucuggcaggugcugggcuacuguucaguauuaugaagaauaccacuaacacgcgccggggaacaggcaauaccggugagacucucggcgaaaaauggaagucgagacuuaacgcccuggggaagagcgaguuucaaaucuacaaaaaguccggaauacaggaggucgaccguaccuuggcaaaagaaggcaucaagaggggggagacagaucaccaugcugugucucggggaucagccaaacugcgcugguucguugaacgaaacauggugacuccagagggcaagguaguggaccucgguugcgggagaggaggcuggagcuauuacugugguggccugaaaaaugucagggaaguuaagggguuaaccaagggaggcccugggcacgaggagcccauuccuauguccacauauggauggaaccuugugcggcugcagaguggcgucgauguguucuuuacgccacccgaaaaaugcgacacccuccuaugugauaucggugagucuagcccuaauccaacuauugaagccgggcgcacacugagaguauugaaccugguggagaauuggcucaacaauaacacccaauucugcaucaagguucuuaaucccuacaugccgucagugauagaaaaaauggagacucugcagaggaaguacggaggcgcguugguccgaaacccucugucccggaauaguacacaugagauguauugggugagcaacgcuaccggcaauauugucucuuccgugaacaugaucucacguaugcucaucaauagauuuacgaugaaacacaagaaggcaaccuacgaaccagacguugauuuagggagcggaacacgcaacauugguauagagaacgaaauccccaaucuggacauuaucggcaaaaggauugagaagaucaaacaggaacacgagacuucguggcauuaugaccaggaucacccuuacaagaccugggccuaucaugggucuuacgagacaaaacaaacuggaagugcuuccagcaugguaaacggcgugguccggcuucugaccaagccaugggacgugguucccauggugacacagauggccaugaccgauacuacgccguucggucagcagagagucuuuaaggaaaaaguggacacacgcacccaagagccuaaggaagggacuaaaaagcuaaugaggauaaccgcagaguggcucuggaaagagcugggaaagaagaaaacaccccgaauguguacgcgggaagaguucaccagaaagguaaggucaaaugccgcuuugggcgcgaucuuuacugaugaaaacaaauggaaguccgcccgcgaggcaguggaagacucucguuucugggagcugguugaucgggagagaaaucuccaccuugaaggcaaaugcgagacaugugucuauaacaugauggggaagagggaaaaaaagcugggagaguuugguaaggcuaaaggcagccgcgccauuugguacaugugguuaggggcacgauuccuggaauuugaggccuugggauuccucaaugaggaccacugguuuagucggagaaacucccugagcggcguggaaggugaggggcuacauaagcuuggauacauccugagggaugugucuaaaaaggaaggcggcgcuauguaugccgacgauaccgcggggugggacacucgcauuacacucgaggaccugaaaaaugaagagauggucaccaaccacaugaagggagagcauaagaaauuggcagaagccaucuucaagcugacauaccagaauaaaguugugagaguacagcggccaacuccuagggguaccgugauggauauuauaucacguaaggaccagcgaggcagugggcaagucggaacguauggccucaacaccuucacaaauauggaggcucagcuuauccgccagauggaaggugaggggauuuuuaaauccauccaaagacugacugugaccgaggaaaucgccguucagaacugguuagcacgggugggaagggagcgccugagcagaauggcuauuucuggcgaugacugcgucgugaagcccuuggaugaccgguucgccucggcucucacagcccugaaugauaugggcaagguaaggaaagacauacagcagugggaaccaucacgaggguggaacgauuggacucaaguucccuuuugcagccaccauuuccacgagcuagugaugaaggacggacguguccuuguggugccuuguagaaaccaggaugaacugaucggucgcgcacggauuucccagggcgcgggguggagucucaaagagaccgccugccugggaaagucuuacgcucagauguggacguugauguauuuucacaggagagacuuacgccuggccgcaaaugcuaucuguagcgccgucccaucccauuggguuccgacaucacggaccacuuggaguauucacgcaaaacaugaguggaugacaaccgaagauaugcucgccguguggaacaggguauggauccaagagaaucccuggauggaagacaagacuccuguggagucuugggaagaggucccauaccuuggcaagcgagaggaccaguggugcgguagccugauagggcuaaccuccagagcgacaugggcuaaaaacauccagacggccauuaaucaggugcggucacugaucggaaacgaagaguauaccgauuacaugcccagcaugaagagguuccgcaaagaagaggaagaggcaggcguucucugguga

SEQ ID NO: 14721 - RNA, 9876 nt, Artificial Sequence
  derived and/or modified CDS sequence (opt3) from DENV-2__EU482731__SS-prME
accgccggagugaucguaaugcugauucccacuguuauggcuuuccaccucacuacgagaaacggggagccucauaugauagugggaaggcaggaaaaggguaaaagccuucuguuuaagaccgaggacggcguaaauaugugcacauugauggcaaucgauuuaggggaacugugugaggacacuauuaccuacaaaugcccauuacuccggcaaaacgaaccggaggauaucgacuguuggugcaauuccacaucuaccugggugacuuauggaacauguaccacgacuggcgagcaccgccgagaaaagcguucagucgcccuggugccccauguugguauggggcuugagaccagaacagaaacuuggaugaguagcgagggagcguggaaacacgugcagaggauugagaccuggauccugcggcauccuggcuucacaauaauggcugccaucuuggcauacaccauuggcacgacucacuuucagcgcgcccucaucuucauucugcugacagcugucgcaccauccaugaccaugagaugcaucgggauaucuaacagggauuuuguggaaggaguaucggguggcucauggguugacauugugcucgagcacgggagcugugucacuacaauggccaagaauaagcccaccuuagauuucgaacugaucaaaacggaggcuaagcagccugccacccuucggaaauauugcauugaagcgaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggaucgugaccugcgcaauguuuacaugcaaaaagaauauggaaggaaaaauuguccagccugagaaccucgaauacaccauaguuaucacuccacacagcggugaggagcaugccgugggcaaugacacggggaagcacggaaaagaaauuaagaucacaccgcaguccucaaccacugaggcugaacugaccggcuaugguacaguaaccauggaguguagucccaggacugggcuugauuucaacgaaauggugcuguugcaaauggaggacaaagccuggcucguccaccggcagugguuucuggauuuaccucugccauggcuccccggcgcagacacacagggaagcaauuggauacagaaggagacgcuugugaccuucaagaacccucaugcuaaaaagcaagacguugugguccugggcucucaggaaggggccaugcacacugcguugacaggagccaccgagauucagauguccucagguaaucuacuguuuacaggccaucucaaaugccgucugcgcauggauaaacuucaacugaaagggaugagcuacaguauguguacuggaaaguucaagaucgugaaagaaaucgcagagacccagcacggcacgauuguaaucagaguucaguaugagggugacgggucuccaugcaagauucccuucgaaauaaccgauuuggagaaaaggcaugugcucggccggcugaucacagucaacccgauugugacugaaaaggacgcuccugucaacaucgaggccgaacccccauuuggagauuccuacaucauugugggcguugagccugggcaguuaaaacugaauugguucaagaagggaagcucgauaggucaaauguuugagaccacaaugcgaggcgcuaaacgcauggccauccuaggggacacugcaugggauuucggaucucucggcgguguguuuaccuccauugggaaggcccugcaccagguauucggcgcuaucuacggagcggcauuuucaggcgucaguuggacgaugaaaauucuuaucggggugauaaucacauggauuggaaugaacagcagauccaccucuuugagcguuucacuggugcucgucggcgugguaacucuguaucuuggugccauggugcaggcugacaguggguguguugucuccuggaagaauaaagaacugaagugcggaagcggcaucuucauuacagauaacgugcacaccuggacugagcaguacaaguuucaacccgaaucuccaucaaaauuggccagugcaauccagaaggcccaugaggaagguauauguggcauuaggagcgugacccggcucgagaaucugauguggaaacagaucacacccgaguuaaaccacauucuguccgaaaaugaggucaagcuaacgaucaugaccggggacauaaaaggaaucaugcaggcuggcaagcgcucucucagaccucaaccaacugaacugaaauauucguggaagacaugggggaaggccaaaaugcuuagcaccgagucccauaaccagacauucuugauugauggaccggaaacugcagagugccccaauaccaacagggcguggaacucacuggagguugaagacuacggcuuugguguguucacgacaaacaucuggcucaagcugcgugagaaacaggacguguuuugugauaguaaguuaaugucugcugccauuaaagacaaucgggcaguacacgccgauaugggguauuggaucgaaagcgcucugaacgacaccuggaagauggagaaggccuccuucauagaggucaaaucaugccacuggccuaagagccauacucuuuggucuaauggaguguuggaauccgagaugauuauccccaagaauuucgcaggccccguuagucagcacaacuaccgaccugguuaucauacccaaacagcuggcccauggcaccucgggaagcuggaaauggauuuugacuucugugagggaacuaccguggucgugacagaagauugcggcaauagagggcccagccuaaggacgaccacugccucuggaaaacugaucacagaguggugcugucgcuccugcacccucccgccucugcgguacagaggcgaggacgguuguugguacgggauggaaauuaggccacuuaaggagaaggaagagaacuugguuaauucacuggugacugcgggacauggccagaucgauaacuuuaguuuagguguacucggcauggcccuguuccuugaagagaugcugcgcacacgagucgggaccaaacacgcuacguugcucguggcacugagcuuugugacucuaauuaccggaaauaugucguuccgggaccugggccgugucaugguuauggugggggccacaaugaccgaugacauaggaaugggcguaacuuaucucgcucugcuugccgcauuuaaggugagacccacauucgcggccgguuugcuguuaaggaaacucaccuccaaggagcugaugauggcuacaaucgggauugcccuucugucucagagcacucuaccugaaaccauccucgagcugacggaugcauuggcucugggaaugauggucuuaaaaauugugcgcaacauggaaaaguaccaacucgccguuacaaucauggcaauaucaugcgugcccaaugccgucauccugcagaacgcuuggaaggugaguuguaccauucuugcggccguuuccgugucuccacuguugcucacuagcucccagcagaaagcagacuggaucccucuggcucuaaccauuaagggccugaaucccacagccaucuuucuuacuacccucucacggacgagcaaaaagagaaguuggccacugaacgaggccauaauggcugucggcaugguaucuauuuuggcauccagccugcuaaagaaugacaucccgaugacagggccucucguggccggaggucugcuuaccguuugcuaugugcugacuggcaggucggcggauuuggaacucgagcgagcugccgacgucaagugggaggaucaagcagaaaucucagggucuagucccauucuguccauaacaaucagcgaggacggaucuaugagcauuaaaaacgaagaggaggaacagacccuaacuauccugauucgcacaggccuucucgugaucuccgguguauucccagugucaauacccaucaccgccgcugcaugguaccugugggaggucaagaagcagcgggccgggguuuugugggaugugccuaguccacccccugugggaaaagcggaauuagaggacggcgcuuauagaauuaagcagaggggcauccugggguacagccaaauuggagccggugucuauaaagaaggcacguuucacacuauguggcaugugacccguggggcaguucucaugcaccgcggaaagcggaucgagccgucuugggccgaugucaaaaaggaccugauauccuacggcgguggguggaaacuugagggagaauggaaagagggcgaagaggugcagguccuggcuuuggaaccaggcaagaaucccagagccgugcagacaaaaccugggauuuucaagaccaacacaggaacuaucggugcaguuucacuagauuuuaguccaggcaccagcgggucccccaucguggacaggaaaggaaaggucgugggccuguacgguaaugggguagucacgcgaucuggagcuuaugugucggccauugcgcagacagaaaagagcaucgaggauaacccugaaauagaggacgauauuuuccggaaaaagcgccucacuaucauggaccugcauccgggcgccggcaaaaccaagagauaccuucccgcaauuguuagggaagcuaucaaacggggguuacgaacacugauacucgccccaaccagaguggucgcugcagagauggaagaggccuugcgcggacugccuauuagguaucaaacucccgccauccgugcugagcacaccggucgggaaaucguggaccucaugugucaugcgacauucacgaugagacugcuuucaccaguuagggugccuaacuacaaucugauuaucauggaugaggcacacuuuacugaccccgccuccauugcugcccgcggcuauauaaguacccgagucgaaaugggggaggcagccggaaucuucaugacagcuaccccaccgggcucuagagauccuuuuccccagagcaacgcgccaauuaucgacgaggaacgggagauccccgaaagguccuggaacucaggucacgagugggugacugauuucaaggggaagacaguaugguuugugccuucuauuaaagccggaaacgacauagcagcuugcuugcgcaagaauggcaaaaagguuauccagcuaagccguaaaaccuucgauagugaauacgucaagacgagagccaacgacugggauuuuguggugacuacagacauuuccgagaugggcgcaaauuucaaggccgagcgggucaucgauccaaggcgcuguaugaaacccguaauucugaccgacggggaagaacgagugauccucgcuggaccuaugccgguuacccauagcucugccgcgcaaagacgggguaggauaggccgcaacccaaagaaugaaaacgaccaguauaucuacaugggggagcccuuagaaaaugaugaggacugcgcacacuggaaagaggccaagaugcugcuugauaacauuaauacuccugaaggaaucauucccucaauguuugagccagaaagagagaaaguggacgcuaucgauggcgaauacaggcugcggggugaggcccguaagacauucgucgaccucaugcgccgaggggauuugccuguguggcuggcuuauaaaguugcagccgagggcauaaacuacgcugacagaaagugguguuuugauggaauuaagaauaaccagauccucgaagagaacguggaagucgagauuuggaccaaagagggcgaaaggaagaaacugaagccccgguggcuugacgcccgcaucuauuccgauccacuagcacugaaagaguucaaggaguucgcggccgggagaaagaguuugacauuaaaucugauaacugagaugggaaggcucccuacguuuaugacccagaaagcucggaacgcccuggacaaucuugcagugcugcauacagcugaaguagguggccgagcccacaaccacgcacucagcgaguugccggagacucuggaaacccuacugcuccuuacacuguuagccaccgugacugggggaaucuucuuguuucugaugucgggcaaggguauugggaaaaugacgcucggcaugugcugcaucauuaccgcuucuauccugcuuugguacgcgcaaauacagccccauuggauugccgcauccaucauccuggaguucuuucucauuguuuugcugaucccagaaccugagaagcagagaacaccccaggauaaucaauuaacuuaugucgugauagcuauucuaaccguggucgccgccacaauggcaaacgaaaugggauuccuggagaaaaccaagaaggaccucggcuuugggagcaucacuacacaggagucagaaaguaauauucuugacaucgaucugcgcccagcuucugccuggacguuguacgcgguugcuaccacuuucgugacaccuaugcugaggcacuccauagagaacagcucaguaaaugugagucucaccgccaucgcaaaccaggccaccguccugaugggacuugguaaaggcuggccccucagcaagauggacauuggggugccgcuguuggcuaucggauguuauucccagguuaauccaauuacacugacugcagccuuacuacugcucguggcgcauuacgcuaucauuggcccuggucuucaagccaaagcaacgcgggaagcccagaagcgugcugccgcagggaucaugaaaaaccccaccgucgauggcauaacaguaauugaccuggagccaauccccuacgauccuaaguuugaaaagcaguugggacaggugaugcugcucauccugugcguuacucaagugcuuaugaugagaaccacaugggcuuuaugugaggcccugacccucgcgacuggcccgauuucuacguugugggaggggaaucccggaagguucuggaacacaaccauagccgucagcauggcaaauaucuuucgcggcuccuaucuggcuggugccgggcuacuguucucaauuaugaaaaacacuaccaauacacggcgaggaacuggcaacgugggugaaacccucggcgagaaguggaaaucuagacuuaacgcacuggggaagagugaauuucagaucuacaaaaagucgggcauucaggaggucgacaggacauuggcuaaagagggcaucaagcgcggggaaacggaucaccaugccgugagccggggauccgccaagcugagaugguucguugagcguaauauggugaccccagaaggcaaaguaguggaccucgguugcgggaggggaggcuggucuuauuacugugguggccugaagaacguccgggagguuaaaggguuaacuaagggaggcccugggcacgaggaaccaauaccuaugucaacauauggauggaaucuugugcgccugcaaagcggcgucgauguguucuuuaccccacccgagaaaugcgacacucuccuaugugauaucggugaauccaguccuaacccaacaauugaggcggggcgaacccugagaguauugaaucugguggaaaacuggcucaauaacaauacgcaguucugcaucaagguucuuaaccccuacaugccgucugugauugagaagauggaaacccugcagaggaaauauggaggcgcuuugguccggaauccucugagccgcaacucaacacacgagauguacuggguguccaaugcaacuggcaacaucgucaguagcgugaauaugauaucuagaaugcucauuaacagguuuaccaugaagcauaaaaaggccacauacgagccagacguugauuuaggguccggaacucgaaacaucgguaucgaaucagagauucccaaucuggacauaaucggcaaacggauugaaaagaucaagcaggagcacgaaaccagcuggcauuaugaccaagaucacccuuacaaaacaugggcuuaucacgggucguacgagaccaagcagacuggaucugccaguuccaugguaaacggcgugguccgucuucugacgaaaccaugggacgugguucccauggugacacagauggcaaugaccgauacuaccccguucggucagcaaagagucuuuaaggagaaaguggacacacgcacgcaggaaccuaaggaggggaccaagaaacuaaugaagauuacugccgaauggcucuggaaagagcugggaaagaaaaagacacccaggauguguacccgggaggaguucacuagaaaaguacgcagcaaugcugcguugggcgccaucuuuacagaugagaacaaguggaagucagcaagggaagcuguggaggacggccgauucugggaacugguugaucgggagagaaaucuccaucuugaggggaaaugcgaaaccugugucuauaacaugaugggaaagagggagaaaaagcugggugaauuuggcaaagccaaggggucccgcgcaauaugguacaugugguuaggagcccguuuccuggaguuugaggcuuugggcuuccucaaugaggaccacugguuuucucgggguaacagccugagugggguggagggagaaggccuacauagacuuggcuauauccugagggagguggggaagaaagaaggaggugccauguacgcggaugacacagcaggcugggauacucgcauuacccucgaggaccugaagaaugaagagauggucacgaaccacaugaaaggggagcauaagaaauuggccgaagcuaucuucaagcugaccuaccagaauaagguugugcgaguacagcggccaacaccuagaggaacugugauggacauuaucuccaggaaagaucaacgcggcagcggucaggucgggaccuauggacucaacacauucacuaauauggaggcccagcuuauuagacaaauggaaggcgagggcauauuuaagucuauccagcaccugaccgcaacggaggaaauugcugugcagaacugguuagcccggguugggagggagcgucugucacgaauggcuaucaguggagacgauugcguggucaaacccaucgacgaucgcuucgccuccgcauugacagcgcucaaugacauggguaaggugagaaaagauauucagcaaugggaaccaagccggggcuggaacgacuggacccagguacccuuuugcucucaccauuuccacgagcugguuaugaaggaugggagggugcuagucgugccuugucgcaaccaggacgaacuuauaggcagagcacggaucucgcagggagcugguuggucacugaaggagacugccugccucgggaaaagcuacgcacaaauguggacacugauguauuuucauaggcgagauuugcguuuagcugccaaugcaauuuguuccgccgugccaagucacugggucccgaccucuagaacuaccuggagcauccacgcgaagcaugaguggaugacaacggaagacaugcuggcuguuuggaaccgcguguggauucaggagaaucccuggauggaagauaaaaccccuguagaguccugggaagaggugccauaccucggaaagcgggaggaccaguggugcggcucacuuaucggccugacaaguagggccacaugggccaaaaauauacagaccgccaucaaucaagucagaucucuaauugggaacgaagaguauacugacuacaugcccagcaugaagcgcuuccggagggaagaggaagaggcuggagugcugugguga

SEQ ID NO: 14722 - RNA, 9876 nt, Artificial Sequence
  derived and/or modified CDS sequence (opt3) from DENV-2__EU482732__SS-prME
accgugggcgucaucauuaugcugauacccacagccauggcuuuccaccucacuacgagaaacggggagccucauaugaucguuggaaggcaggaaaaggguaaaagccuucuguuuaagaccgaggacggcgugaauaugugcacauugauggcaauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcccuggucccccauguggguauggggcuugagaccagaacagaaacuuggaugaguagcgagggagcguggaaacacguucagaggaucgagaccuggauacugcggcauccuggcuucacaaucauggcugccauuuuggcauacaccaucggcacgacucacuuucagcgcgcccucauuuucauccugcugacagcuguggcaccauccaugaccaugagaugcauagggauuucuaacagggauuuugucgaaggagugucggguggcucauggguagacaucguucucgagcacgggagcugugugacuacaauggccaagaauaagcccaccuuagauuucgaacugauuaaaacggaggcuaagcagccugccacccuucggaaauauugcaucgaagcgaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggauugugaccugcgcaauguuuacaugcaaaaagaauauggaaggaaaagugguccucccugagaaccuggaauacaccauaguuaucacuccacacagcggugaggagcaugccgugggcaaugacacggggaagcacggaaaagaaauuaagaucacaccgcaguccucaauaaccgaggcugaacuuacuggcuaugguaccguaacaauggaguguagucccaggaccgggcuggauuucaacgaaaugguguugcuccagauggaggacaaagccuggcugguccaccggcaaugguuuuuagaucugccucucccauggcuucccggcgcagacacucagggaagcaauuggauucagaaggagacacuggugacguucaagaacccucaugcuaaaaagcaggacguuguggucuugggcucucaagaaggggccaugcacaccgcgcuaacuggagccacagagauccagauguccucagguaaucugcucuuuaccggccaucugaaaugccgucuucgcauggauaagcugcaguugaaagggaugagcuacaguauguguacaggaaaguucaagaucgugaaagaaauugcagagacucaacacggcaccaucguaauuagaguucaguaugagggugacgggucuccaugcaagauacccuucgaaaucauggaucucgagaaaaggcaugugcugggccgguuaauuacggucaacccgaucgugaccgaaaaggacuccccugucaacaucgaggcugaacccccauuuggagauagcuacauuauaaucggcguggagccugggcagcugaaacuaaauugguucaagaagggaucgucuauuggucagauguuugagacaacuaugcgaggcgccaaacgcauggcuauccucggggacaccgccugggauuucggaucccugggcggugcauuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauuccaaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcucuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacacacacugaccauacuaauccgcacuggccugcuuguaauuagugguguguucccagucagcauccccauuacagcagccgcuugguaccucugggagguuaagaagcaacgggcaggggugcugugggaugugccuucuccacccccugucggaaaagccgaauuggaggacggcgcguauagaaucaagcagaggggcauauuuggguacucccagauuggagcugguguguauaaagaaggcaccuuccauacuauguggcacguuacacguggggccguauuaaugcaucgcggaaagcggaucgagccgucaugggcagaugugaaaaaggaccugaucaguuacggcgguggguggaagcucgagggagaauggaaagagggcgaagagguccaggugcuggcccuugaaccaggcaagaaucccagagcuguucaaaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccacccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcauaccggucgggaaaucguugaccugaugugucacgcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccagucaaacgcuccaaucauggacgaggaacgggagauucccgaaaggucuuggaauagcggucaugaguggguaacugauuuuaaggggaagaccgugugguucguuccuaguauaaaagcgggaaacgacaucgccgcaugccugcgcaagaauggcaaaaaggucauucaauugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcacucauccgcugcccagcggaggggucgcaucggcagaaacccaaaaaaugaaaacgaccaguauauuuacaugggggagccccucgaaaaugaugaggacugcgcgcauuggaaggaggcaaaaauguuacuggauaacaucaauacuccugaaggaauuauccccaguauguucgagccagaaagggagaaggucgacgccauagauggcgaauaccggcuucguggugaggcucgcaaaacauuuguggaccugaugcgaagaggggaucucccuguuugguuggccuauaggguggcugcagagggcauuaacuacgccgaccggcgcugguguuucgauggaaucaagaauaaccaaauucuggaagagaacgucgaaguggagaucuggaccaaagagggcgaaagaaagaagcucaaacccagguggcuggacgcucggauauauagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucacacagcagaaguggguggcagggcuuacaaucacgcccugucugagcucccggagacuuuggaaacgcugcuacugcucacccuucuggcaacaguuacugggggaauuuuuuuauucuugauguccggcaaggguaucgggaagaugacccugggcaugugcugcauuaucacagccagcauacuccugugguaugcucagauucagccccauuggaucgcggccucaaucauucuugaguuuuuccugaucguccucuugauaccagaaccugagaaacaacggaccccccaggacaaccagcugacuuacguggugauugcaaucuuaacggucguugcugccaccauggccaaugaaaugggauuucuagagaagacaaaaaaggaccugggccucgggaguauuacuacccaggagucugaauccaacauccuugauauagaccugcguccagcaagcgcuuggacauuguaugccguggcgaccacuuucguaacaccuaugcugagacacucaaucgagaauaguagcgugaacgucucccucacggcuauugccaaucaagcaaccgugcugaugggacuugguaggggcuggccccucucuaaaauggauaucgggguuccgcuguuggccauuggauguuacagccaggugaacccaaucacucugacagcugcauuacuacugcucgucgcccauuacgcgauuaucggcccuggucuucaggcuaaggccacccgcgaagcacagaagcgggccgcugccgggauaaugaaaaaucccaccguagacggcauuacagugaucgaucuggagccaauccccuaugacccuaaguuugaaaaacaauugggacagguuaugcugcucgugcugugcgucacucaggugcuuaugaugcgaacgaccugggcauuaugugaggcucugacacucgccacuggcccgauuuccaccuugugggaggggaaccccggaagauucuggaauacaaccauagcggucucaauggccaacaucuuuaggggcucuuaccuggcaggugcugggcuacuguucaguauuaugaagaauacuacgaacacacgccggggaaccggcaauaucggugaaacucucggcgagaaauggaagucgagacuuaacgcccuggggaagagcgaauuucagauuuauaaaaaguccggaauccaagagguggaucguaccuuggcaaaagagggcauaaagaggggggaaacagaccaccaugcuguuucucggggaucagccaaacugcgcugguucguggagcgaaacaugguaacuccagaaggcaagguggucgaucucgguugcgggagaggaggcuggagcuacuauugugguggccugaaaaauguuagggaggugaagggguuaaccaagggaggcccugggcacgaagagcccaucccuauguccacauacggauggaaccuuguccggcugcagaguggcguggacguauucuuuacgccacccgagaaaugcgauacccuccuaugugacauuggugaaucuagcccuaauccaacuaucgaggccgggcgcacacugagaguguugaaccugguugaaaauuggcucaacaauaacacccaguucugcauuaaggugcuuaaucccuauaugccgucagucaucgagaaaauggaaacucugcaaaggaaguacggaggcgcguuggugcgaaacccucugucccggaauaguacacacgagauguacugggucagcaacgcuaccggcaauauagugucuuccguuaacaugauuucacguaugcucaucaauagauuuacgaugaaacauaagaaggcaaccuaugagccagauguagacuuagggagcggaacacgcaacaucgguauugaaaacgagauacccaaucuggacaucauuggcaaaaggaucgaaaagauuaaacaggagcacgaaacuucguggcauuacgaucaggaccacccuuauaagaccugggccuaccacgggucuuaugagacaaaacagacuggaagugcuuccagcauggugaacggcgucgugaagcuucugaccaagccaugggauguugugcccauggucacacaaauggccaugaccgacacuacgccguucggucagcagcggguguuuaaagagaagguagauacaagaacccaggaaccuaaagaggggacuaagaaacuaaugcgcaucaccgcagaauggcucuggaaggagcugggaaagaaaaagacacccaggauguguacgcgagaggaauucacccggaaagugagaucaaaugccgcuuugggcgcgauauuuacugacgagaacaaguggaaauccgccagggaagcaguugaggauucucgcuucugggaacuggucgaccgugagcggaaucuccaucuugagggcaagugcgaaacauguguguacaacaugauggggaaaagagagaagaagcugggagaauuugguaaagcuaagggcagcagggccaucugguauaugugguuaggggcacgcuuccuggaguuugaagccuugggauuccucaaugaggaucacugguuuagucgaggcaacucccugagcgguguggagggggaaggacuacauaaacuuggcuacauucugcgggacgucucuaagaaagagggcggggcuauguacgccgaugacaccgcgggaugggacacuagaaucacacucgaagaucugaagaaugaggaaaugguuaccaaccacaugaagggugagcauaaaaaguuggcagaggccauuuucaaacugacauaucaaaauaaggugguaagggugcagcgcccaacuccuagaggcaccgucauggacaucauuucacggaaagaucagagggggaguggacaggugggcacguacggucucaacaccuucacaaauauggaagcucaacuuauacgucagauggagggggaaggaaucuuuaaguccauucagcgacugacuguuaccgaggagaucgccgugcaaaacugguuagcacgcgucggcagagaacggcugagcaggauggcuaucucuggcgacgauugcgugguaaagcccuuggacgaucgcuucgccucggcucucacagcccugaaugacauggggaaaguuagaaaggauauucagcagugggagccaucacggggauggaacgacuggacucaggugcccuuuugcagccaccacuuccaugaacuagucaugaaagaugguagggugcuuguggucccuugucgaaaccaagacgagcugauaggccgugcaagaaucucccagggggcgggauggagucucaaggaaaccgccugccugggcaaaucuuaugcucagauguggacguugauguacuuucaccgccgggauuuaaggcuggccgcaaaugcuauuuguagcgccguuccaucccauugggugccgacaucaagaaccacuuggaguauccacgcaaagcacgaguggaugacaaccgaggacaugcucgccguauggaaccgcguguggauucaggaaaaucccuggauggaggacaagacuccugucgaaucuugggaggaagugccauaucuugguaaacgggaggaucaauggugcgggagccugaucggacuaaccuccagggcgacaugggcuaagaacauacagacggccaucaaucagguucgaucacugauuggcaacgaggaauacaccgacuauaugcccagcaugaaaagauuccggaaggaggaagaggaagcaggcgugcucugguga

SEQ ID NO: 14723 - RNA, 9876 nt, Artificial Sequence
  derived and/or modified CDS sequence (opt3) from DENV-2__EU482733__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauuccaaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcucuucugucacagaguacuauaccugaaacaauccuagagcucaccgaugcccuggcauugggaaugaugguccugaaaauugugcgcaacauggaaaaguaccaguuagcuguuacaaucauggccauuuccugcgugcccaaugcagucauccuccaaaacgccuggaaggugucuuguacuauacuggcugcgguuagcguguccccacuucuguugaccucaagccagcagaaagccgacuggauuccucucgcacugacgaucaagggccuaaaucccacagcuaucuuucugaccacucuuagucggaccucuaaaaagagauccuggccacucaacgaggccgucauggccguaggcauggugagcauucuggcuucgucauugcugaaaaaugacauaccgaugacagggccuuuaguugcaggaggucuccugacugugugcuauguccuuaccggcaggucugccgaucuggaauuggagcgagcggcugacgugaagugggaggaucaggccgaaaucaguggguccagccccauucucucuaucacgauuagcgaggacggauccaugucaaucaaaaacgaagaggaggaacaaacacugaccauacuaauccgcacuggccugcuuguaauuagugguguguucccagucagcauccccauuacagcagccgcuugguaccucugggagguuaagaagcagcgggcaggggugcugugggaugugccuucuccacccccugucggaaaagccgaauuggaggacggcgcguauagaaucaagcagaggggcauauuuggguacucccagauuggagcugguguguauaaagaaggcaccuuccacacuauguggcauguuacacguggggccguauuaaugcaccgcggaaagcggaucgagccgucaugggcagaugugaaaaaggaccugaucaguuacggcgguggguggaagcucgagggagaauggaaagagggcgaagagguccaagugcuggcccuugaaccaggcaagaaucccagagcuguucagaccaaaccugggcuguuuaagacgaacacuggaaccauuggugccgugagcuuggauuucuccccaggcacaucugggucgcccaucgucgacaggaaaggaaaggugguaggccuauacgguaauggggucgugacccgaagcggagcauauguuucagcuauagcccagacagagaaguccauugaggauaacccugaaaucgaggacgauauuuuccggaaaaagcgccugacuaucauggaccuccauccgggcgcgggcaaaaccaagagauaccugcccgccauagugagggaagcaauuaaacgggggcuucgaacguuaauccuggcuccaacaagagucguggccgcugagauggaagaggcacuccgcggauugccuaucagguaucagacucccgccauucgugccgagcacaccggucgggaaaucguugaccugaugugucaugcuacauuuaccaugagacuccugaguccagugagggucccuaacuacaaucuuauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccaaucaaacgcuccaaucauggacgaggaacgggagauucccgaaaggucuuggaauagcggucacgaguggguaacugauuuuaaggggaagaccgugugguucguuccuaguauaaaagcgggaaacgacaucgccgcaugccugcgcaagaauggcaaaaaggucauucaguugucccguaaaacauuugauagcgaauacgugaagaccagagcuaacgacugggauuucguggucacuacagacaucucugagaugggcgccaauuuucgggcagagaggguaauugauccacgccgauguaugaagcccgugauccuaaccgacggggaagagagaguuauacuggccggaccuaugccggugacgcauucauccgcugcccagcggaggggucgcaucggcagaaacccaaaaaaugaaaacgaccaauauauuuacaugggggagccccucgaaaaugaugaggacugcgcgcacuggaaggaggcaaaaauguuacuggauaacaucaauacuccugaaggaauuauccccaguauguucgagccagaaagggagaaggucgacgccauagauggcgaauaccggcuucguggugaggcucgcaaaacauuuguggaccugaugcgaagaggggaucucccuguuugguuggccuauaggguggcugcagagggcauuaacuacgccgaccggcgcugguguuucgauggaaucaagaauaaccagauucuggaagagaacgucgaaguggagaucuggaccaaagagggcgaaagaaagaagcucaaacccagguggcuggacgcucggauauauagcgauccacuugcccuaaaggaguucaaagaauuugcagcggggcgaaagucgcugaccuugaauuuaaucacugagaugggaagacugccuacauucaugacccagaaagcccgcgacgcucucgauaaccuggccguacuucauacagcagaaguggguggcagggcuuacaaucacgcccugucugagcucccggagacuuuggaaacgcugcuacugcucacccuucuggcaacaguuacugggggaauuuuuuuauucuugauguccggcaaggguaucgggaagaugacccugggcaugugcugcauuaucacagccagcauacuccugugguaugcucagauucaaccccacuggaucgcggccucaaucauucuugaguuuuuccugaucguccucuugauaccagaaccugagaaacagcggaccccccaggacaaccagcugacuuacguggugauugcaaucuuaacggucguugcugccaccauggccaaugaaaugggauuucuagagaagacaaaaaaggaccugggccucgggaguauuacuacccaagagucugaauccaacauccuugauauagaccugcguccagcaagcgcuuggacauuguaugccguggcgaccacuuucguaacaccuaugcugagacauucaaucgagaauaguagcgugaacgucucccucacggcuauugccaaucaggcaaccgugcugaugggacuugguaggggcuggccccucucuaaaauggauaucgggguuccgcuguuggccauuggauguuacagccaggugaacccaaucacucugacagcugcauuacuacugcucgucgcccacuacgcgauuaucggcccuggucuucaggcuaaggccacccgcgaagcacaaaagcgggccgcugccgggauaaugaaaaaucccaccguagacggcauuacagugaucgaucuggagccaauccccuaugacccuaaguuugaaaaacaguugggacagguuaugcugcucgugcugugcgucacucaggugcuuaugaugcgaacgaccugggcauuaugugaggcucugacacucgccacuggcccgauuuccaccuugugggaggggaaccccggaagauucuggaauacaaccauagcggucucaauggccaacaucuuuaggggcucuuaccuggcaggugcugggcuacuguucaguauuaugaagaauacuacgaacacacgccggggaaccggcaauaucggugaaacucucggcgagaaauggaagucgagacuuaacgcccuggggaagagcgaauuucaaauuuauaaaaaguccggaauccaggagguggaucguaccuuggcaaaagagggcauaaagaggggggaaacagaccaucacgcuguuucucggggaucagccaaacugcgcugguucguggagcgaaacaugguaacuccagaaggcaagguggucgaucucgguugcgggagaggaggcuggagcuacuauugugguggccugaaaaauguuagggaggugaagggguuaaccaagggaggcccugggcaugaagagcccaucccuauguccacauacggauggaaccuuguccggcugcagaguggcguggacguauucuuuacgccacccgagaaaugcgauacccuccuaugugacauuggugaaucuagcccuaauccaacuaucgaggccgggcgcacacugagaguguugaaccugguugaaaauuggcucaacaauaacacccaauucugcauuaaggugcuuaaucccuauaugccgucagucaucgagaaaauggaaacucugcagaggaaguacggaggcgcguuggugcgaaacccucugucccggaauaguacacacgagauguacugggucagcaacgcuaccggcaauauagugucuuccguuaacaugauuucacguaugcucaucaauagauuuacgaugaaacacaagaaggcaaccuaugagccagauguagacuuagggagcggaacacgcaacaucgguauugaaaacgagauacccaaucuggacaucauuggcaaaaggaucgaaaagauuaaacaggagcaugaaacuucguggcacuacgaucaggaccauccuuauaagaccugggccuaccacgggucuuaugagacaaaacaaacuggaagugcuuccagcauggugaacggcgucgugcggcuucugaccaagccaugggauguugugcccauggucacacagauggccaugaccgacacuacgccguucggucagcagagaguguuuaaggagaaaguagauacacgcacccaagaaccuaaggaggggacuaaaaagcuaaugaggaucaccgcagaauggcucuggaaagagcugggaaagaagaaaacaccccgaauguguacgcgggaggaauucaccagaaaggugaggucaaaugccgcuuugggcgcgauauuuacugacgagaacaaauggaaguccgcccgcgaagcaguugaggauucucguuucugggaacuggucgaccgggagagaaaucuccaccuugagggcaaaugcgaaacauguguguacaacaugauggggaagagggagaaaaagcugggagaauuugguaaggcuaaaggcagccgcgccaucugguauaugugguuaggggcacgauuccuggaguuugaagccuugggauuccucaaugaggaucauugguuuagucggggcaacucccugagcgguguggagggggaaggacuacacaagcuuggcuacauucugagagacgucucuaaaaaggagggcggggcuauguacgccgaugacaccgcgggaugggacacuaggaucacacucgaagaucugaaaaaugaggaaaugguuaccaaccauaugaagggugagcacaagaaauuggcagaggccauuuucaagcugacauaucagaauaaagugguacgcgugcagagaccaacuccucggggcaccgucauggacaucauuucaaggaaggaucagcgugggaguggacaagugggcacguacggucucaacaccuucacaaauauggaagcucagcuuauacgacagauggagggggaaggaaucuuuaaauccauucaacgccugacuguuaccgaggagaucgccgugcagaacugguuagcaagagucggccgggaaaggcugagccgcauggcuaucucuggcgacgauugcgugguaaagcccuuggacgauagauucgccucggcucucacagcccugaaugacauggggaagguucggaaagauauucagcagugggagccaucaaggggauggaacgacuggacucaagugcccuuuugcagccaucacuuccacgaacuagucaugaaggauggucgagugcuuguggucccuugucguaaccaggacgagcugauaggcagagcacgcaucucccagggggcgggauggagucucaaagaaaccgccugccugggcaagucuuaugcucagauguggacguugauguacuuucaucggagggauuuaagacuggccgcaaaugcuauuuguagcgccguuccaucccacugggugccgacaucacgcaccacuuggaguauccaugcaaaacacgaguggaugacaaccgaggacaugcucgccguauggaaccggguguggauucaagaaaaucccuggauggaggacaagacuccugucgaaucuugggaggaagugccauaucuugguaagagggaggaucaguggugcgggagccugaucggacuaaccucccgagcgacaugggcuaaaaacauacagacggccaucaaucagguuagaucacugauuggcaacgaggaauacaccgacuauaugcccagcaugaagcgguucaggaaagaggaagaggaagcaggcgugcucugguga

SEQ ID NO: 14724 - RNA, 9876 nt, Artificial Sequence
  derived and/or modified CDS sequence (opt3) from DENV-2__EU482734__SS-prME
accgcaggcgugaucgucaugcugauucccacggcuauggcauuccaccucacuacgcguaacggggagccucauaugauaguuggaaggcaggaaaaggguaagagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauaaugaucacuccacacagcggugaggagcaugcugucggcaaugacacggggaagcacggaaaagaaauuaagaucacaccgcaguccucaauaaccgaggccgaacugacuggcuaugguaccguuacaauggaguguagucccaggaccgggcuugauuucaacgaaauggugcuguugcaaauggaggacaaagcauggcucguacaccggcagugguuucuggauuuaccucugccauggcuccccggcgcugacacucagggaagcaauuggauucagaaggagacacuugugacguucaagaacccucaugccaaaaagcaagacgucgugguucugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgugaaagaaauugcugagacucagcacggcaccaucgucauuagagugcaguaugagggugacgggucuccaugcaagauacccuucgaaaucauggauuuggagaaaaggcauguacucggccggcugauuacgguuaacccgaucgugaccgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaguggggaaggcccugcaccagguuuucggcgcuauuuacggagcggcauuuaguggcgugagcuggacuaugaaaauccuuauagggguaaucauuaccuggaucggaaugaacuccagaucuacgagcuugucagucagucuggugcucguuggcguggucacacuguaucuuggugccauggugcaggcugacuccggguguguagugagcuggaagaauaaagaacugaagugcggaucuggcauuuucaucaccgauaacguucacacuuggacagagcaguacaaguuucaacccgaaucaccaaguaaauuggccagcgcaauacagaaggcccaugaggaagguauuuguggcaucagguccgucacccggcucgagaaucugauguggaaacagauuacucccgaguuaaaccacauccugucugaaaaugaggugaagcuaaccauaaugacaggggacaucaaaggaauuaugcaggcuggcaagcgcucgcucagaccucaaccaacggaacugaaauauagcuggaagaccugggggaaggccaaaaugcuuuccacugagucacauaaccagacauucuugaucgauggaccggaaaccgcagagugccccaauacaaacagggcguggaauagucuggagguggaagacuacggcuuuggugucuucacuaccaacauuuggcucaagcugcgugagaaacaggacguauuuugugauucuaaguuaaugagcgcugccaucaaagacaaucgggcagugcacgccgauaugggguauuggauagaauccgcucugaacgacacguggaagauggagaaggccucauucauugaggugaaaagcugccacuggccuaagucucauacacuuugguccaauggaguauuggaaagugagaugaucauccccaagaauuucgcaggccccgucagccagcacaacuaccgaccugguuaucauacccaaacugcuggcccauggcaccucgggaagcuggaaauggauuuugacuucugugagggaaccacagugguugugacugaagauugcggcaauagagggcccucucuaaggaccacaacggccuccggaaaacugauuaccgaguggugcugucgcucaugcacucucccgccucugcgguacagaggcgaggacgguuguugguacgggauggaaaucaggccacuuaaggagaaggaagagaacuuggucaauagucuggugacagcgggacauggccagauugauaacuuuagcuuagguguucucggcauggcccuguuccuugaagagaugcugcgcacccgaguggggacuaaacacgcuauauugcucguagcagucucguuugugacacugaucaccggaaauauguccuuccgggaccuaggccgugugauggucaugguuggggccacgaugacugaugacauuggaaugggcgugaccuaucuggcucuccuggccgcauuuaagguaagacccacauucgcggccggucuuuugcugaggaaauuaaccucuaaggagcucaugauggcuacuaucgggauugcccugcuuagccagucaacaaucccugaaaccauacuggagcuaacagaugcacucgcucugggaaugauggccuugaaaaucgugaagaacauggaaaaguaccaacuggcagucacuauuauggccaucaguugcgugcccaaugcuguuauuuuacagaacgcguggaaaguguccuguaccauccucgccgcagucucugugagcccacugcuucugacguccucacagcagaaggcugacuggauaccuuuggcccucacaauuaaaggccugaaucccaccgccaucuuucuaacuacccugagccgcacaaguaagaaacggucuuggccacuuaacgaggcuaucauggcaguuggcaugguguccauucucgccagcucgcuguugaagaaugacauaccgaugacugggccucuggucgcgggagguuuacucaccguaugcuaugugcugacgggcagaucagcugaucuugaacuggagagggccgcagacguuaaaugggaggaucaagccgaaaucucugggaguucccccauuuugagcaucacaauuucugaggacggaagcauguccauccgaaacgaagaggaggaacagacccucacuauacugauccgcacaggccuacuggugauuucaggugucuucccagugaguauccccguaaccgcugcagccugguaccuuugggaggugaagaagcagcgggcggggguccucugggauguuccuagcccacccccugugggaaaagcugaacuggaggacggcgccuauagaauuaagcagaggggcaucuugggguacucucaaauaggagccgguguguauaaagaaggcacuuuucacacaauguggcaugucacccguggggcaguguuaaugcaccgcggaaagcggauugagccguccugggcugauguuaaaaaggaccugguaucauacggcgguggguggaagcucgagggagaauggaaagagggcgaagaggugcagguccuggcccuugaaccaggcaagaaucccagagcagugcagacgaaaccugggaucuucaagacuaacaccggaacaaucggugcuguuagucuggauuuuagcccaggcaccuccgggucucccauuguggacaggaaaggaaaggucgugggcuuguacgguaaugggguagucacacgaucgggagccuaugugagcgcgaucgcccagacugagaagucaauagaggauaacccugaaauugaggacgauaucuuccggaaaaagcgccuaaccauuauggaccugcauccgggcgcaggcaaaacgaagagauaccuccccgcuaucguuagggaagccauaaaacgggggcugcgaacacuuauuuuagcuccaacuagaguggucgcagccgagauggaagaggcccugcgcggacucccuaucagguaucaaacccccgcuauccgugcggagcacacaggucgggaaauuguggacuugaugugucaugcaaccuucacuaugagacugcucuccccaguuagggugccuaacuacaaucugaucauuauggaugaggcccacuuuaccgaccccgcuaguauagccgcacgcggcuauaucucuacacgagucgaaaugggggaggccgcuggaauuuucaugacggcgacuccaccgggcagcagagauccuuuuccccaguccaacgccccaaucauggacgaggaacgggagauccccgaaaggucauggaacucuggucacgagugggugaccgauuucaaggggaagacaguaugguuugugccuagcauuaaagcaggaaacgacauagcugccugccuucgcaagaauggcaaaaagguuauccagcugagucguaaaaccuucgauuccgaauacgucaagacuagagcaaacgacugggauuuuguggugacaaccgacauuagcgagaugggcgccaauuucaaggcugagcgggucaucgauccaaggcgcuguaugaaacccguaauuuugacggacggggaagaacgagugauccuagccggaccuaugccgguuacucauucuucagcggcacaaagacgggguaggauaggccgcaacccaaagaaugaaaacgaccaguauaucuacaugggggagccccuggaaaaugaugaggacugcgcccacuggaaagaggcuaagaugcucuuagauaacauuaauacaccugaaggaaucauucccuccauguuugagccagaaagagagaaaguggacgccaucgauggcgaauacaggcugcggggugaggcucguaagaccuucgucgaccuuaugcgccgaggggaucugccuguguggcucgcauauaaaguugccgcugagggcauaaacuacgccgacagaaggugguguuuugauggaauuaagaauaaccagaucuuggaagagaacguggaagucgagauuuggaccaaggagggcgaacggaaaaagcugaaaccccgcuggcucgacgcaagaaucuauagugauccacuggcgcuuaaggaguucaaagaguucgccgcugggagaaagagccuaacucugaauuugauaacagagaugggacgguuaccuaccuuuaugacacagaaggcccgaaacgcacuggacaaucucgcugugcugcauacugccgaagccgguggcaaagccuacaaccacgcucuuucggagcugccggagacgcucgaaaccuugcugcuacugacacuccuugcgacuguaaccgggggaaucuuccuguuuuuaaugucuggcaaggguauugggaaaaugacauugggcaugugcugcaucauuaccgccuccauccugcucugguaugcacaaauacagccccacuggauugcugccagcaucauccuggaguucuuucuuauugugcugcucaucccagaaccugagaagcagagaacuccccaggauaaucaauugacguacguugucauagccauucugaccgugguggcagcuacaauggccaacgaaaugggauucuuagagaaaacuaagaaggaccuaggccuggggucaaucaccacacaggagagugaaucuaauauucucgacaucgaucuucgcccagcguccgcuuggacccuguaugccgucgcaacuacauuuguuacgccuauguugaggcauagcauagagaacucaagugugaauguaagccugaccgccaucgcuaaccaggcaacugugcucaugggacuggguaaaggcuggccccuuuccaagauggacauuggggucccgcuccuggccaucggauguuacucucaggugaauccaauuacauugaccgcggcucuguuacuacugguugcccacuacgcaaucauuggcccuggucuccaagccaaagcuacccgggaagcccagaagcgugcagcugccgggaucaugaaaaaccccacaguggauggcauaacugucauugaccuugagccaauccccuaugauccuaaguucgaaaagcagcugggacagguaauguugcugauccucugcgugacgcaaguucugaugaugagaaccacaugggcgcuuugugaggccuuaacucuggcaaccggcccgauuagcacacucugggaggggaaucccggaagguuuuggaacaccacuauagcuguguccauggccaauaucuuccgcggcucauacuuggccggugcugggcugcuauuuucuauuaugaaaaacacgacaaauacccggcgaggaacuggcaacaucggugaaacccugggcgagaaguggaaaaguagacucaacgcccuugggaagucggaguuccagauuuauaaaaagagcggaauccaggaggucgacaggacacuggccaaagagggcauaaagcgcggggaaacugaucaucacgcggugucccggggaucugcuaaguugagaugguuugucgagcguaauauggugaccccagaaggcaaaguuguggaccuggguugcgggaggggaggcuggucauacuauugugguggccucaagaacguacgggaggugaaagggcugacaaagggaggcccugggcaugaagaaccaaucacgaugagcaccuacggauggaauuuaguccgccuucaauccggcguugauguguucuucacuccuccagagaaaugcgacacacugcucugugauauuggugaaaguucucccaacccuaccaucgaggcagggcgaacucuaagaguccugaauuugguggaaaacuggcugaauaacaauacacaguuuugcauuaagguacucaacccauauaugcccagcgugaucgagaagauggaaacccuucagaggaaauacggaggcgcccugguucggaauccguugucacgcaacuccacgcacgagauguacugggugaguaaugcuaccggcaacauagucagcucugugaauaugauuuccagaaugcugaucaacagguucacaaugaagcacaaaaaggccacuuaugagccugacgucgaucucgggucaggaacccgaaacaucgguauugaaagcgagauaccaaauuuagacaucauuggcaaacggaucgaaaagauuaagcaggagcaugaaacaucguggcacuacgaccaagaucaucccuauaaaacuugggcauaccacgggucuuaugagaccaagcagacaggaagugccuccagcauggugaacggcguuguacgucugcuuaccaaaccuugggacguggucccaauggugacucagauggcuaugacggauacaacccccuuuggucagcaaagaguuuucaaggagaaaguggacacucgcacccaggaaccgaaggaggggacaaagaaacugaugaagaucacggcggaauggcuauggaaagagcucggaaagaaaaagaccccuaggauguguacucgggaggaauuuacaagaaaaguccgcucaaaugccgcacugggcgcuauauucaccgaugagaacaaguggaaguccgccagggaagcaguggaggacggccgauuuugggaauugguagaucgggagagaaaucugcaccucgaggggaaaugcgaaacuuguguguacaacaugaugggaaagagggagaagaaacuuggugaguucggcaaagccaaagggucucgcgcuaucugguauauguggcugggagccagauuuuuagaguucgaagcgcugggcuuuuugaaugaggaccauugguucagccgggguaacagucucuccgggguugagggagaaggccugcacagacuaggcuacauucuuagggaugucagcaagaaagaagggggagcaauguacgccgacgauacagcugguugggacacccgcaucacacuggaagaccucaagaaugaggaaauggugacuaaccauaugaaaggcgagcacaagaaacuggccgaggcaauuuuuaaguugaccuaucagaauaaggugguccgaguucagcggcccacgccaagagggaccgugauggauaucauuucuaggcgcgaccaaagaggaucaggccagguagguacauacgggcugaacacuuucaccaauauggaagcucagcucauacggcaaauggagggagaaggcaucuucaaaaguauucagcaucuuacagugacugaggagaucgccguccagaacuggcuggcuagggugggccgugaacgauuaucccgcauggccaucagcggggaugacugcguugugaagccuauugaugacagauuugcaucugcgcugaccgccuugaaugauaugggaaaaguccggaaggacauacagcaaugggagcccucgagggguuggaacgauuggacacaggugccauucugcucacaccacuuucaugaacucguaaugaaagacggccgcguucuggugguccccuguagaaaccaggaugagcuaaucgggcgggcuaggauuagccagggagccggcuggucccuuaaggaaacagcaugccuggguaagaguuaugcucaaauguggacccucauguacuuccaccgacgugaccugagauuggccgcaaaugccaucuguucugcggugccuagccauugggugccaacuucccgcacaaccuggucaauucacgcuaaacacgaguggaugacuaccgaggauauguuagccgucuggaaccggguuuggauccaggaaaauccguggauggaggacaagacacccguggaaaguugggaggaaguaccuuaucuggggaaaagggaggaccaguggugcggaucucucauaggccuuacgagcagagcaaccugggccaagaacauccagacugcuauuaaucaagugcgcucccugaucggcaacgaggaauacacagauuauaugccaucaaugaaacgguuuaggcgagaggaagaggaagccgggguccuaugguga

SEQ ID NO: 14725 - RNA, 9876 nt, Artificial Sequence
  derived and/or modified CDS sequence (opt3) from DENV-2__EU482735__SS-prME
accgcaggcgugaucgucaugcugauucccacggcuauggcauuccaccucacuacgcguaacggggagccucauaugauaguuggaaggcaggaaaaggguaagagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauaaugaucacuccacacagcggugaggagcaugcugucggcaaugacacggggaagcacggaaaagaaauuaagaucacaccgcaguccucaauaaccgaggccgaacugacuggcuaugguaccguuacaauggaguguagucccaggaccgggcuugauuucaacgaaauggugcuguugcaaauggaggacaaagcauggcucguacaccggcagugguuucuggauuuaccucugccauggcuccccggcgcugacacucagggaagcaauuggauucagaaggagacacuugugacguucaagaacccucaugccaaaaagcaagacgucgugguucugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgugaaagaaauugcugagacucagcacggcaccaucgucauuagagugcaguaugagggugacgggucuccaugcaagauacccuucgaaaucauggauuuggagaaaaggcauguacucggccggcugauuacgguuaacccgaucgugaccgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaguggggaaggcccugcaccagguuuucggcgcuauuuacggagcggcauuuaguggcgugagcuggacuaugaaaauccuuauagggguaaucauuaccuggaucggaaugaacuccagaucuacgagcuugucagucagucuggugcucguuggcguggucacacuguaucuuggugccauggugcaggcugacuccggguguguagugagcuggaagaauaaagaacugaagugcggaucuggcauuuucaucaccgauaacguucacacuuggacagagcaguacaaguuucaacccgaaucaccaaguaaauuggccagcgcaauacagaaggcccaugaggaagguauuuguggcaucagguccgucacccggcucgagaaucugauguggaaacagauuacucccgaguuaaaccacauccugucugaaaaugaggugaagcuaaccauaaugacaggggacaucaaaggaauuaugcaggcuggcaagcgcucgcucagaccucaaccaacggaacugaaauauagcuggaagaccugggggaaggccaaaaugcuuuccacugagucacauaaccagacauucuugaucgauggaccggaaaccgcagagugccccaauacaaacagggcguggaauagucuggagguggaagacuacggcuuuggugucuucacuaccaacauuuggcucaagcugcgugagaaacaggacguauuuugugauucuaaguuaaugagcgcugccaucaaagacaaucgggcagugcacgccgauaugggguauuggauagaauccgcucugaacgacacguggaagauggagaaggccucauucauugaggugaaaagcugccacuggccuaagucucauacacuuugguccaauggaguauuggaaagugagaugaucauccccaagaauuucgcaggccccgucagccagcacaacuaccgaccugguuaucauacccaaacugcuggcccauggcaccucgggaagcuggaaauggauuuugacuucugugagggaaccacagugguugugacugaagauugcggcaauagagggcccucucuaaggaccacaacggccuccggaaaacugauuaccgaguggugcugucgcucaugcacucucccgccucugcgguacagaggcgaggacgguuguugguacgggauggaaaucaggccacuuaaggagaaggaagagaacuuggucaauagucuggugacagcgggacauggccagauugauaacuuuagcuuagguguucucggcauggcccuguuccuugaagagaugcugcgcacccgaguggggacuaaacacgcuauauugcucguagcagucucguuugugacacugaucaccggaaauauguccuuccgggaccuaggccgugugauggucaugguuggggccacgaugacugaugacauuggaaugggcgugaccuaucuggcucuccuggccgcauuuaagguaagacccacauucgcggccggucuuuugcugaggaaauuaaccucuaaggagcucaugauggcuacuaucgggauugcccugcuuagccagucaacaaucccugaaaccauacuggagcuaacagaugcacucgcucugggaaugauggccuugaaaaucgugaagaacauggaaaaguaccaacuggcagucacuauuauggccaucaguugcgugcccaaugcuguuauuuuacagaacgcguggaaaguguccuguaccauccucgccgcagucucugugagcccacugcuucugacguccucacagcagaaggcugacuggauaccuuuggcccucacaauuaaaggccugaaucccaccgccaucuuucuaacuacccugagccgcacaaguaagaaacggucuuggccacuuaacgaggcuaucauggcaguuggcaugguguccauucucgccagcucgcuguugaagaaugacauaccgaugacugggccucuggucgcgggagguuuacucaccguaugcuaugugcugacgggcagaucagcugaucuugaacuggagagggccgcagacguuaaaugggaggaucaagccgaaaucucugggaguucccccauuuugagcaucacaauuucugaggacggaagcauguccauccgaaacgaagaggaggaacagacccucacuauacugauccgcacaggccuacuggugauuucaggugucuucccagugaguauccccguaaccgcugcagccugguaccuuugggaggugaagaagcagcgggcggggguccucugggauguuccuagcccacccccugugggaaaagcugaacuggaggacggcgccuauagaauuaagcagaggggcaucuugggguacucucaaauaggagccgguguguauaaagaaggcacuuuucacacaauguggcaugucacccguggggcaguguuaaugcaccgcggaaagcggauugagccguccugggcugauguuaaaaaggaccugguaucauacggcgguggguggaagcucgagggagaauggaaagagggcgaagaggugcagguccuggcccuugaaccaggcaagaaucccagagcagugcagacgaaaccugggaucuucaagacuaacaccggaacaaucggugcuguuagucuggauuuuagcccaggcaccuccgggucucccauuguggacaggaaaggaaaggucgugggcuuguacgguaaugggguagucacacgaucgggagccuaugugagcgcgaucgcccagacugagaagucaauagaggauaacccugaaauugaggacgauaucuuccggaaaaagcgccuaaccauuauggaccugcauccgggcgcaggcaaaacgaagagauaccuccccgcuaucguuagggaagccauaaaacgggggcugcgaacacuuauuuuagcuccaacuagaguggucgcagccgagauggaagaggcccugcgcggacucccuaucagguaucaaacccccgcuauccgugcggagcacacaggucgggaaauuguggacuugaugugucaugcaaccuucacuaugagacugcucuccccaguuagggugccuaacuacaaucugaucauuauggaugaggcccacuuuaccgaccccgcuaguauagccgcacgcggcuauaucucuacacgagucgaaaugggggaggccgcuggaauuuucaugacggcgacuccaccgggcagcagagauccuuuuccccaguccaacgccccaaucauggacgaggaacgggagauccccgaaaggucauggaacucuggucacgagugggugaccgauuucaaggggaagacaguaugguuugugccuagcauuaaagcaggaaacgacauagcugccugccuucgcaagaauggcaaaaagguuauccagcugagucguaaaaccuucgauuccgaauacgucaagacuagagcaaacgacugggauuuuguggugacaaccgacauuagcgagaugggcgccaauuucaaggcugagcgggucaucgauccaaggcgcuguaugaaacccguaauuuugacggacggggaagaacgagugauccuagccggaccuaugccgguuacucauucuucagcggcacaaagacgggguaggauaggccgcaacccaaagaaugaaaacgaccaguauaucuacaugggggagccccuggaaaaugaugaggacugcgcccacuggaaagaggcuaagaugcucuuagauaacauuaauacaccugaaggaaucauucccuccauguuugagccagaaagagagaaaguggacgccaucgauggcgaauacaggcugcggggugaggcucguaagaccuucgucgaccuuaugcgccgaggggaucugccuguguggcucgcauauaaaguugccgcugagggcauaaacuacgccgacagaaggugguguuuugauggaauuaagaauaaccagaucuuggaagagaacguggaagucgagauuuggaccaaggagggcgaacggaaaaagcugaaaccccgcuggcucgacgcaagaaucuauagugauccacuggcgcuuaaggaguucaaagaguucgccgcugggagaaagagccuaacucugaauuugauaacagagaugggacgguuaccuaccuuuaugacacagaaggcccgaaacgcacuggacaaucucgcugugcugcauacugccgaagccgguggcaaagccuacaaccacgcucuuucggagcugccggagacgcucgaaaccuugcugcuacugacacuccuugcgacuguaaccgggggaaucuuccuguuuuuaaugucuggcaaggguauugggaaaaugacauugggcaugugcugcaucauuaccgccuccauccugcucugguaugcacaaauacagccccacuggauugcugccagcaucauccuggaguucuuucuuauugugcugcucaucccagaaccugagaagcagagaacuccccaggauaaucaauugacguacguugucauagccauucugaccgugguggcagcuacaauggccaacgaaaugggauucuuagagaaaacuaagaaggaccuaggccuggggucaaucaccacacaggagagugaaucuaauauucucgacaucgaucuucgcccagcguccgcuuggacccuguaugccgucgcaacuacauuuguuacgccuauguugaggcauagcauagagaacucaagugugaauguaagccugaccgccaucgcuaaccaggcaacugugcucaugggacuggguaaaggcuggccccuuuccaagauggacauuggggucccgcuccuggccaucggauguuacucucaggugaauccaauuacauugaccgcggcucuguuacuacugguugcccacuacgcaaucauuggcccuggucuccaagccaaagcuacccgggaagcccagaagcgugcagcugccgggaucaugaaaaaccccacaguggauggcauaacugucauugaccuugagccaauccccuaugauccuaaguucgaaaagcagcugggacagguaauguugcugauccucugcgugacgcaaguucugaccaugagaacaacuugggcgcuuugugaggccuuaacccuggcaacaggcccgauuagcacccucugggaggggaaucccggaagguuuuggaacacuacgauagcuguguccauggccaauaucuuccgcggcucauacuuggccggugcugggcugcuauuuucuauuaugaaaaacacaaccaauacucggcgaggaaccggcaacaucggugaaacacugggcgagaaguggaaaaguagacucaacgcccuugggaagucggaguuccagauuuauaaaaagagcggaauccaggaggucgacaggacucuggccaaagagggcauaaagcgcggggaaaccgaucaucacgcggugucccggggaucugcuaaguugagaugguuugucgagcguaauauggugacaccagaaggcaaaguuguggaccuggguugcgggaggggaggcuggucauacuauugugguggccucaagaacguacgggaggugaaagggcugacgaagggaggcccugggcaugaagaaccaaucccuaugagcaccuacggauggaauuuaguccgccuucaauccggcguugauguguucuucacuccacccgagaaaugcgacacacugcucugugauauuggugaaaguucuccuaacccaaccaucgaggcagggcgaacucuaagaguccugaauuugguggaaaacuggcugaauaacaauacacaguuuugcauuaagguacucaaccccuauaugccgagcgugaucgagaagauggaaacccuucagaggaaauacggaggcgcccugguucggaauccuuugucacgcaacuccacgcacgagauguacugggugaguaaugcuaccggcaacauagucagcucugugaauaugauuuccagaaugcugaucaacagguucacaaugaagcacaaaaaggccacuuaugagccagacgucgaucucgggucaggaacccgaaacaucgguauugaaagcgagauacccaauuuagacaucauuggcaaacggaucgaaaagauuaagcaggagcaugaaacaucguggcacuacgaccaagaucauccuuauaaaacuugggcauaccacgggucuuaugagaccaagcagacaggaagugccuccagcauggugaacggcguuguacgucugcuuaccaaaccaugggacgugguccccauggugacucagauggcuaugacggauacaaccccguuuggucagcaaagaguuuucaaggagaaaguggacacucgcacccaggaaccuaaggaggggacaaagaaacugaugaagaucacggcggaauggcuauggaaagagcucggaaagaaaaagacccccaggauguguacucgggaggaauuuacaagaaaaguccgcucaaaugccgcacugggcgcuauauucaccgaugagaacaaguggaaguccgccagggaagcaguggaggacggccgauuuugggaauugguagaucgggagagaaaucugcaccucgaggggaaaugcgaaacuuguguguacaacaugaugggaaagagggagaagaaacuuggugaguucggcaaagccaaagggucucgcgcuaucugguauauguggcugggagccagauuuuuagaguucgaagcgcugggcuuuuugaaugaggaccauugguucagccgggguaacagucucuccgggguugagggagaaggccugcacagacuaggcuacauucuuagggaugucagcaagaaagaagggggagcaauguacgccgacgauacagcugguugggacacccgcaucacacuggaagaccucaagaaugaggaaauggugacuaaccauaugaaaggcgagcacaagaaacuggccgaggcaauuuuuaaguugaccuaucagaauaaggugguccgaguucagcggccaacgccuagagggaccgugauggauaucauuucuaggcgcgaccaaagaggaucaggccagguagguacauacgggcugaacacuuucaccaauauggaagcucagcucauacggcaaauggagggagaaggcaucuucaaaaguauucagcaucuuacagugacugaggagaucgccguccagaacuggcuggcuagggugggccgugaacgauuaucccgcauggccaucagcggggaugacugcguugugaagcccauugaugacagauuugcaucugcgcugaccgccuugaaugauaugggaaaaguccggaaggacauacagcaaugggagccaucgagggguuggaacgauuggacacaggugcccuucugcucacaccacuuucaugaacucguaaugaaagacggccgcguucugguggucccuuguagaaaccaggaugagcuaaucgggcgggcuaggauuagccagggagccggcuggucccuuaaggaaacagcaugccuggguaagaguuaugcucaaauguggacccucauguacuuccaccgacgugaccugagauuggccgcaaaugccaucuguucugcggugccaagccauugggugccgacuucccgcacaaccuggucaauucacgcuaaacacgaguggaugacuaccgaggauauguuagccgucuggaaccggguuuggauccaggaaaaucccuggauggaggacaagacaccuguggaaaguugggaggaaguaccauaucuggggaaaagggaggaccaguggugcggaucucucauaggccuuacgagcagagcaaccugggccaagaacauccagacugcuauuaaucaagugcgcucccugaucggcaacgaggaauacacagauuauaugcccucaaugaaacgguuuaggcgagaggaagaggaagccgggguccuaugguga

SEQ ID NO: 14726 - RNA, 9876 nt, Artificial Sequence
  derived and/or modified CDS sequence (opt3) from DENV-2__EU482736__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcucuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucacaacuaauauuuggcugaaguuacgugagaaacaggacguguuuugugauagcaagcugauguccgccgcaaucaaagacaaccgggccgugcacgcugauaugggguauuggauagaaucagcccuuaaugacaccuggaagauggagaaggcaagcuucauugagguaaaaucuugccacuggccuaagucccauacguuguggaguaacggaguccucgaaagcgagaugaucaucccaaaaaauuucgcuggccccgugucucagcacaacuaccgaccugguuaucauacacagaccgccggcccauggcaccuggggaagcuagaaauggauuuugacuucugugagggaacuaccguuguggucacagaagauugcggcaacagagggcccucccugaggacuaccacagcgucaggaaaacucauuacggaguggugcugucgcaguugcacccugccgccucuucgguacagaggcgaggacgguuguugguacgggauggaaaucaggccauugaaggagaaggaagagaaucuggugaacagcuuaguuacugccggacauggccaaauugauaauuuuucgcucggugugcugggcauggcucuuuuccuggaagagauguugcgcacacgaguagggaccaaacacgcaaugcuccuggucgugguguccuuugucacucuaauaacaggaaacaugucuuuccgggaccugggccguguuauggugaugguaggggccaccaugacggaugacaucggaaugggcauuacuuaucucgcucugcuugccgcauuuaaggugagacccaccuucgcggccgguuugcuguuaaggaaacucacaagcaaggagcugaugauggcuaccaucgggauugcccuucugucacagaguacuaucccugaaacaauacuagagcucaccgaugcacuggcuuuguccaugaugguccugaaaaucgugcgcaauauggaaaaguaccaguuagccguuacaauuauggcaaucucuugcgugcccaacgccgucauucuccaaaaugcuuggaaggugagcuguacuauccuggcggccguuuccgugucaccacuucuguugaccagcagucagcagaaagcagacuggauaccucucgcucugacgauuaagggacuaaaccccacagccaucuuucugaccacucuuucucggaccuccaaaaagagaagcuggccacucaaugaggccaucauggcugucggcaugguaucgauucuggcaucaucuuugcugaaaaacgacauaccgaugacaggcccuuuaguggccgggggacuccugacuguuugcuaugugcuuaccgguaggagugcggaucuggaauuggagcgagcugccgacgucaagugggaggaucaggcagaaaucuccggcagcucucccauucucagcaucacgauuuccgaggacgggucaaugaguaucaaaaaugaagaggaggaacaaacacugaccauacuaauccgcacuggacugcuugugauuagcggcguauucccagugucuauccccauuacagccgcugcaugguaccucugggaggucaagaagcagcgggccgguguucugugggaugugccuuccccacccccuguggggaaagcggaauuggaggacggagcuuauagaaucaagcagaggggcauauuaggcuacucacagauuggggccggagucuauaaagaagguaccuuucacacuauguggcaugugacacguggcgcaguucugaugcaccgcgggaagcggaucgagccgaguugggccgauguaaaaaaggaccucaucagcuacggaggcgguuggaagcuggagggggaauggaaagagggagaagaggugcaaguccuugcucuggaaccaggcaagaaccccagagccgugcagaccaaaccuggcuuguucaagacgaauacugggaccauuggagcaguuucccuagauuuuucuccagguacaucgggcagccccaucguggacaggaaagggaaggucgugggacuguacggcaacgguguagucacccgaucaggggcuuauguguccgccauagcgcagacagagaagaguauugaggauaauccugaaaucgaggacgauauuuuccggaaaaagcgccucacuaucauggaccugcauccgggagccggcaaaaccaagagauaccuucccgcaauaguuagggaagcuauuaaacggggcuuacgaacgcugauccucgccccaacaagaguggucgcugcagagauggaagaggccuugcgcgggcugccuaucagguaucagacucccgccauucgugcugagcacaccggacgggaaaucguggaccucaugugucaugcgacauucaccaugagacugcuuucuccaguuagggugccuaacuacaaccugauuauaauggaugaggcacacuuuacugaccccgccagcaucgcugcccgcgguuauauuuccacccgagucgaaaugggcgaggcagccgggaucuucaugacagcuacgccaccgggaucaagagauccuuuuccccaaucuaaugcgccaaucauggacgaggaacgggagauucccgaaaggagcuggaacaguggccacgagugggugacugauuucaaggguaagaccguaugguuugugccuuccauaaaagccgggaaugacaucgcagcuugcuugcgcaagaacggaaaaaagguuauucagcuaagccguaaaacauucgauucugaauacgucaagaccagagccaaugacugggauuuuguggugacuacagacaucucagagaugggcgcaaacuucaaggccgagcgggucauugauccaaggcgcuguaugaaacccguaauccugaccgacggcgaagagcgagugauacucgcugggccuaugccgguuacgcauuccagugccgcgcagagacggggaaggaucggucgcaauccaaagaacgaaaaugaccaauauauuuacaugggcgagcccuuagaaaacgaugaggacugcgcacacuggaaagaggccaagaugcugcuugauaauaucaacacuccugaagggauuauccccagcauguuugagccagaaagagagaaaguggacgcuauagauggagaauacaggcugcggggcgaggcccguaagacauucgucgaccucaugcgccgaggugauuugccuguguggcuggcuuauagaguugcagccgaggggauuaauuacgcugacaggcggugguguuuugauggcaucaaaaacaaucagauucucgaagagaacguggaagucgagaucuggaccaaggagggagaacgcaagaaacugaagcccagauggcuugacgccaggauauauucggauccacuagcacugaaagaguucaaggaauucgcggccggccggaaaucuuugaccuuaaaccugaucacugagauggggcgacucccuacauuuaugacccagaaggcuagagacgcccuggauaaucuugcagugcugcauacagcugaagccggaggucgcgcauacaaccacgcccucuccgaguugccggagacucuggaaacgcuacugcuccuuacccuguuagcuacaguaacuggcgggauuuucuuguuucugaugagcggaaagggcaucgguaaaaugacccucgggaugugcugcauuaucacagcgucaauacugcuuugguaugcccagauucaaccccacuggaucgcagcuaguaucauucuggaguucuuucucaucguguugcugauaccagaaccugagaagcagaggaccccccaggacaaucaguuaacuuacguugucauugccauccuaacggugguggccgcaaccauggcuaacgaaaugggcuuccuggagaaaacaaagaaagaccucggacuuggcucuauugccacucaagaguccgaaagcaauauccuggauauagacuugcggccagcgucagcuuggacccuguaugccgucgcaacaaccuuuguuacuccuaugcuccgucauaguaucgagaacagcuccgugaauguaucucugacagccauugcuaaccaggcaacggugcuuauggggcucggaaaggguuggccccugagcaagauggauaucggcgucccguugcuggccauuggguguuacucccaggugaauccaaucaccuuaacugcggcucuacugcuccuuguugcccacuacgcaauuaucggaccuggccugcaggccaaagcuacaagagaagcccaaaagagggcagcugccgguauaaugaaaaaccccaccguggacgggauuaccgucaucgauuuggagccaauccccuaugacccuaaguucgaaaaacagcugggccagguaaugcuccugauucuuugcgugacacagguuuuaaugaugcgcacuacgugggcgcugugugaggcccucaccuuggcaacaggaccgauaucaacucugugggagggcaaucccgggcgguuuuggaacaccacaaucgcugugucuauggccaauauuuuccgaggaaguuaccuagcaggcgcuggucugcucuuuucgaucaugaagaacaccacuaauacgagaagggggacaggaaacauuggcgaaacccuuggugagaaguggaaaagccgccugaaugccuugggcaaguccgaauuccaaaucuauaaaaagucugggauacaggaggucgaucggacucuggccaaagagggaaucaagagaggcgaaaccgaccaucacgcggugucacgugggagcgcuaaacucaggugguuugucgagcggaacauggugacaccagaaggaaagguuguggaucugggcugcggucgcgggggaugguccuacuauuguggcgguuuaaagaacguacgagaggugaaaggccuuacuaaggggggaccuggccaugaagagcccauuccuaugaguaccuacggguggaaucuggucagacuccagucuggaguugacguguucuucacaccacccgagaaaugcgauacgcuacugugugacaucggcgaaagcucaccuaacccaaccauugaggcagguaggacuuugcggguccugaaucucguggaaaacuggcuuaauaacaauacacaauuuugcaucaagguacugaaccccuauaugccguccgugauagagaaaauggaaaccuugcagcgcaaguacgggggagcccugguuagaaauccucucaguaggaacagcacucacgagauguacugggugucuaaugcuacaggcaacauugucuccucagugaauaugaucagccgaauguuaaucaaccgguucaccaugaagcacaaaaaggccacguaugagccagaugucgaccugggcucggggacccguaauauuggaauagaaucugagauccccaaccuugacauuaucgguaaaagaauugaaaagaucaaacaggagcaugaaacaaguuggcacuacgaucaggaccauccuuauaagacuugggcauaccacggcuccuaugagaccaagcaaacagggagcgccucauccauggugaacggaguuguacgccugcuaacuaaaccaugggaugugguccccauggugacccagauggcuaugacagacaccacuccguuuggccagcagaggguuuucaaggagaaaguggauacgcggacacaagaaccuaaggaggguaccaaaaagcucaugaagauaacugcggaauggcuguggaaagaguuggggaagaaaaagacccccagaauguguacacgcgaggaauuuacgaggaaaguccgaucuaaugccgcacugggagcuaucuucaccgacgagaacaaguggaaaagcgcccgggaagcaguggaggauaguagauuuugggaacucauugacagggagcgcaaucuucaccuggagggcaagugcgaaacuuguguauacaacaugaugggcaagcgugagaaaaaguuaggggaauucggaaaagccaaggguucccgggcuaucugguauauguggcugggcgccagauuuuuggaguucgaagcgcucggguuucugaaugaggaucauugguucagcaggggaaacucucuaucaggcguggagggugaagggcuucaccgccugggauacauucuccgagacguuaguaaaaaggagggcggcgcaauguacgccgaugacacagcugggugggacacccggaucacucuggaagauuugaagaaugaggaaauggucacaaaccauaugaaaggagagcacaagaaacuggccgaggcaauuuuuaagcucaccuaucagaauaaaguggugagaguccagaggccaacaccucgcgguacuguuauggacauaaucuccagacgggaucagaggggcagcgggcaagugggaaccuacggccuuaacacguucaccaauauggaagcucagcugauucgucagauggagggugaagggaucuucaagucuauccaacauuuaacaguaacugaggagauugccgugcagaacuggcuggcucgagucggacgcgaaagauugucgcggauggccauaucaggcgacgauugcgugguuaagccccucgacgauagguuugcaagcgcgcugaccgcccuaaaugacaugggcaaagugcgcaaggauauccagcagugggagccauccagaggguggaacgacuggacacaaguccccuucugcagucaccacuuucaugaacuugugaugaaagauggacggguacugguugugccuuguaggaaucaggacgagcucauuggucgagcucguaucucucagggcgccggguggagccugaaggaaacugcaugcuugggaaaauccuaugcucagauguggaccuuaauguacuuccacagacgcgaucugcggcucgccgcaaacgccauuuguucagcggucccaagucauugggugccgacgucuaggacaaccuggagcauccacgcuaagcacgaguggaugacuacagaggacaugcuugccguguggaacagagucuggauacaagaaaaucccuggauggaggacaagaccccuguugaauccugggaggaagugccauaucugggcaaacgcgaggaucaguggugcgguucacuaaucgggcugacuagccgggcaaccugggccaagaacauucagacagcuaucaaucagguaaggucucucauuggaaacgaggaauacacggacuauaugcccuccaugaaacgauuuagacgggaggaagaggaagccggcguguugugguga

SEQ ID NO: 14727 - RNA, 9876 nt, Artificial Sequence
  derived and/or modified CDS sequence (opt3) from DENV-2__EU482737__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuugucugcaagcauucuaugguggauagaggcugggguaacggguguggacuauucggcaagggcgggaucgugaccugcgccauguuuacaugcaaaaagaauauggaaggaaaagucguucucccugagaaccuggaauacaccaucgugauuacuccacacagcggugaggagcaugcuguaggcaaugacacggggaagcacggaaaagaaauaaagaucacaccgcaguccucaauuaccgaggccgaacuuacuggcuaugguaccgugacaauggaguguagucccaggaccgggcuggauuucaacgaaauggucuugcuccagauggaggacaaagcauggcuggugcaccggcaaugguuuuuagaucugccucucccauggcuucccggcgcugacacucagggaagcaauuggauccagaaggagacacugguuacguucaagaacccucaugccaaaaagcaggacguggucguguugggcucucaagaaggggcgaugcacaccgcccuaacuggagcaacagagauacagauguccucagguaaucugcucuuuaccggccaucugaaaugccgucuucgcauggauaagcugcaguugaaagggaugagcuacaguauguguacaggaaaguucaagauuguaaaagaaaucgcugagacucaacacggcaccaucguuauuagagugcaguaugagggugacgggucuccaugcaagauccccuucgaaauuauggaucucgagaaaaggcauguccugggccgguuaauaacggugaacccgaucgucgccgaaaaggacuccccugugaacauugaggcugaacccccauuuggagauagcuacaucaucauuggcguugagccugggcagcugaaacuaaauugguucaagaagggaucgucuauaggucagauguuugagaccacaaugcgaggcgccaaacgcauggcaauccucggggacacugccugggauuucggaucccugggcgguguguuuaccucaauugggaaggcucuucaccaaguauucggcgcgaucuacggagcagccuuuaguggcgucagcuggacaaugaaaauuuugaucggggugauaaucacuuggauuggaaugaacuccagaucuaccagccugucaguuagucucgugcuggucggcgugguaacgcuuuaucugggugcuauggugcaggccgacuccggguguguugucagcuggaagucuaaagaauugaagugcggaucaggcaucuucauuacagauaaugugcacaccuggacugagcaguacaaguuucagcccgaaaguccaagcaaacucgcauccgccauccaaaaggcucaugaggaagguauauguggcauuaggucugugacacggcuggagaacuuaauguggaaacagaucacccccgagcugaaucacauucuaucggaaaacgaggucaagcucacuaucaugaccggggacauaaaaggaaucaugcaggccggcaagcgcagccugagaccucagccaacagaacuuaaauauuccuggaagacgugggggaaggcaaaaauguugucaaccgagagucauaaucaaacuuuccugauugauggaccggaaacagcggagugccccaacaccaauagggcuuggaacucucucgagguugaagacuacggcuuugguguguucacaacuaauaucuggcugaaguuacgugagaaacaggacguguuuugugauagcaagcugauguccgccgcaauuaaagacaaccgggccguacacgcugauaugggguauuggaucgaaucagcccuuaaugacaccuggaagauggagaaggcaagcuucauagaggucaaaucuugccacuggccuaagucccauacguuguggaguaacggagugcucgaaagcgagaugauuaucccaaaaaauuucgcuggccccguuucucagcacaacuaccgaccugguuaucauacacagaccgccggcccauggcaccuggggaagcuagaaauggauuuugacuucugugagggaacuaccguggucgugacagaagauugcggcaacagagggcccucccugaggacuaccacagcgucaggaaaacucaucacggaguggugcugucgcaguugcacccugccgccucuucgguacagaggcgaggacgguuguugguacgggauggaaauuaggccauugaaggagaaggaagagaaucugguuaacagcuuagugacugccggacauggccaaaucgauaauuuuucgcucgguguacugggcauggcucuuuuccuggaagagauguugcgcacacgagucgggaccaaacacgcaaugcuccuggugguggucuccuuuguuacucuaauuacaggaaacaugucuuuccgggaccugggccgugugaugguaauggugggggccaccaugacggaugacauaggaaugggcaucacuuaucucgcucugcuugccgcauuuaaggucagacccaccuucgcggccgguuugcuguuaaggaaacucacaagcaaggagcugaugauggcuaccauugggaucgcccuucugucacagaguacuauuccugaaacaauccuagagcucaccgaugcacuggcuuuguccaugauggugcugaaaauaguucgcaauauggaaaaguaccaguuagccgugacaaucauggcaauuucuugcguccccaacgccgugauccuccaaaaugcuuggaagguuagcuguacuauucuggcggccguguccgucucaccacuucuguugaccagcagucagcagaaagcagacuggaucccucucgcucugacgauaaagggacuaaaccccacagccauuuuucugaccacucuuucucggaccuccaaaaagagaagcuggccacucaaugaggccaucauggcuguaggcauggugucgauccuggcaucaucuuugcugaaaaacgacauuccgaugacaggcccuuuaguugccgggggacuccugacugugugcuauguccuuaccgguaggagugcggaucuggaauuggagcgagcugccgacgugaagugggaggaucaggcagaaauauccggcagcucucccauccucagcauuacgaucuccgaggacgggucaaugaguauuaaaaaugaagaggaggaacaaacacugaccauccuaauacgcacuggacugcuuguaaucagcggcguguucccagucucuauucccaucacagccgcugcaugguaccucugggagguuaagaagcagcgggccggugugcugugggaugugccuuccccacccccugucgggaaagcggaauuggaggacggagcuuauagaauuaagcagaggggcaucuuaggcuacucacagauaggggccggaguguauaaagaagguaccuuucacacuauguggcauguuacacguggcgcaguacugaugcaccgcgggaagcggauugagccgaguugggccgaugugaaaaaggaccucaucagcuacggaggcgguuggaagcuggagggggaauggaaagagggagaagagguccaagugcuugcucuggaaccaggcaagaaccccagagccguucagaccaaaccuggcuuguucaagacgaauacugggaccaucggagcagugucccuagauuuuucuccagguacaucgggcagccccauugucgacaggaaagggaaggugguaggacuguacggcaacggugucgugacccgaucaggggcuuauguuuccgccaucgcgcagacagagaagaguauagaggauaauccugaaauugaggacgauaucuuccggaaaaagcgccucacuauuauggaccugcauccgggagccggcaaaaccaagagauaccuucccgcaaucgugagggaagcuauaaaacggggcuuacgaacgcugauucucgccccaacaagagucguggcugcagagauggaagaggccuugcgcgggcugccuaucagguaucagacucccgccauccgugcugagcacaccggacgggaaauuguugaccucaugugucaugcgacauucaccaugagacugcuuucuccagugagggucccuaacuacaaccugaucauuauggaugaggcacacuuuacugaccccgccagcauagcugcccgcgguuauaucuccacccgaguggaaaugggcgaggcagccgggauuuucaugacagcuacgccaccgggaucaagagauccuuuuccccaaucuaaugcgccaaucauggacgaggaacgggagauccccgaaaggagcuggaacaguggccacgaguggguaacugauuucaaggguaagaccgugugguuuguuccuuccauuaaagccgggaaugacauagcagcuugcuugcgcaagaacggaaaaaaggucauccagcuaagccguaaaacauucgauucugaauacgugaagaccagagccaaugacugggauuuuguggucacuacagacauuucagagaugggcgcaaacuucaaggccgagcggguaaucgauccaaggcgcuguaugaaacccgugauucugaccgacggcgaagagcgaguuauccucgcugggccuaugccggugacgcauuccagugccgcgcagagacggggaaggauaggucgcaauccaaagaacgaaaaugaccaauauaucuacaugggcgagcccuuagaaaacgaugaggacugcgcacacuggaaagaggccaagaugcugcuugauaauauuaacacuccugaagggaucauucccagcauguuugagccagaaagagagaaagucgacgcuaucgauggagaauacaggcugcggggcgaggcccguaagacauucguggaccucaugcgccgaggugauuugccuguuuggcuggcuuauagaguggcagccgaggggauaaauuacgcugacaggcggugguguuuugauggcauuaaaaacaaucagauccucgaagagaacgucgaaguggagauuuggaccaaggagggagaacgcaagaaacugaagcccagauggcuugacgccaggaucuauucggauccacuagcacugaaagaguucaaggaauucgcggccggccggaaaucuuugaccuuaaaccugauaacugagauggggcgacucccuacauuuaugacccagaaggcuagagacgcccuggauaaucuugcaguacugcauacagcugaagccggaggucgcgcauacaaccacgcccucuccgaguugccggagacucuggaaacgcuacugcuccuuacccuguuagcuacagugacuggcgggaucuucuuguuucugaugagcggaaagggcauugguaaaaugacccucgggaugugcugcaucauuacagcgucaauccugcuuugguaugcccagauacaaccccacuggauugcagcuaguaucauccuggaguucuuucucauuguuuugcugaucccagaaccugagaagcagaggaccccccaggacaaucaguuaacuuacgucgugauagccauucuaacgguggucgccgcaaccauggcuaacgaaaugggcuuccuggagaaaacaaagaaagaccucggacuuggcucuaucgccacucaagaguccgaaagcaauauucuggauaucgacuugcggccagcgucagcuuggacccuguaugccguugcaacaaccuuugugacuccuaugcuccgucauaguauagagaacagcuccguaaaugugucucugacagccaucgcuaaccaggcaacgguccuuauggggcucggaaaggguuggccccugagcaagauggauauuggcgugccguugcuggccaucggguguuacucccagguuaauccaauuaccuuaacugcggcucuacugcuccuuguggcccacuacgcaaucauuggaccuggccugcaggccaaagcuacaagagaagcccaaaagagggcagcugccgguaucaugaaaaaccccaccgucgacgggauaaccguaauugauuuggagccaauccccuaugacccuaaguucgaaaaacagcugggccaggugaugcuccugauccuuugcguuacacagguguuaaugaugcgcacuacgugggcgcugugugaggcccucaccuuggcaacaggaccgauuucaacucugugggagggcaaucccgggcgguuuuggaacaccacaauagcugucucuauggccaauaucuuccgaggaaguuaccuagcaggcgcuggucugcucuuuucgauuaugaagaacaccacuaauacgagaagggggacaggaaacaucggcgaaacccuuggugagaaguggaaaagccgccugaaugccuugggcaaguccgaauuccaaauuuauaaaaagucugggauccaggagguggaucggacucuggccaaagagggaauaaagagaggcgaaaccgaccaucacgcggucucacgugggagcgcuaaacucaggugguuuguggagcggaacaugguuacaccagaaggaaaggugguagaucugggcugcggucgcgggggaugguccuacuauuguggcgguuuaaagaacgugcgagaggucaaaggccuuacuaaggggggaccuggccaugaagagcccaucccuaugaguaccuacggguggaaucugguuagacuccagucuggaguggacgucuucuucacaccacccgagaaaugcgauacgcuacugugugacauuggcgaaagcucaccuaacccaaccaucgaggcagguaggacuuugcgggugcugaaucucguagaaaacuggcuuaauaacaauacacaauuuugcauuaaggugcugaaccccuauaugccguccguuaucgagaaaauggaaaccuugcagcgcaaguacgggggagcccuggugagaaauccucucaguaggaacagcacucacgagauguacugggucucuaaugcuacaggcaacauaguguccucagucaauaugauuagccgaauguuaaucaaccgguucaccaugaagcacaaaaaggccacguaugagccagauguggaccugggcucggggacccguaauaucggaauugaaucugagauacccaaccuugacaucauugguaaaagaaucgaaaagauuaaacaggagcaugaaacaaguuggcacuacgaucaggaccauccuuauaagacuugggcauaccacggcuccuaugagaccaagcaaacagggagcgccucauccaugguuaacggaguagugcgccugcuaacuaaaccaugggaugucgugcccaugguuacccagauggcuaugacagacaccacuccguuuggccagcagaggguguucaaggagaaagucgauacgcggacacaagaaccuaaggaggguaccaaaaagcucaugaagaucacugcggaauggcuguggaaagaguuggggaagaaaaagacccccagaauguguacacgcgaggaauuuacgaggaaagugcgaucuaaugccgcacugggagcuauauucaccgacgagaacaaguggaaaagcgcccgggaagcaguagaggauaguagauuuugggaacucaucgacagggagcgcaaucuucaccuggagggcaagugcgaaacuuguguguacaacaugaugggcaagcgugagaaaaaguuaggggaauucggaaaagccaaggguucccgggcuauuugguauauguggcugggcgccagauuuuuggaguucgaagcgcucggguuucugaaugaggaucauugguucagcaggggaaacucucuaucaggcguugagggugaagggcuucaccgccugggauacauccuccgagacgucaguaaaaaggagggcggcgcaauguacgccgaugacacagcugggugggacacccggauuacucuggaagauuugaagaaugaggaaauggugacaaaccauaugaaaggagagcacaagaaacuggccgaggcaaucuuuaagcucaccuaucagaauaaaguggucagaguucagaggccaacaccucgcgguacugugauggacauuauauccagacgggaucagaggggcagcgggcaaguaggaaccuacggccuuaacacguucaccaauauggaagcucagcugauccgucagauggagggugaagggauuuucaagucuauccaacauuuaacagugacugaggagaucgccguccagaacuggcuggcucgagugggacgcgaaagauugucgcggauggccauuucaggcgacgauugcguugugaagccccucgacgauagguuugcaagcgcgcugaccgcccuaaaugacaugggcaaaguccgcaaggauauacagcagugggagccauccagaggguggaacgacuggacacaagugcccuucugcagucaccacuuucaugaacuuguaaugaaagauggacggguucugguggucccuuguaggaaucaggacgagcucaucggucgagcucguauuucucagggcgccggguggagccugaaggaaacugcaugcuugggaaaauccuaugcucagauguggaccuuaauguacuuccacagacgcgaucugcggcucgccgcaaacgccaucuguucagcggugccaagucauugggugccgacgucuaggacaaccuggagcauucacgcuaagcacgaguggaugacuacagaggacaugcuugccgucuggaacagaguuuggauccaagaaaaucccuggauggaggacaagaccccuguggaauccugggaggaaguaccauaucugggcaaacgcgaggaucaguggugcgguucacuaauagggcugacuagccgggcaaccugggccaagaacauccagacagcuauuaaucaggugaggucucucaucggaaacgaggaauacacggacuauaugcccuccaugaaacgauuuagacgggaggaagaggaagccggcgucuugugguga

SEQ ID NO: 14728 - RNA, 9876 nt, Artificial Sequence
  derived and/or modified CDS sequence (opt3) from DENV-2__EU482739__SS-prME
accgccggagugaucauuaugcugauacccacagcuauggcauuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauucugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggauuauucggcaagggcgggauugucacaugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccugacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugugaugguacaggccgacuccgggugugugguuagcuggaagaauaaagaauugaagugcggaucuggcaucuucauaaccgauaacguccacacuuggacagagcaguacaaguuucagcccgaaucaccaaguaaacucgcuagcgccauucaaaaggcacaugaggaagguaucuguggcauuagguccgugacccggcuggagaauuuaauguggaaacagaucacucccgagcugaaccacauacuaucugaaaaugaggugaagcucaccaucaugacaggggacauuaaaggaaucaugcaggccggcaagcgcucgcugagaccucagccaacggaacuuaaauauagcuggaagaccugggggaaggcuaaaauguuguccacugagucacauaaccaaacauuccugauugauggaccggaaaccgccgagugccccaauacaaacagggcauggaauagucucgaggucgaagacuacggcuuugguguuuucucuacuaacaucuggcugaaguuacgugagaaacaggacguguuuugugauagcaagcugauguccgcggcuauaaaagacaaucgggccgugcacgcagauaugggguauuggauugaaucagcccuuaacgacaccuggaagauggagaaggcuagcuucaucgagguaaaaucuugccacuggccuaagucccauacguuguggaguaauggaguccucgaaagcgagaugaucauucccaaaaacuucgccggccccgugucucagcacaacuaccgaccugguuaucauacacagaccgcaggcccauggcaccuggggaagcuagaaauggauuuugacuucugugagggaacuaccguuguggucacagaagauugcggcaauagagggcccucccugaggacuaccacagcuucaggaaaacucaucacggaguggugcugucgcaguugcacccugccgccucuucgguacagaggcgaggacgguuguugguacgggauggaaauuaggccauugaaggagaaggaagagaaccuggugaauagcuuaguuacugccggacauggccaaauagauaacuuuucgcucggugugcugggcauggcgcuuuuccuggaagagauguugcgcacacgaguagggaccaaacacgccauccuccuggucgcuguguccuuugugacucuaauuacaggaaauaugucuuuccgggaccugggccgugucaugguuauggugggggcaaccaugacggaugacaucggaaugggcguaacuuaucucgcccugcuugcugccuuuaaggugagacccaccuucgcagcggguuugcuguuaaggaaacucacaagcaaggagcugaugauggccaccauugggaucgcacuucugucacagaguacuauaccugaaacaauccuagagcucaccgaugcccuggcauugggaaugaugguccugaaaauugugcgcaacuuagaaaaguaccagcucgcuguuacaaucauggccauuuccugcgugcccaaugcagucauccugcaaaacgccuggaaggugucuuguacuauacuugcugcgguuagcguguccccacuguugcucaccucaagccagcagaaagccgacuggauuccucuggcacuaacgaucaagggccugaaucccacagcuaucuuucuuaccacucucagucggaccucuaaaaagagauccuggccacugaacgaggccgucauggccguaggcauggugagcauuuuggcuucgucacugcucaaaaaugacauaccgaugacagggccucuaguugcaggaggucugcuuacugugugcuauguccugaccggcaggucugccgauuuggaacucgagcgagcggcugacgugaagugggaggaucaggccgaaaucaguggguccagccccauucugucuaucacgauuagcgaggacggauccaugucaaucaaaaacgaagaggaggaacaaacacuaaccauacugauccgcacuggccuucucguaauuagugguguguucccagucagcauccccauuacagcagccgcuugguaccugugggagguuaagaagcagcgggcagggguguugugggaugugccuucuccacccccugucggaaaagccgaauuagaggacggcgcguauagaaucaagcagaggggcauauuuggguacucccagauuggagcugguguguauaaagaaggcaccuuccacacuauguggcauguuacacguggggccguacugaugcaccgcggaaagcggaucgagccgucaugggcagaugugaaaaaggaccucaucaguuacggcgguggguggaagcuggagggagaauggaaagagggcgaagagguccaagugcuugcccuggaaccaggcaagaaucccagagcuguucagaccaaaccuggguuguuuaagacgaacacuggaaccauuggugccgugagccuagauuucuccccaggcacaucugggucgcccaucgucgacaggaaaggaaaggugguaggccuguacgguaauggggucgugacccgaagcggagcauauguuucagcuauagcccagacagagaaguccauugaggauaacccugaaaucgaggacgauauuuuccggaaaaagcgccucacuaucauggaccugcauccgggcgcgggcaaaaccaagagauaccuucccgccauagugagggaagcaauuaaacggggguuacgaacgcugauccucgcuccaacaagagucguggccgcugagauggaagaggcauugcgcggacugccuaucagguaucagacucccgccauucgugccgagcacaccggucgggaaaucguugaccucaugugucaugcuacauuuaccaugagacugcuuaguccagugagggucccuaacuacaaucugauuauaauggaugaggcgcacuucacugaccccgcaucuaucgccgcucgcggcuauauuagcacccgaguggaaaugggggaggccgcaggaaucuuuaugacagccacgccaccgggcuccagagauccuuucccccaaucaaacgcuccaaucauggacgaggaacgggagauucccgaaaggucuuggaauagcggucacgaguggguaacugauuuuaaggggaagaccgugugguucguuccuaguauaaaagcgggaaacgacaucgccgcaugcuugcgcaagaauggcaaaaaggucauucagcuaucccguaaaacauuugauagcgaauacgugaagaccagagcuaacgacugggauuucguggucacuacagacaucucugagaugggcgccaauuuucgggcagagaggguaauugauccacgccgauguaugaagcccgugauccugaccgacggggaagagagaguuauacucgccggaccuaugccggugacgcauucauccgcugcccagcggaggggucgcaucggcagaaaccccaaaaaugaaaacgaccaauauauuuacaugggggagcccuuagaaaaugaugaggacugcgcgcacuggaaggaggcaaaaaugcugcuugauaacaucaauacuccugaaggaauuauccccaguauguucgagccagaaagggagaaggucgacgccauagauggcgaauaccggcugcguggugaggcucgcaaaacauuuguggaccucaugcgaagaggggauuugccuguuuggcuggccuauaggguggcugcagagggcauuaacuacgccgaccggcgcugguguuucgauggaaucaagaauaaccagauucucgaagagaacgucgaaguggagaucuggaccaaagagggcgaaagaaagaagcugaaacccagguggcuugacgcucggauauauagcgauccacuagcccugaaggaguucaaagaauuugcagcggggcgaaagucguugaccuuaaaucugaucacugagaugggaagacucccuacauucaugacccagaaagcccgcgacgcucuggauaaccuugccguacugcauacagcagaaguggguggcagggcuuacaaucacgcccucucugaguugccggagacucuggaaacgcuacugcuccuuacccuguuagcaacaguuacugggggaauauuuuuguuccugauguccggcaaggguaucgggaagaugacccucggcaugugcugcauuaucacagccagcauacugcuuugguaugcucagauucaaccccacuggaucgcggccucaaucauucuggaguuuuuccucaucgucuugcugauaccagaaccugagaaacagcggaccccacaggacaaccaguuaacuuacguggugauugcaauccuaacggucguugcugccaccauggccaaugaaaugggauuucuggagaagaccaaaaaggaccucggccuugggaguauuacuacccaagagucugaauccaacauccuggauauagacuugcguccagcaagcgcuuggacacuguaugccguggcgaccacuuucguaacaccuaugcucagacauucaaucgagaauaguagcgugaacgucucccugacggcuauugccaaucaggcaaccgugcuuaugggacucgguaggggcuggccccugucuaaaauggauaucgggguuccguugcuggccauuggauguuacagccaggugaacccaaucacuuuaacagcugcacuacugcuccuugucgcccacuacgcgauuaucggcccuggucugcaggcuaaggccacccgcgaagcacaaaagcgggccgcugccgggauaaugaaaaaucccaccguagacggcauuacagugaucgauuuggagccaauccccuaugacccuaaguuugaaaaacagcugggacagguuaugcuccuggugcuuugcgucacucagguguuaaugaugcgaacgaccugggcacugugugaggcucucacauuggccacuggcccgauuuccacccugugggaggggaaccccggaagauucuggaauacaaccauagcggucucaauggccaacaucuuuaggggcucuuaccuagcuggugcugggcuacucuucaguauuaugaagaauacuacgaacacacgccggggaaccggcaauaucggugaaacucuuggcgagaaauggaagucgagacugaacgccuugggaaagagcgaauuucaaaccuauaaaaaguccggcauucaggagguggaucguacacuggcaaaagagggcaucaagagaggggaaacugaccaucacgcuguuucucggggaucagccaaacuccgcugguucguggagcgaaacaugguaaccccagaaggcaagguggucgaucuggguugcgggagaggaggcuggagcuacuauugugguggccuuaaaaauguuagggaggugaaggggcuaacaaagggaggcccugggcaugaggaaccaauaccuauguccacguacggauggaaccugguccggcuccagaguggcguggacguauucuuuaccccacccgagaaaugcgauacucuacugugugacaucggugaaucuagcccuaauccaacaauugaggccgggcgcaccuugagagugcugaaccucguugaaaauuggcuuaacaauaacacucaauucugcaucaaggugcugaaucccuauaugccgucagucauugagaaaauggaaacauugcagaggaaguacggaggcgcgcuggugcgaaacccucucucccggaauaguacccacgagauguacugggucagcaacgcuacgggcaauaucgugucuuccguuaacaugauaucacguauguuaauuaauagauuuaccaugaaacacaagaaggcaacauaugagccagauguagaccuggggagcggaacucgcaacaucgguaucgaaaacgagauucccaaucuugacauaaucggcaaaaggauugaaaagaucaaacaggagcaugaaaccucguggcacuacgaucaggaccauccuuauaagacaugggccuaccacgggucuuaugagacuaaacaaaccggaagugcuuccagcauggugaacggcgucgugcggcugcuaacaaagccaugggauguugugcccauggucacccagauggccaugacugacacgacaccguucggucagcagagaguguuuaaggagaaaguagauacccgcacucaagaaccuaaggaggggaccaaaaagcucaugaggauuacagcagaauggcuguggaaagaguugggaaagaagaaaacgccccgaauguguacccgggaggaguucacuagaaaggugaggucaaaugccgcucugggcgcgaucuuuacagacgagaacaaauggaaguccgcccgcgaagcaguugaggauucucguuucugggaacucgucgaccgggagagaaaucuucaccuggagggcaaaugcgaaaccuguguguacaacaugauggggaagagggagaaaaaguuaggagaauuugguaaggcuaaaggcagccgcgccauaugguauauguggcugggggcacgauucuuggaguuugaagcccucggauuccugaaugaggaucauugguuuagucggggcaacucccuaagcgguguggagggggaaggacuucacaagcugggcuacauccucagagacgucucuaaaaaggagggcggggcuauguacgccgaugacacugcgggaugggacacaaggauuacccuggaagauuugaaaaaugaggaaaugguuacaaaccauaugaagggugagcacaagaaacuggcagaggccaucuucaagcucacuuaucagaauaaagugguacgcgugcagagaccaaccccucggggcacggucauggacauuaucucaaggaaggaucagcgugggaguggacaagugggcaccuacggucuuaacacauucacuaauauggaagcucagcugauucgacagauggagggggaaggaauauuuaaauccauccaacauuuaaccguuacagaggagauugccgugcagaacuggcuggcacgcgucggcagagaacgguugagcaggauggcuaucucuggcgacgauugcgugguaaagccccucgacgaucgcuucgccucggcucugacugcccuaaaugacauggggaagguuagaaaagauauccagcagugggagccaucacggggauggaacgacuggacccaagugcccuuuugcagccaccacuuccaugaacuugucaugaaggaugguagggugcugguggucccuugucgaaaccaggacgagcucauuggccgugcaagaauaucccagggggcgggauggagucugaaagaaacggccugcuugggcaagucuuaugcucagauguggacauuaauguacuuucaccgccgggaucugaggcucgccgcaaaugcuaucuguagcgccguuccaucccauugggugccgaccucaagaacuacauggaguauucacgcaaaacacgaguggaugaccacugaggacaugcuugccguauggaaccgcguguggauccaagaaaaucccuggauggaggacaagaccccugucgaaucuugggaggaagugccauaucuggguaagcgggaggaucaguggugcgggagccuaauuggacugacauccagggcgacgugggcuaaaaacauccagaccgccauaaaucagguucgaucacucaucggcaacgaggaauacacugacuauaugcccagcaugaagagauuccggaaagaggaagaggaagcaggcguguugugguga

SEQ ID NO: 14729 - RNA, 9876 nt, Artificial Sequence
  derived and/or modified CDS sequence (opt3) from DENV-2__EU482740__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccgaaaaggacuccccugucaacaucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaccaaguguucggcgcuauuuacggagcggcauuuaguggcguaagcuggacuaugaaaaucuugauaggggucaucauuaccuggaucggaaugaacuccagaucuacgagccugucagugagucucguucuggugggcgucgugacacuuuaucugggugccaugguacaggcugacuccgggugugugguuagcuggaagucuaaagaauugaagugcggaucaggcauuuucaucaccgauaauguccacacuuggacagagcaguacaaguuucagcccgaaaguccaagcaaacucgccuccgcaauacaaaaggcccaugaggaagguauuuguggcaucaggucugugacccggcuggagaacuuaauguggaaacagauuacucccgagcugaaucacauccuaucggaaaacgaggugaagcucaccauaaugacaggggacaucaaaggaauuaugcagccuggcaagcgcagccugagaccacagccgacggaacuuaaauauuccuggaagaccugggggaaggcuaaaauguugucaacugagagucauaaucaaacauuccugaucgauggacccgaaaccgccgagugcccuaacacaaauagggcauggaacucucucgaggucgaagacuacggcuuugguguuuucacuaccaauauuuggcugaaguuacgugagaaacaggacguguuuugugauagcaagcugauguccgcggcuaucaaagacaaccgggccgugcacgcagauaugggguauuggauagaaucagcccuuaaugacacguggaagauggagaaggcuagcuucauugagguaaaaucuugccacuggccaaagucccauacauuguggaguaacggaguccucgaaagcgagaugaucauccccaaaaauuucgccggcccugugucucagcacaacuaccgaccagguuaucauacccagacugcaggccccuggcaccuggggaagcuagaaauggauuuugacuucugugagggaaccacaguuguggucacugaagauugcggcaacagagggccgucccugaggaccacaacggcuucaggaaaacucauuaccgaguggugcugucgcaguugcacucugccuccacuucgguacagaggcgaggacgguuguugguacgggauggaaaucaggcccuugaaggagaaggaagagaaucuggugaacagcuuaguuacagccggacauggccaaauugauaauuuuucgcucggugugcugggcauggcgcuuuuccuggaagagauguugcgcacccgaguagggacuaaacacgccauacuccuggucgcuguguccuuugugacacuaaucaccggaaacaugucuuuccgggaccugggccgugucaugguuauggugggggcaacgaugacugaugacauuggaaugggcguaaccuaucucgcccugcuugcugccuuuaaggugagaccuacauucgcagcggguuugcuguuaaggaaacucaccagcaaggagcugaugauggccacuaucgggauugcucuucugucacagaguacaauccccgaaaccauacuagagcucacagaugcccuggcauugggaaugaugguccugaaaaucgugcgcaauauggaaaaguaccaguuagcuguuacuauuauggccaucuccugcgugccaaacgcagucauucuccaaaaugccuggaaggugucuuguaccauccuggcuguugugagcgucuccccucuucuguugacgucaagccagcagaaagcggacuggauaccccucgcccugacaauuaagggccuaaacccaaccgcaaucuuucugacuacccuuagucggacaucuaaaaagagauccuggccgcucaaugaggcuaucauggccguaggcauggugagcauucuggccucgucauugcugaaaaacgacauaccuaugacugggcccuuaguugcuggaggucuccugaccgugugcuauguccuuacgggcaggucugcagaucuggaauuggagcgagccgcggacgugaagugggaggaucaggcugaaaucaguggguccagcccaauucucucuaucacaauuagcgaggacggauccaugucaaucaaaaaugaagaggaggaacaaacccugacuauacuaauccgcacaggccugcuuguaauuagugguguguuccccgucagcaucccuauuaccgccgcagccugguaccucugggagguuaagaagcagcgggcuggggugcugugggaugugccaucucccccuccggucggaaaagcagaauuggaggacggcgccuauagaaucaagcagaggggcauauuaggguacucccagauuggagcggguguguauaaagaaggcacuuuucacacaauguggcauguuacccguggggcuguacugaugcaccgcggaaagcggaucgagccaucaugggccgaugugaaaaaggaccucaucaguuacggcgguggguggaagcuggagggagaauggaaagagggcgaagagguccaagugcuugcacuggaacccggcaagaacccuagagccguucagacgaaaccaggguuguucaagacuaauaccggaacaauuggugcugugagccuagauuuuucccccggcaccucugggucgccuaucgucgacaggaaaggaaaggugguaggccuguacgguaacggggucgugacacgaagcggagccuauguuucagcaauagcucagacugagaaguccauugaggauaauccggaaaucgaggacgauauuuuccggaaaaagcgccucaccaucauggaccugcaucccggcgccggcaaaacgaagagauaccuuccagcgauagugagggaagccauuaaacggggguuacgaacacugauccucgcaccuacuagagucguggcugccgagauggaagaggcuuugcgcggacugcccaucagguaucagaccccagcaauucgugccgagcacacaggucgggaaaucguugaccucaugugucaugccaccuucacuaugagacugcuuaguccugugaggguccccaacuacaaccugauuauaauggaugaggcucacuuuaccgacccagcgucuaucgcagcccgcggcuauauuagcacacgaguggaaaugggggaggcugccggaaucuucaugacggcaacuccgccuggcuccagagaucccuuuccacaaucaaaugcccccaucauggacgaggaacgggagauuccugaaaggucuuggaacagcggucacgaguggguaaccgauuucaaggggaagacagugugguuuguuccaaguauaaaagcuggaaaugacaucgcggccugcuugcgcaagaacggcaaacgugucauucagcuauccagaaagaccuucgauagcgaauacgugaaaacucgggcaaaugacugggauuuuguggucacaaccgacaucucugagaugggcgcuaacuucaaggccgagaggguaauugauccccgccgauguaugaagccugugauccugacggacggggaagagagaguuauacucgcaggaccgaugccagugacucauucauccgccgcucagcggaggggucgcaucggcagaaaucccaaaaacgaaaaugaccaauauauuuacaugggggagccuuuagaaaacgaugaggacugcgcccacuggaaggaggcgaaaaugcugcuugauaauaucaacacacccgaaggaauuaucccaaguauguuugagccugaaagggagaaggucgacgcaauagauggcgaauaccggcugcguggugaggcccgcaaaaccuucguggaccucaugcgaagaggggauuugcccguuuggcuggcuuauaggguggccgcugagggcauuaauuacgcagaccggcgcugguguuuugauggaaucaagaacaaucagauucucgaagagaacgucgaaguggagaucuggaccaaagagggcgaaagaaagaagcugaaaccaagguggcuugacgcccggauauauagcgauccucuagcucugaaggaguucaaagaauucgccgcagggcgaaagucguugacuuuaaaccugaucacagagaugggaagacucccgaccuuuaugacacagaaagcgcgcgacgcccuggauaaucuugcuguacugcauacugccgaagcagguggcagggcuuacaaccacgcccucucugaguugcccgagacgcuggaaacccuacugcuccuuacacuguuagcaacugugaccgggggaauuuucuuguuucugauguccggcaaggguaucgggaagaugacacucggcaugugcugcauuaucaccgccagcauacugcuuugguaugcucagauucaaccacacuggaucgcggccucaaucauucuggaguucuuucucaucguuuugcugauaccugaacccgagaaacagcggacuccacaggacaaucaguuaacguacgucgugauugcaauccuaaccguggucgcugccacaauggccaacgaaaugggauuccuggagaagacuaaaaaggaccucggccuugggaguauuaccacacaagagucugaauccaauauccuggauauagacuugcguccugcaagcgcuuggacccuguaugccguugcgacuacauuugugacgcccaugcucagacauucaaucgagaacaguagcguaaaugugucccugaccgcuauugccaaccaggcaacuguccuuaugggacucgguaaaggcuggccgcugucuaagauggauaucggggugccauugcuggccauuggauguuacagccagguuaauccuaucacauuaaccgcugcacuacugcuccuuguggcccacuacgcgauuaucggccccggucugcaggcuaaggccaccagggaagcacaaaaacgcgccgcugccgggauaaugaagaacccaacagucgacggcauuacuguaaucgauuuggagcccaucccuuaugacccgaaauucgaaaagcagcugggacaggugaugcuccugauucuuugcguuacgcagguguuaaugaugcggaccacaugggcacugugugaggcucucacuuuggccaccggccccauauccacacugugggaggggaauccaggacgauuuuggaacaccacuaucgcggucucaauggccaauauuuucagaggcucuuaccuagcaggugcugggcugcucuuuaguaucaugaaaaacacgacaaauaccaggcgcggaacuggcaacauuggugaaacccuuggcgagaaguggaagucgcggcugaaugccuuggggaaaagcgaauuccaaaucuauaagaaauccggaauacaggagguggauagaacacuggcaaaggagggcaucaaacguggggaaacugaccaucacgcugucucuaggggaucagccaagcuccggugguuuguggagcgcaacaugguuaccccugaaggcaaagugguagaucuggguugcgggcgaggaggcuggagcuacuauugugguggcuuaaagaacgugagagaggucaaggggcuuacaaaaggaggccccgggcaugaagagccuauuccaauguccacguacggauggaaucugguuaggcuccagaguggcguggacgucuucuucacccccccugagaagugcgauacucuacugugugacaucggugaaucuagcccaaaccccacaauugaggccgggcggaccuugcgcgugcugaaucucguagaaaacuggcuuaauaacaauacucaauuuugcgugaaaguucugaacccguauaugccuucagugaucgagaagauggaaacauugcagagaaaauacggaggcgcgcuggucaggaauccacucucccgaaacaguacccacgagauguacugggugagcaaugcuacgggcaacauagucucuuccgugaauaugauuucacggauguuaaucaaccguuucaccaugaagcacaagaaagcaacauaugagcccgauguugaccuggggagcggaacuagaaauaucgguauugaaucggagauaccuaaccuugacaucauuggcaagcgcaucgaaaaaauuaagcaggagcaugaaaccucuuggcacuacgaucaggaccauccauauaaaacaugggccuaccacgggaguuaugagacuaagcaaaccggauccgcuagcucaaugguaaacggcguggucaggcugcuaacaaagcccugggaugugguuccgauggugacccagauggccaugacugacacgacaccuuuuggucagcagcgggucuucaaagagaagguggauaccagaacucaagaacccaaagaggggaccaagaaacucaugaagaucacagcagaauggcuguggaaggaguugggaaaaaagaaaacgccacgcauguguaccagggaggaauuuacucgaaagguacgguccaaugccgcucugggcgcgauauucacagacgagaacaaauggaagucugccagagaagcaguggaggauagcagguuuugggaacucaucgaccgcgagcguaaucuucaccuggagggcaaaugcgaaaccuguguuuacaacaugauggggaagcgggagaagaaauuaggagaauucgguaaggcuaaaggcaguagagccauuugguauauguggcugggggcaagguuuuuggaguucgaagcccucggauuucugaaugaggaucauugguucucccgcggcaacagccuaucuggugucgagggggaaggacuucaccgacugggcuacauccuccgggacgugucaaagaaagagggcggggcuauguacgccgaugacacugcgggaugggacacaagaauuacccuggaagauuugaagaaugaggaaauggugacaaaccauaugaagggugagcacaaaaagcuggcagaggccaucuuuaaacucacuuaucagaauaaggucguuagggugcagcgcccuacccccagaggcacgguaauggacauuauaagucggagggaucagcguggguccggacaagugggcaccuacggucuuaacacauucacuaauauggaagcucagcugauccgacagauggagggggaaggaauuuucaaaagcauccaacauuuaaccgucacagaggagaucgccgugcagaacuggcuggcacgcguuggcagagaacgguugucuaggauggcuauuucgggcgacgauugcguggucaagccacucgacgaucgcuuugccucagcucugacugcccuaaaugacauggggaaggugagaaaagauauacagcagugggagcccagccggggauggaacgacuggacccaaguaccuuucugcucccaccacuuucaugaacuuguuaugaaggaugguagggugcuggucgugccaugucgaaaucaggacgagcucaucggccgugcaagaauuagucagggggcgggauggucucugaaagaaacggccugcuugggcaagagcuaugcucagauguggacauuaauguacuuccaccgccgggaucugaggcucgccgcaaacgcuaucuguuccgccgugccgucacauuggguccccaccaguagaacuacauggucuauucacgcaaaacacgaguggaugaccacugaggacaugcuugccguuuggaaccgcguguggauccaagaaaauccuuggauggaggacaagaccccaguagaaagcugggaggaagugcccuaucuggguaagcgggaggaucaguggugcgggucccuaauaggacugacaucaagggcgacgugggcuaaaaacauccagaccgccauuaaucagguccgaagccucaucggcaacgaggaauacacugacuauaugccuucuaugaagagauuucggagggaggaagaggaagcaggcguguugugguga

SEQ ID NO: 14730 - RNA, 9876 nt, Artificial Sequence
  derived and/or modified CDS sequence (opt3) from DENV-2__EU482741__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcucuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucacaacuaauauuuggcugaaguuacgugagaaacaggacguguuuugugauagcaagcugauguccgccgcaaucaaagacaaccgggccgugcacgcugauaugggguauuggauagaaucagcccuuaaugacaccuggaagauggagaaggcaagcuucauugagguaaaaucuugccacuggccuaagucccauacguuguggaguaacggaguccucgaaagcgagaugaucaucccaaaaaauuucgcuggccccgugucucagcacaacuaccgaccugguuaucauacacagaccgccggcccauggcaccuggggaagcuagaaauggauuuugacuucugugagggaacuaccguuguggucacagaagauugcggcaacagagggcccucccugaggacuaccacagcgucaggaaaacucauuacggaguggugcugucgcaguugcacccugccgccucuucgguacagaggcgaggacgguuguugguacgggauggaaaucaggccauugaaggagaaggaagagaaucuggugaacagcuuaguuacugccggacauggccaaauugauaauuuuucgcucggugugcugggcauggcucuuuuccuggaagagauguugcgcacacgaguagggaccaaacacgcaaugcuccuggucgugguguccuuugucacucuaauaacaggaaacaugucuuuccgggaccugggccguguuauggugaugguaggggccaccaugacggaugacaucggaaugggcauuacuuaucucgcucugcuugccgcauuuaaggugagacccaccuucgcggccgguuugcuguuaaggaaacucacaagcaaggagcugaugauggcuaccaucgggauugcccuucugucacagaguacuaucccugaaacaauacuagagcucaccgaugcacuggcuuugggaaugaugguccugaaaaucgugcgcaauauggaaaaguaccaguuagccguuacaauuauggcaaucuccugcgugcccaacgccgucauucuccaaaaugcuuggaaggugucuuguacuauccuggcggccguuagcguguccccacuucuguugaccucaagccagcagaaagcagacuggauaccucucgcucugacgauuaagggccuaaaccccacagccaucuuucugaccacucuuagucggaccucuaaaaagagauccuggccacucaaugaggccaucauggcugucggcaugguaagcauucuggcaucgucauugcugaaaaacgacauaccgaugacagggccuuuaguggccggaggucuccugacuguuugcuaugugcuuaccggcaggucugcggaucuggaauuggagcgagcugccgacgucaagugggaggaucaggcagaaaucaguggguccagccccauucucucuaucacgauuagcgaggacggauccaugucaaucaaaaaugaagaggaggaacaaacacugaccauacuaauccgcacuggccugcuugugauuagugguguauucccagugagcauccccauuacagccgcugcaugguaccucugggaggucaagaagcagcgggccgggguucugugggaugugccuucuccacccccuguggaaaaagcggaguuggaagacggagcuuauagaaucaagcagaggggcauauuaggcuacucccagauuggggccggagucuauaaagaggguaccuuucacacuauguggcaugugacacguggcgcaguucugaugcaccgcgggaagcggaucgagccgucaugggccgauguaaaaaaggaccucaucaguuacggaggcgguuggaagcuggaaggggaguggaaagaaggagaggaagugcaaguccuugcucuggagccaggcaagaaccccagagccgugcagaccaaaccuggcuuguucaagacgaauacugggaccauuggagcaguuagccuagauuuuuccccagguacaucuggcucgcccaucguggacaggaaagggaaggucgugggacuguacggcaacgguguagucacccgaagcggggcuuaugugucagccauagcgcagacagagaaguccauugaagauaauccugagaucgaagacgauauuuuccggaaaaagcgccucacuaucauggaccugcauccgggagccggcaaaaccaagagauaccuucccgcaauaguuagggaggcuauuaaacggggcuuacgaacgcugauccucgccccaacaagaguggucgcugcagaaauggaggaggccuugcgcgggcugccuaucagguaucagacucccgccauucgugcugaacacaccggacgggagaucguggaccucaugugucaugcgacauucaccaugagacugcuuaguccaguuagggugccuaacuacaaccugauuauaauggaugaagcacacuuuacugaccccgccucuaucgcugcccgcgguuauauuagcacccgagucgagaugggcgaggcagccgggaucuucaugacagcuacgccaccgggauccagagauccuuuuccccaaucaaaugcgccaaucauggacgaagagcgggaaauucccgagaggucuuggaacagcggccacgaaugggugacugauuucaaggguaagaccguaugguuugugccuaguauaaaagccgggaaugacaucgcagcuugcuugcgcaagaacggaaaaaagguuauucagcuaucccguaaaacauucgauagcgaguacgucaagaccagagccaaugacugggauuuuguggugacuacagacaucucugagaugggcgcaaacuucaaggccgaacgggucauugauccaaggcgcuguaugaaacccguaauccugaccgacggcgaggaacgagugauacucgcugggccuaugccgguuacgcauucauccgccgcgcagagacggggaaggaucggucgcaauccaaagaacgagaaugaccaauauauuuacaugggcgaacccuuagagaacgaugaggacugcgcacacuggaaagaagccaagaugcugcuugauaauaucaacacuccugaggggauuauccccaguauguuugaaccagagagagaaaaaguggacgcuauagauggagaguacaggcugcggggcgaggcccguaagacauucgucgaccucaugcgccgaggugauuugccuguguggcuggcuuauagaguugcagccgaagggauuaauuacgcugacaggcggugguguuuugauggcaucaaaaacaaucagauucucgaggaaaacguggaggucgagaucuggaccaaggaaggagagcgcaagaaacugaagcccagauggcuugacgccaggauauauagcgauccacuagcacugaaagaauucaaggaguucgcggccggccggaaaucguugaccuuaaaccugaucacugaaauggggcgacucccuacauuuaugacccagaaggcuagagacgcccuggauaaucuugcagugcugcauacagcugaggccggaggucgcgcauacaaccacgcccucucugaguugccggaaacucuggagacgcuacugcuccuuacccuguuagcuacaguaacuggcgggauuuucuuguuucugauguccggaaagggcaucgguaaaaugacccucgggaugugcugcauuaucacagcgagcauacugcuuugguaugcccagauucaaccccacuggaucgcagcuucaaucauucuggaauucuuucucaucguguugcugauaccagagccugaaaagcagaggaccccccaggacaaucaguuaacuuacguugucauugccauccuaacggugguggccgcaaccauggcuaacgagaugggcuuccuggagaaaacaaagaaagaccucggacuuggcaguauugccacucaagaaucugaguccaauauccuggauauagacuugcggccagcgagcgcuuggacccuguaugccgucgcaacaaccuuuguuacuccuaugcuccgucauucaaucgaaaacaguagcgugaauguaucccugacagccauugcuaaccaggcaacggugcuuauggggcucggaaaggguuggccccugucuaagauggauaucggcgucccguugcuggccauuggguguuacagccaggugaauccaaucaccuuaacugcggcucuacugcuccuuguugcccacuacgcaauuaucggaccuggccugcaggccaaagcuacaagagaggcccaaaagagggcagcugccgguauaaugaaaaaccccaccguggacgggauuaccgucaucgauuuggaaccaauccccuaugacccuaaguucgagaaacagcugggccagguaaugcuccugauucuuugcgugacacagguuuuaaugaugcgcacuacgugggcgcugugugaggcccucaccuuggcaacaggaccgauauccacucugugggaaggcaaucccgggcgguuuuggaacaccacaaucgcugugucaauggccaauauuuuccgaggaucuuaccuagcaggcgcuggucugcucuuuaguaucaugaagaacaccacuaauacgagaagggggacaggaaacauuggcgagacccuuggugaaaaguggaaaucgcgccugaaugccuugggcaagagcgaguuccaaaucuauaaaaaguccgggauacaggaggucgaucggacucuggccaaagaaggaaucaagagaggcgagaccgaccaucacgcggugucucgugggucagcuaaacucaggugguuugucgaacggaacauggugacaccagagggaaagguuguggaucugggcugcggucgcgggggauggagcuacuauuguggcgguuuaaagaacguacgagaagugaaaggccuuacuaaggggggaccuggccaugaggagcccauuccuauguccaccuacggguggaaucuggucagacuccagaguggaguugacguguucuucacaccacccgaaaaaugcgauacgcuacugugugacaucggcgagucuagcccuaacccaaccauugaagcagguaggacuuugcggguccugaaucucguggagaacuggcuuaauaacaauacacaauuuugcaucaagguacugaaccccuauaugccgucagugauagaaaaaauggagaccuugcagcgcaaguacgggggagcccugguuagaaauccucucuccaggaacaguacucacgagauguacugggugagcaaugcuacaggcaacauugucucuuccgugaauaugaucucacgaauguuaaucaaccgguucaccaugaagcacaaaaaggccacguaugaaccagaugucgaccugggcagcgggacccguaauauuggaauagagucggaaauccccaaccuugacauuaucgguaaaagaauugagaagaucaaacaggaacaugagacaucuuggcacuacgaucaggaccauccuuauaagacuugggcauaccacggcaguuaugagaccaagcaaacaggguccgccagcucaauggugaacggaguuguacgccugcuaacuaaaccaugggaugugguccccauggugacccagauggcuaugacagacaccacuccguuuggccagcagaggguuuucaaggaaaaaguggauacgcggacacaagagccuaaggaagguaccaaaaagcucaugaagauaacugcggaguggcuguggaaagaguuggggaagaaaaagacccccagaauguguacacgcgaagaguuuacgaggaaaguccgauccaaugccgcacugggagcuaucuucaccgacgaaaacaaguggaaaucugcccgggaggcaguggaagauagcagauuuugggagcucauugacagggagcgcaaucuucaccuggaaggcaagugcgagacuuguguauacaacaugaugggcaagcgugaaaaaaaguuaggggaguucggaaaagccaaggguagucgggcuaucugguauauguggcugggcgccagauuuuuggaauucgaggcgcucggguuucugaaugaggaucauugguucuccaggggaaacagccuaucuggcguggaaggugaggggcuucaccgccugggauacauucuccgagacguuucaaaaaaggaaggcggcgcaauguacgccgaugacacagcugggugggacacccggaucacucuggaggauuugaagaaugaagagauggucacaaaccauaugaaaggagagcacaagaaacuggccgaagcaauuuuuaagcucaccuaucagaauaaaguggugagaguccagaggccaacaccucgcgguacuguuauggacauaaucaguagacgggaucagaggggcuccgggcaagugggaaccuacggccuuaacacguucaccaauauggaggcucagcugauucgucagauggaaggugaggggaucuucaagagcauccaacauuuaacaguaacugaggaaauugccgugcagaacuggcuggcucgagucggacgcgagagauugucucggauggccauaucgggcgacgauugcgugguuaagccccucgacgauagguuugcaucagcgcugaccgcccuaaaugacaugggcaaagugcgcaaggauauccagcagugggaaccaagcagaggguggaacgacuggacacaaguccccuucugcucccaccacuuucaugagcuugugaugaaagauggacggguacugguugugccuuguaggaaucaggacgaacucauuggucgagcucguaucagucagggcgccggguggucucugaaggagacugcaugcuugggaaaaagcuaugcucagauguggaccuuaauguacuuccacagacgcgaucugcggcucgccgcaaacgccauuuguuccgcggucccaucacauugggugccgacgaguaggacaaccuggucuauccacgcuaagcacgaguggaugacuacagaagacaugcuugccguguggaacagagucuggauacaagagaaucccuggauggaagacaagaccccuguugagagcugggaagaggugccauaucugggcaaacgcgaggaucaguggugcgguucccuaaucgggcugacuucacgggcaaccugggccaagaacauucagacagcuaucaaucagguaaggagccucauuggaaacgaagaguacacggacuauaugcccucuaugaaacgauuuagacgggaagaggaagaggccggcguguugugguga

SEQ ID NO: 14731 - RNA, 9876 nt, Artificial Sequence
  derived and/or modified CDS sequence (opt3) from DENV-2__EU482742__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaccagagauucagauguccucagguaaucugcucuuuacaggccaucugaaaugccgucuucgcauggauaagcugcaguugaaagggaugagcuacaguauguguaccggaaaguucaagaucgugaaagaaaucgcugagacacaacacggcacuauuguaaucagaguucaguaugagggugacgggucucccugcaagauuccguucgaaauaauggaucucgagaaaaggcaugugcugggccgguuaaucaccgucaacccuauugugacggaaaaggacucccccgucaacaucgaggccgaaccaccuuuuggagauagcuacaucauuauaggcguggagcccgggcagcugaaacuaaauugguucaagaagggaucgucuaucggucagauguuugagaccacaaugcgaggcgcuaaacgcauggccauucucggggacacugcaugggauuucggaucccugggcgguguuuuuaccucaaucgggaaggcccuucaccaaguguucggcgcuauuuacggagcggcauuuaguggcguaagcuggacaaugaaaaucuugauaggggucaucauuacuuggaucggaaugaacuccagaucuaccagccugucagugagucucguucuggugggcgucgugacgcuuuaucugggugccaugguacaggcugacuccgggugugugguuagcuggaagucuaaagaauugaagugcggaucaggcauuuucaucacagauaauguccacaccuggacugagcaguacaaguuucagccagaaagucccagcaaacucgccuccgcaauacaaaaggcccaugaggaagguauuuguggcaucaggucugugacacggcuggagaacuuaauguggaaacagauuaccccugagcugaaucacauccuaucggaaaacgaggugaagcucacuauaaugaccggggacaucaaaggaauuaugcaggcuggcaagcgcagccugagaccacagccgacagaacuuaaauauuccuggaagacgugggggaaggccaaaauguugucaaccgagagucauaaucaaacuuuccugaucgauggacccgaaacagcagagugcccuaacaccaauagggcguggaacucucucgaggucgaagacuacggcuuugguguuuucacaacuaauauuuggcugaaguuacgugagaaacaggacguguuuugugauagcaagcugauguccgcugccaucaaagacaaccgggcagugcacgccgauaugggguauuggauagaaucagcucuuaaugacaccuggaagauggagaaggccagcuucauugagguaaaaucuugccacuggccaaagucccauacguuguggaguaacggaguccucgaaagcgagaugaucauccccaaaaauuucgcaggcccugugucucagcacaacuaccgaccagguuaucauacacagaccgcuggccccuggcaccuggggaagcuagaaauggauuuugacuucugugagggaacuaccguuguggucacagaagauugcggcaacagagggccgucccugaggacuaccacagccucaggaaaacucauuacggaguggugcugucgcaguugcacccugccuccacuucgguacagaggcgaggacgguuguugguacgggauggaaaucaggcccuugaaggagaaggaagagaaucuggugaacagcuuaguuacugcgggacauggccaaauugauaauuuuucgcucggugugcugggcauggcccuuuuccuggaagagauguugcgcacacgaguagggaccaaacacgcuauacuccuggucgcaguguccuuugugacucuaaucacaggaaacaugucuuuccgggaccugggccgugucaugguuauggugggggccaccaugacggaugacauuggaaugggcguaacuuaucucgcucugcuugccgcauuuaaggugagaccuaccuucgcggccgguuugcuguuaaggaaacucacaagcaaggagcugaugauggcuaccaucgggauugcccuucugucacagaguacuauccccgaaacaauacuagagcucaccgaugcacuggcuuugggaaugaugguccugaaaaucgugcgcaauauggaaaaguaccaguuagccguuacaauuauggcaaucuccugcgugccaaacgccgucauucuccaaaaugcuuggaaggugucuuguacuauccuggcggccguuagcguguccccucuucuguugaccucaagccagcagaaagcagacuggauaccccucgcucugacgauuaagggccuaaacccaacagccaucuuucugaccacucuuagucggaccucuaaaaagagauccuggccgcucaaugaggccaucauggcugucggcaugguaagcauucuggcaucgucauugcugaaaaacgacauaccuaugacagggcccuuaguggccggaggucuccugacuguuugcuaugugcuuaccggcaggucugcggaucuggaauuggagcgagcugccgacgucaagugggaggaucaggcagaaaucaguggguccagcccaauucucucuaucacgauuagcgaggacggauccaugucaaucaaaaaugaagaggaggaacaaacacugaccauacuaauccgcacuggccugcuugugauuagugguguauuccccgugagcaucccuauuacagccgcugcaugguaccucugggaggucaagaagcagcgggccgggguucugugggaugugccaucucccccuccggugggaaaagcggaauuggaggacggcgcuuauagaaucaagcagaggggcauauuaggguacucccagauuggagccggugucuauaaagaaggcaccuuucacacuauguggcaugugacacguggggcaguucugaugcaccgcggaaagcggaucgagccaucaugggccgauguaaaaaaggaccucaucaguuacggcgguggguggaagcuggagggagaauggaaagagggcgaagaggugcaaguccuugcucuggaacccggcaagaacccuagagccgugcagaccaaaccaggguuguucaagacgaauacuggaaccauuggugcaguuagccuagauuuuucccccggcacaucugggucgccuaucguggacaggaaaggaaaggucgugggccuguacgguaacgggguagucacccgaagcggagcuuaugugucagccauagcgcagacagagaaguccauugaggauaauccggaaaucgaggacgauauuuuccggaaaaagcgccucacuaucauggaccugcaucccggcgccggcaaaaccaagagauaccuuccagcaauaguuagggaagcuauuaaacggggguuacgaacgcugauccucgccccuacaagaguggucgcugcagagauggaagaggccuugcgcggacugcccaucagguaucagacuccagccauucgugcugagcacaccggucgggaaaucguggaccucaugugucaugcgacauucaccaugagacugcuuaguccuguuagggugcccaacuacaaccugauuauaauggaugaggcacacuuuacugacccagccucuaucgcugcccgcggcuauauuagcacccgagucgaaaugggggaggcagccggaaucuucaugacagcuacgccgccuggcuccagagaucccuuuccacaaucaaaugcgcccaucauggacgaggaacgggagauuccugaaaggucuuggaacagcggucacgagugggugacugauuucaaggggaagaccguaugguuugugccaaguauaaaagccggaaaugacaucgcagcuugcuugcgcaagaacggcaaaaagguuauucagcuaucccguaaaacauucgauagcgaauacgucaagaccagagccaaugacugggauuuuguggugacuacagacaucucugagaugggcgcaaacuucaaggccgagcgggucauugaucccaggcgcuguaugaaaccuguaauccugaccgacggggaagagcgagugauacucgcuggaccgaugccaguuacgcauucauccgccgcgcagagacgggguaggaucggccgcaaucccaagaacgaaaaugaccaauauauuuacaugggggagccuuuagaaaacgaugaggacugcgcacacuggaaagaggccaagaugcugcuugauaauaucaacacucccgaaggaauuaucccaaguauguuugagccugaaagagagaaaguggacgcuauagauggcgaauacaggcugcggggugaggcccguaagacauucgucgaccucaugcgccgaggggauuugcccguguggcuggcuuauagaguugcagccgagggcauuaauuacgcugacaggcggugguguuuugauggaaucaaaaacaaucagauucucgaagagaacguggaagucgagaucuggaccaaggagggcgaacgcaagaaacugaagccaagauggcuugacgccaggauauauagcgauccucuagcacugaaagaguucaaggaauucgcggccgggcggaaaucguugaccuuaaaccugaucacugagaugggacgacucccgacauuuaugacccagaaggcuagagacgcccuggauaaucuugcagugcugcauacagcugaagccgguggccgcgcauacaaccacgcccucucugaguugcccgagacucuggaaacgcuacugcuccuuacccuguuagcugcgguaacagggggaauuuucuuguuucugauguccggcaaggguaucgggaaaaugacucucggcaugugcugcauuaucaccgccagcauacugcuuugguaugcacagauucaaccacacuggaucgcugccucaaucauucuggaguucuuucucaucguguugcugauaccugaacccgagaagcagaggacaccacaggacaaucaguuaaccuacguugucauugccauccuaacugugguggcagcuacgauggccaacgaaaugggauuccuggagaaaaccaagaaagaccucggccuugggaguauuacaacucaagagucugaauccaauauccuggauauagacuugcggccugcgagcgcuuggacccuguaugccgucgcaacaaccuuuguuacucccaugcuccgucauucaaucgagaacaguagcgugaauguaucccugacagccauugcuaaccaggcaacggugcuuaugggacucgguaagggcuggccgcugucuaagauggauaucggggucccauugcuggccauuggauguuacagccaggugaauccuaucaccuuaacugcggcucuacugcuccuuguugcccacuacgcaauuaucggccccggucugcaggccaaagcuacaagagaagcccaaaagagggcagcugccgggauaaugaaaaacccaaccguggacggcauuaccgucaucgauuuggagcccaucccuuaugacccgaaguucgaaaaacagcugggacagguaaugcuccugauucuuugcgugacacagguuuuaaugaugcgcacuacgugggcgcugugugaggcccucaccuuggcaacaggccccauauccacucugugggaggggaauccaggacgguuuuggaacaccacaaucgcugugucaauggccaauauuuuccgaggcucuuaccuagcaggugcugggcugcucuuuaguaucaugaagaacaccacuaauacgagaaggggaacaggcaacauuggugaaacccuuggcgagaaguggaaaucgcgccugaaugccuuggggaagagcgaauuccaaaucuauaaaaaguccggaauacaggaggucgaucggacucuggccaaagagggcaucaagagaggggaaaccgaccaucacgcggugucucguggaucagcuaaacucaggugguuugucgagcggaacauggugacaccugaaggcaagguuguggaucuggguugcgggcgcggaggcuggagcuacuauugugguggcuuaaagaacguacgagaggugaaagggcuuacuaagggaggccccgggcaugaagagccuauuccaauguccaccuacggauggaaucuggucagacuccagaguggcguugacguguucuucacacccccugagaaaugcgauacgcuacugugugacaucggugaaucuagcccaaaccccaccauugaggcagggaggacuuugcggguccugaaucucguggaaaacuggcuuaauaacaauacacaauuuugcaucaagguacugaacccguauaugccuucagugauagagaaaauggaaaccuugcagcgcaaguacggaggcgcccugguuagaaauccacucuccaggaacaguacucacgagauguacugggugagcaaugcuacaggcaacauugucucuuccgugaauaugaucucacgaauguuaaucaaccgguucaccaugaagcacaaaaaggccacguaugagcccgaugucgaccuggggagcggaacccguaauauugguauagaaucggagaucccuaaccuugacauuaucggcaaaagaauugaaaagaucaaacaggagcaugaaacaucuuggcacuacgaucaggaccauccauauaagacuugggcauaccacgggaguuaugagaccaagcaaacaggauccgccagcucaauggugaacggcguuguacgccugcuaacuaaacccugggauguggucccgauggugacccagauggcuaugacagacaccacuccuuuuggucagcagaggguuuucaaggagaaaguggauacgcggacacaagaacccaaggaggggaccaaaaagcucaugaagauaacugcggaauggcuguggaaagaguugggaaagaaaaagaccccaagaauguguacacgcgaggaauuuacgaggaaaguccgauccaaugccgcacugggcgcuaucuucaccgacgagaacaaguggaaaucugcccgggaagcaguggaggauagcagauuuugggaacucauugacagggagcgcaaucuucaccuggagggcaagugcgaaacuuguguauacaacaugauggggaagcgugagaaaaaguuaggagaauucgguaaagccaagggcagucgggcuaucugguauauguggcugggggccagauuuuuggaguucgaagcgcucggauuucugaaugaggaucauugguucuccaggggcaacagccuaucugguguggagggggaaggacuucaccgccugggcuacauucuccgagacguuucaaaaaaggagggcggggcaauguacgccgaugacacagcuggaugggacacccggaucacucuggaagauuugaagaaugaggaaauggucacaaaccauaugaaaggugagcacaagaaacuggccgaggcaauuuuuaagcucaccuaucagaauaaaguggugagaguccagaggccuacaccccgcggcacuguuauggacauaaucaguagacgggaucagaggggguccggacaagugggcaccuacggucuuaacacguucaccaauauggaagcucagcugauucgucagauggagggggaaggaaucuucaagagcauccaacauuuaacaguaacugaggagauugccgugcagaacuggcuggcucgagucggccgcgaaagauugucucggauggccauaucgggcgacgauugcgugguuaagccacucgacgauagguuugcaucagcgcugaccgcccuaaaugacauggggaaagugcgcaaggauauccagcagugggagcccagcagaggauggaacgacuggacacaagucccuuucugcucccaccacuuucaugaacuugugaugaaagauggucggguacugguugugccauguaggaaucaggacgagcucauuggccgagcucguaucagucagggggccggauggucucugaaggaaacugcaugcuugggcaaaagcuaugcucagauguggaccuuaauguacuuccacagacgcgaucugcggcucgccgcaaacgccauuuguuccgcggucccgucacauugggugcccacgaguaggacaaccuggucuauccacgcuaagcacgaguggaugacuacagaggacaugcuugccguguggaacagagucuggauacaagaaaauccuuggauggaggacaagaccccaguugaaagcugggaggaagugcccuaucuggguaaacgcgaggaucaguggugcgggucccuaaucggacugacuucacgggcaaccugggccaagaacauucagacagcuaucaaucagguaaggagccucauuggcaacgaggaauacacggacuauaugccuucuaugaaacgauuuagacgggaggaagaggaagccggcguguugugguga

SEQ ID NO: 14732 - RNA, 9876 nt, Artificial Sequence
  derived and/or modified CDS sequence (opt3) from DENV-2__EU482744__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccgaaaaggacuccccugucaacaucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaccaaguguucggcgcuauuuacggagcggcauuuaguggcguaagcuggacuaugaaaaucuugauaggggucaucauuaccuggaucggaaugaacuccagaucuacgagccugucagugagucucguucuggugggcgucgugacacuuuaucugggugccaugguacaggcugacuccgggugugugguuagcuggaagaauaaagaauugaagugcggaucuggcauuuucaucaccgauaacguccacacuuggacagagcaguacaaguuucagcccgaaucaccaaguaaacucgccagcgcaauacaaaaggcccaugaggaagguauuuguggcaucagguccgugacccggcuggagaauuuaauguggaaacagauuacucccgagcugaaccacauccuaucugaaaaugaggugaagcucaccauaaugacaggggacaucaaaggaauuaugcaggcuggcaagcgcucgcugagaccucagccaacggaacuuaaauauagcuggaagaccugggggaaggccaaaauguuguccacugagucacauaaccaaacauuccugaucgauggaccggaaaccgcagagugccccaauacaaacagggcguggaauagucucgaggucgaagacuacggcuuugguguuuucacuaccaacauuuggcugaaguuacgugagaaacaggacguguuuugugauucuaagcugaugagcgcugccaucaaagacaaucgggcagugcacgccgauaugggguauuggauagaauccgcucuuaacgacacguggaagauggagaaggccucauucauugagguaaaaagcugccacuggccuaagucucauacauugugguccaauggaguccucgaaagugagaugaucaucccaaaaaacuucgcaggccccgugagccagcacaacuaccgaccugguuaucauacccagacugcuggcccauggcaccuggggaagcuagaaauggauuuugacuucugugagggaaccacaguuguggucacugaagauugcggcaauagagggcccucucugaggaccacaacggccuccggaaaacucauuaccgaguggugcugucgcucaugcacucugccgccucuucgguacagaggcgaggacgguuguugguacgggauggaaaucaggccauugaaggagaaggaagagaaccuggugaauaguuuaguuacagcgggacauggccaaauugauaacuuuagccucggugugcugggcauggcccuuuuccuggaagagauguugcgcacccgaguagggacuaaacacgcuauacuccuggucgcagugucguuugugacacuaaucaccggaaauauguccuuccgggaccugggccgugucaugguuauggugggggccacgaugacugaugacauuggaaugggcguaaccuaucucgcucugcuugccgcauuuaaggugagacccacauucgcggccgguuugcuguuaaggaaacucaccucuaaggagcugaugauggcuacuaucgggauugcccuucugagccagucaacaaucccugaaaccauacuagagcucacagaugcacuggcuuugggaaugaugguccugaaaaucgugcgcaacauggaaaaguaccaguuagccguuaguauuauggcaaucuccugcgugcccaaugccgucauucuccaaaacgcuuggaaggugucuuguacuauccuggcggccguuagcguguccccacuucuguugaccucaagccagcagaaagcagacuggauaccucucgcucugacgauuaagggccuaaaucccacagccaucuuucugaccacucuuagucggaccucuaaaaagagauccuggccacucaacgaggccaucauggcugucggcaugguaagcauucuggcaucgucauugcugaaaaaugacauaccgaugacagggccuuuaguggccggaggucuccugacuguuugcuaugugcuuaccggcaggucugcggaucuggaauuggagcgagcugccgacgucaagugggaggaucaggcagaaaucaguggguccagccccauucucucuaucacgauuagcgaggacggauccaugucaaucaaaaacgaagaggaggaacaaacacugaccauacuaauccgcacuggccugcuugugauuagugguguauucccagugagcauccccauuacagccgcugcaugguaccucugggaggucaagaagcagcgggccgggguucugugggaugugccuucuccacccccugugggaaaagcggaauuggaggacggcgcuuauagaaucaagcagaggggcauauuaggguacucccagauuggagccggugucuauaaagaaggcaccuuucacacuauguggcaugugacacguggggcaguucugaugcaccgcggaaagcggaucgagccgucaugggccgauguaaaaaaggaccucaucaguuacggcgguggguggaagcuggagggagaauggaaagagggcgaagaggugcaaguccuugcucuggaaccaggcaagaaucccagagccgugcagaccaaaccuggguuguucaagacgaacacuggaaccauuggugcaguuagccuagauuuuuccccaggcacaucugggucgcccaucguggacaggaaaggaaaggucgugggccuguacgguaaugggguagucacccgaagcggagcuuaugugucagccauagcgcagacagagaaguccauugaggauaacccugaaaucgaggacgauauuuuccggaaaaagcgccucacuaucauggaccugcauccgggcgccggcaaaaccaagagauaccuucccgcaauaguuagggaagcuauuaaacggggguuacgaacgcugauccucgccccaacaagaguggucgcugcagagauggaagaggccuugcgcggacugccuaucagguaucagacucccgccauucgugcugagcacaccggucgggaaaucguggaccucaugugucaugcgacauucaccaugagacugcuuaguccaguuagggugccuaacuacaaucugauuauaauggaugaggcacacuuuacugaccccgccucuaucgcugcccgcggcuauauuagcacccgagucgaaaugggggaggcagccggaaucuucaugacagcuacgccaccgggcuccagagauccuuuuccccaaucaaacgcgccaaucauggacgaggaacgggagauucccgaaaggucuuggaauagcggucacgagugggugacugauuucaaggggaagaccguaugguuugugccuaguauaaaagccggaaacgacaucgcagcuugcuugcgcaagaauggcaaaaagguuauucagcuaucccguaaaacauucgauagcgaauacgucaagaccagagccaacgacugggauuuuguggugacuacagacaucucugagaugggcgcaaauuucaaggccgagcgggucauugauccaaggcgcuguaugaaacccguaauccugaccgacggggaagagcgagugauacucgcuggaccuaugccgguuacgcauucauccgccgcgcagagacgggguaggaucggccgcaacccaaagaaugaaaacgaccaauauauuuacaugggggagcccuuagaaaaugaugaggacugcgcacacuggaaagaggccaagaugcugcuugauaacaucaauacuccugaaggaauuauccccaguauguuugagccagaaagagagaaaguggacgcuauagauggcgaauacaggcugcggggugaggcccguaagacauucgucgaccucaugcgccgaggggauuugccuguguggcuggcuuauagaguugcagccgagggcauuaacuacgcugacaggcggugguguuuugauggaaucaaaaauaaccagauucucgaagagaacguggaagucgagaucuggaccaaggagggcgaacgcaagaaacugaagcccagauggcuugacgccaggauauauagcgauccacuagcacugaaagaguucaaggaauucgcggccgggcggaaaucguugaccuuaaaucugaucacugagaugggacgacucccuacauuuaugacccagaaggcuagagacgcccuggauaaccuugcagugcugcauacagcugaagccgguggccgcgcauacaaucacgcccucucugaguugccggagacucuggaaacgcuacugcuccuuacccuguuagcuacaguaacugggggaauuuucuuguuucugauguccggcaaggguaucgggaaaaugacccucggcaugugcugcauuaucacagcgagcauacugcuuugguaugcccagauucaaccccacuggaucgcagcuucaaucauucuggaguucuuucucaucguguugcugauaccagaaccugagaagcagaggaccccccaggacaaccaguuaacuuacguugucauugccauccuaacggugguggccgcaaccauggcuaaugaaaugggauuccuggagaaaacaaagaaagaccucggccuugggaguauuacuacccaagagucugaauccaacauccuggauauagacuugcggccagccagcgcguggacacuguaugcugucgccaccacuuuuguuacaccuaugcuccgucauucaaucgagaauaguagcgugaacguaucccugacggcaauugccaaucaggcuaccgugcuuaugggacucgguaagggcuggccccugucuaagauggauaucggggucccguugcuggcaauuggauguuacagccaggugaacccaaucacuuuaacagccgcgcuacugcuccuuguugcucacuacgccauuaucggcccuggucugcaggcaaaagccaccagagaagcucaaaagagggccgcagcugggauaaugaaaaaucccaccguggacggcauuacagucaucgauuuggagccaauccccuaugacccuaaguucgaaaaacagcugggacagguaaugcuccugauucuuugcgugacucagguuuuaaugaugcgcacgaccugggcccugugugaggcgcucacauuggccacuggcccgauauccacccugugggaggggaaccccggacgguuuuggaauacaaccaucgcagugucaauggcuaacauuuuccgaggcucuuaccuagccggugcagggcugcucuuuaguaucaugaagaauacuacgaacacaagaaggggaaccggcaauauuggugaaacucuuggcgagaaguggaaaucgcgccugaacgcuuuggggaagagcgaauuccaaaucuauaaaaaguccggaauacaggaggucgaucggacccuggccaaagagggcaucaagagaggggaaacagaccaucacgccgugucucguggaucagcgaaacucaggugguuugucgagcggaacauggugacuccagaaggcaagguuguggaucuggguugcgggcgcggaggcuggagcuacuauugugguggcuuaaagaauguacgagaggugaaagggcuuaccaagggaggcccugggcaugaagagcccauuccuauguccacauacggauggaaccuggucagacuccagaguggcguugacguguucuucacgccacccgagaaaugcgauacccuacugugugacaucggugaaucuagcccuaauccaacuauugaggcugggaggacauugcggguccugaaccucguggaaaauuggcuuaacaauaacacccaauuuugcaucaagguacugaaucccuauaugccgucagugauagagaaaauggaaacuuugcagcgcaaguacggaggcgcacugguuagaaacccucucuccaggaauaguacacacgagauguacugggugagcaacgccaccggcaauauugucucuuccgugaacaugaucucacgaauguuaaucaaucgguucacgaugaagcacaaaaaggcuaccuaugagccagaugucgaccuggggagcggaacacguaacauugguauagaaucggagauccccaaccuugacauuaucggcaaaagaauugaaaagaucaaacaggagcaugaaacuucuuggcacuacgaucaggaccauccuuauaagaccugggccuaccacgggaguuaugagacaaagcaaacuggauccgcaagcucaauggugaauggcguuguacgccugcuaaccaaaccaugggaugugguccccauggugacacagauggccaugaccgacacuacgccguuuggucagcagaggguuuucaaggagaaaguggauacacggacccaagaaccuaaggaggggacuaaaaagcucaugaagauaaccgcugaauggcuguggaaagaguugggaaagaaaaagacacccagaauguguacgcgcgaggaauuuaccaggaaaguccgauccaacgcggcccugggcgcaaucuucacugacgagaauaaguggaaaucugcucgggaagccguggaggauagcagauuuugggaacucauugacagggagcgcaaccuucaccuggagggcaagugcgaaacauguguauacaauaugauggggaagcgugagaaaaaguuaggagaauucgguaaagcaaagggcagucgggccaucugguauauguggcugggggcuagauuuuuggaguucgaagcccucggauuucugaacgaggaucauugguucuccaggggcaauagccuaucugguguggagggggaaggacuucaccgccugggcuacauucuccgagacguuucaaaaaaggagggcggggcgauguacgcagaugacaccgccggaugggacacucggaucacacuggaagauuugaagaacgaggaaauggucaccaaucauaugaaaggugagcacaagaaacuggcugaggccauuuuuaagcucacauaucagaacaaaguggugagaguccagaggccaacuccucgcggcaccguuauggacauaaucaguagacgggaucagaggggguccggacaagugggcacguacggucuuaauaccuucacaaacauggaagcacagcugauucgucagauggagggggaaggaaucuucaagagcauccaacauuuaacuguaaccgaggagauugcugugcagaauuggcuggcccgagucggccgcgaaagauugucucggauggcuauaucgggcgacgauugcgugguuaagccccucgacgauagguuugccucagcacugacagcgcuaaacgacauggggaaagugcgcaaggauauccagcagugggagccaagcagaggauggaaugacuggacucaaguccccuucugcucccaccacuuucaugaacuugugaugaaagauggucggguacugguugugccuuguaggaaccaggacgagcucauuggccgagcccguaucagucagggggcuggauggucucugaaggaaaccgccugcuugggcaaaagcuaugcacagauguggacguuaauguacuuccacagacgcgaucugcggcucgcugccaacgcaauuuguuccgccgucccaucacauugggugccgacaaguaggaccacuuggucuauccacgcgaagcacgaguggaugacaaccgaggacaugcuugcuguguggaauagagucuggauacaagaaaaccccuggauggaggacaagacuccuguugaaagcugggaggaagugccauaucuggguaaacgcgaggaucaguggugcgggucccuaaucggacugaccucacgggccacaugggcaaagaauauucagacggccaucaaccagguaaggagccucauuggcaaugaggaauacaccgacuauaugcccucuaugaaacgauuuagaaaggaggaagaggaagcuggcguguugugguga

SEQ ID NO: 14733 - RNA, 9876 nt, Artificial Sequence
  derived and/or modified CDS sequence (opt3) from DENV-2__EU482745__SS-prME
accgcaggagugaucauuaugcugauacccacagcuauggcauuccaccucacuacgagaaacggggaaccucauaugaucguaggaaggcaggaaaaggguaaaagccuucuguuuaagaccgaagacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccgaaaaggacuccccugucaacaucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaccaaguguucggcgcuauuuacggagcggcauuuaguggcguaagcuggacuaugaaaaucuugauaggggucaucauuaccuggaucggaaugaacuccagaucuacgagccugucagugagucucguucuggugggcgucgugacacuuuaucugggugccaugguacaggcugacuccgggugugugguuagcuggaagucuaaagaauugaagugcggaucaggcauuuucaucaccgauaauguccacacuuggacagagcaguacaaguuucagcccgaaaguccaagcaaacucgccuccgcaauacaaaaggcccaugaggaagguauuuguggcaucaggucugugacccggcuggagaacuuaauguggaaacagauuacucccgagcugaaucacauccuaucggaaaacgaggugaagcucaccauaaugacaggggacaucaaaggaauuaugcaggcuggcaagcgcagccugagaccucagccaacggaacuuaaauauuccuggaagaccugggggaaggccaaaauguugucaacugagagucauaauaggacauuccugaucgauggaccggaaaccgcagagugccccaacacaaaucgugcguggaacucucucgaggucgaagacuacggcuuugguguuuucacuaccaauauuuggcugaaguuacgggagaaacaagacguguuuugugauagcaagcugauguccgcugccaucaaagacaaccgagcagugcacgccgauaugggguauuggauagaaucagcucuuaaugacacguggaagauggagaaggccagcuucauugagguaaaaucuugccacuggccuaagucccauacauuguggaguaacggaguccucgaaagcgagaugaucauccccaaaaauuucgcaggccccgugucucagcacaacuacagaccugguuaucauacccagacugcuggcccauggcaccuggggaagcuagaaauggauuuugacuucugugagggaaccacaguuguggucacugaagauugcggcaacagggggcccucccugcgcaccacaacggccucaggaaaacucauuaccgaguggugcugucggaguugcacucugccgccucuuagauacaggggcgaggacgguuguugguacgggauggaaauccgcccauugaaggagaaggaagagaaucuggugaacagcuuaguuacagcgggacauggccagauugauaauuuuucgcucggugugcugggcauggcccuuuuccuggaagagauguugcgaacccggguagggacuaaacacgcuauacuccuggucgcaguguccuuugugacacuaaucaccggaaacaugucuuuccgugaccugggcagagucaugguuauggugggggccacgaugacugaugacauuggaaugggcguaaccuaucucgcucugcuugccgcauuuaaggugaggcccacauucgcggccgguuugcuguuacgcaaacucaccagcaaggagcugaugauggcuacuaucgggauugcccuucugucacaaaguacaaucccugaaaccauacuagagcucacagaugcacuggcuuugggaaugaugguccugaaaaucgugcggaauauggaaaaguaccaguuagccguuacuauuauggcaaucuccugcgugcccaacgccgucauucuccagaaugcuuggaaggugucuuguaccauccuggcggccguuagcguguccccacuucuguugacgucaagccaacagaaagcagacuggauaccucucgcucugacaauuaagggccuaaaccccaccgccaucuuucugacuacccuuaguagaacaucuaaaaagagguccuggccacucaaugaggccaucauggcugucggcaugguaagcauucuggcaucgucauugcugaaaaacgacauaccgaugacugggccuuuaguggccggaggucuccugaccguuugcuaugugcuuacgggccgaucugcggaucuggaauuggagcgcgcugccgacgucaagugggaggaucaggcagaaaucaguggguccagccccauucucucuaucacaauuagcgaggacggauccaugucaaucaaaaaugaagaggaggaacagacccugacuauacuaauccggacaggccugcuugugauuagugguguauucccagugagcauccccauuaccgccgcugcaugguaccucugggaggucaagaagcaaagagccgggguucugugggaugugccuucuccacccccugugggaaaagcggaauuggaggacggcgcuuauaggaucaagcagcguggcauauuaggguacucccagauuggagccggugucuauaaagaaggcacuuuucacacaauguggcaugugacccgcggggcaguucugaugcaccggggaaagagaaucgagccgucaugggccgaugucaaaaaggaccucaucaguuacggcgguggguggaagcuggagggagaauggaaagagggcgaagaggugcagguccuugcucuggaaccaggcaagaaccccagggccgugcaaacgaaaccuggguuguucaagacuaauaccggaacaauuggugcaguuagccuagauuuuuccccaggcaccucugggucgcccaucguggaccgaaaaggaaaggucgugggccuguacgguaacgggguagucacacggagcggagcuuaugugucagccauagcgcagacugagaaguccauugaggauaauccugaaaucgaggacgauauuuuccgcaaaaagagacucaccaucauggaccugcauccgggcgccggcaaaacgaagagguaccuucccgcaauaguucgggaagcuauuaaacgaggguuaagaacacugauccucgccccaacucgcguggucgcugcagagauggaagaggccuugaggggacugccuauccguuaucagacccccgccauucgggcugagcacacagguagagaaaucguggaccucaugugucaugcgaccuucacuaugaggcugcuuaguccaguucgcgugccuaacuacaaccugauuauaauggaugaggcacacuuuaccgaccccgccucuaucgcugcccgaggcuauauuagcacaagagucgaaaugggggaggcagccggaaucuucaugacggcuacuccaccgggcucccgggauccuuuuccccagucaaaugcgccaaucauggacgaggaaagggagauucccgaacgcucuuggaacagcggucacgagugggugaccgauuucaaggggaagacaguaugguuugugccuaguauaaaagccggaaaugacaucgcagcuugcuugcguaagaacggcaaaaagguuauucaacuauccagaaaaaccuucgauagcgaauacgucaagacucgggccaaugacugggauuuuguggugacaaccgacaucucugagaugggcgcaaacuucaaggccgagagggucauugauccacgccgauguaugaaacccguaauccugacggacggggaagagagagugauacucgcuggaccuaugccgguuacucauucauccgccgcgcagcggaggggucgcaucggcagaaauccaaagaacgaaaaugaccaguauauuuacaugggggagcccuuagaaaacgaugaggacugcgcacacuggaaagaggccaagaugcugcuugauaauaucaacacaccugaaggaauuauccccaguauguuugagccagaaagggagaaaguggacgcuauagauggcgaauaccggcugcguggugaggcccgcaagaccuucgucgaccucaugcgaagaggggauuugccuguguggcuggcuuauaggguugcagccgagggcauuaauuacgcugaccggcgcugguguuuugauggaaucaaaaacaaucaaauucucgaagagaacguggaagucgagaucuggaccaaggagggcgaaagaaagaaacugaagcccagguggcuugacgcccggauauauagcgauccacuagcacugaaagaguucaaggaguucgcggccgggcgaaaaucguugacuuuaaaccugaucacagagaugggaagacucccuaccuuuaugacacagaaggcucgcgacgcccuggauaaucuugcagugcugcauacugcugaagccgguggcagggcauacaaccacgcccucucugaguugccggagacgcuggaaacccuacugcuccuuacacuguuagcuacuguaaccgggggaauuuucuuguuucugauguccggcaaggguaucgggaaaaugacacucggcaugugcugcauuaucaccgcgagcauacugcuuugguaugcccagauucagccccacuggaucgcagcuucaaucauucuggaguucuuucucaucguguugcugauaccagaaccugagaagcaacggacuccccaggacaaucaguuaacguacguugucauugccauccuaaccgugguggccgcaacaauggcuaacgaaaugggauuccuggagaaaacuaagaaagaccucggccuugggaguauuaccacaaaggagucugaauccaauauccuggauauagacuugcguccagccagcgcguggacccuguaugcugucgccacuacauuuguuacgccuaugcucagacauucaaucgagaacaguagcgugaauguaucccugaccgcaauugccaaccaggcuacugugcuuaugggacucgguaagggcuggccccugucuaaaauggauaucggggucccguugcuggcaauuggauguuacagccaagugaauccaaucacauuaaccgccgcgcuacugcuccuuguugcucacuacgccauuaucggcccuggucugcaggcaaaggccaccagggaagcucagaaacgcgccgcagcugggauaaugaagaaccccacaguggacggcauuacugucaucgauuuggagccaauccccuaugacccuaaauucgaaaagcagcugggacaaguaaugcuccugauucuuugcgugacgcagguuuuaaugaugcggaccacaugggcccugugugaggcgcucacuuuggccaccggcccgauauccacacugugggaggggaaucccggacgauuuuggaacaccacuaucgcagugucaauggcuaauauuuucagaggcucuuaccuagccggugcagggcugcucuuuaguaucaugaagaacacgacaaauaccaggcgcggaacuggcaacauuggugaaacccuuggcgagaaauggaagucgcggcugaaugcuuuggggaaaagcgaguuccagaucuauaagaaauccggaauacaggaggucgauagaacacuggccaaggagggcaucaaacguggggaaacugaccaucacgccgugucuaggggaucagcgaagcuccggugguuugucgagcgcaacauggugaccccagaaggcaagguuguggaucuggguugcgggcgaggaggcuggagcuacuauugugguggccuuaaaaacguaagagaggugaaggggcuaacaaaaggaggcccugggcaugaagaaccaauuccuauguccacguacggauggaaucuggucaggcuccaaaguggcguugacguguucuucaccccacccgagaagugcgauacucuacugugugacaucggugaaucuagcccuaacccaacaauugaggcugggcggaccuugcgcguccugaaucucguggaaaacuggcuuaauaacaauacucaguuuugcaucaaaguacugaaccccuauaugccgucagugauagagaagauggaaacauugcagagaaaguacggaggcgcacugguuaggaauccucucucccgaaacaguacccacgagauguacugggugagcaaugccacgggcaacauugucucuuccgugaauaugaucucacggauguuaaucaaccguuucaccaugaaacacaagaaagcuacauaugagccagaugucgaccuggggagcggaacuagaaauauugguauagaaucggagauccccaaccuugacauuaucggcaagcgcauugagaaaaucaagcaagagcaugaaaccucuuggcacuacgaucaggaccauccuuauaagacaugggccuaccacgggaguuaugagacuaaacagaccggauccgcaagcucaauggugaacggcguuguaaggcugcuaacaaagccaugggaugugguccccauggugacccagauggccaugacugacacgacaccguuuggucaacagcggguuuucaaagagaagguggauaccagaacucaggaaccuaaagaggggaccaagaagcucaugaaaauaacagcugaauggcuguggaaggaguugggcaaaaagaaaacgccccgcauguguaccagggaggaauuuacucgaaagguccgguccaaugcggcccugggcgcaaucuucacagacgagaacaaauggaagucugcuagagaagccguggaggauagcagguuuugggaacucauugaccgcgagcguaaucuucaccuggagggcaagugcgaaaccuguguauacaacaugauggggaaacgggagaagaaauuaggagaguucgguaaggcaaaaggcaguagagccaucugguauauguggcugggggcuagguuuuuggaguucgaagcccucggauuucugaaugaggaucauugguucucccgcggcaacagccuaucugguguggagggggaaggacuucaccgacugggcuacauucuccgggacguuucaaagaaggagggcggggcgauguacgcagaugacacugccggaugggacacaagaaucacccuggaagauuugaaaaaugaggaaauggucacaaaccauaugaagggugagcacaaaaagcuggcugaggccauuuuuaaacucacuuaucagaauaagguggugaggguccaacgcccaaccccuagaggcacgguuauggacauaaucagucggagggaucagcguggguccggacaggugggcaccuacggucuuaacacauucacuaauauggaagcacagcugauucgacaaauggagggggaaggaaucuucaagagcauccagcauuuaaccguaacagaggagauugcugugcagaacuggcuggcccgcgucggcagagaacgguugucuaggauggcuauaucgggcgacgauugcgugguuaaaccccucgacgaucgcuuugccucagcacugacugcgcuaaaugacauggggaaggugagaaaagauauccaacagugggagccaagccggggauggaacgacuggacccagguccccuucugcucccaccacuuucaugaacuugugaugaaggaugguaggguacugguugugccuugucgaaaucaggacgagcucauuggccgugccagaaucagucaaggggcuggauggucucugaaagaaacggccugcuugggcaagagcuaugcacagauguggacauuaauguacuuccaccgccgggaucugaggcucgcugccaacgcaauuuguuccgccgucccaucacauugggugccgaccaguagaacuacauggucuauccacgcgaagcacgaguggaugaccacugaggacaugcuugcuguguggaaccgcgucuggauacaggaaaaucccuggauggaggacaaaaccccuguugaaagcugggaggaagugccauaucuggguaagcgggaggaucaguggugcgggucccuaaucggacugacaucaagggccacgugggccaaaaacauucaaaccgccaucaaucagguaaagagccucauuggcaacgaggaauacacugacuauaugcccucuaugaaacgauuuagacgggaggaagaggaagcuggcguguugugguga

SEQ ID NO: 14734 - RNA, 9876 nt, Artificial Sequence
  derived and/or modified CDS sequence (opt3) from DENV-2__EU482746__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccgaaaaggacuccccugucaacaucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaccaaguguucggcgcuauuuacggagcggcauuuaguggcguaagcuggacuaugaaaaucuugauaggggucaucauuaccuggaucggaaugaacuccagaucuacgagccugucagugagucucguucuggugggcgucgugacacuuuaucugggugccaugguacaggcugacuccgggugugugguuagcuggaagucuaaagaauugaagugcggaucaggcauuuucaucaccgauaauguccacacuuggacagagcaguacaaguuucagcccgaaaguccaagcaaacucgccuccgcaauacaaaaggcccaugaggaagguauuuguggcaucaggucugugacccggcuggagaacuuaauguggaaacagauuacucccgagcugaaucacauccuaucggaaaacgaggugaagcucaccauaaugacaggggacaucaaaggaauuaugcaggcuggcaagcgcagccugagaccucagccaacggaacuuaaauauuccuggaagaccugggggaaggccaaaauguugucaacugagagucauaauaggacauuccugaucgauggaccggaaaccgcagagugccccaacacaaaucgugcguggaacucucucgaggucgaagacuacggcuuugguguuuucacuaccaauauuuggcugaaguuacgggagaaacaagacguguuuugugauagcaagcugauguccgcugccaucaaagacaaccgagcagugcacgccgauaugggguauuggauagaaucagcucuuaaugacacguggaagauggagaaggccagcuucauugagguaaaaucuugccacuggccuaagucccauacauuguggaguaacggaguccucgaaagcgagaugaucaucccaaaaaauuucgcaggccccgugucucagcacaacuacagaccugguuaucauacccagacugcuggcccauggcaccuggggaagcuagaaauggauuuugacuucugugagggaaccacaguuguggucacugaagauugcggcaacagggggcccucccugcgcaccacaacggccucaggaaaacucauuaccgaguggugcugucggaguugcacucugccgccucuuagauacaggggcgaggacgguuguugguacgggauggaaauccgcccauugaaggagaaggaagagaaucuggugaacagcuuaguuacagcgggacauggccagauugauaauuuuucgcucggugugcugggcauggcccuuuuccuggaagagauguugcgaacccggguagggacuaaacacgcuauacuccuggucgcaguguccuuugugacacuaaucaccggaaacaugucuuuccgugaccugggcagagucaugguuauggugggggccacgaugacugaugacauuggaaugggcguaaccuaucucgcucugcuugccgcauuuaaggugaggcccacauucgcggccgguuugcuguuacgcaaacucaccagcaaggagcugaugauggcuacuaucgggauugcccuucugucacaaaguacaaucccugaaaccauacuagagcucacagaugcacuggcuuugggaaugaugguccugaaaaucgugcggaauauggaaaaguaccaguuagccguuacuauuauggcaaucuccugcgugcccaacgccgucauucuccagaaugcuuggaaggugucuuguaccauccuggcggccguuagcguguccccacuucuguugacgucaagccaacagaaagcagacuggauaccucucgcucugacaauuaagggccuaaaccccaccgccaucuuucugacuacccuuaguagaacaucuaaaaagagguccuggccacucaaugaggccaucauggcugucggcaugguaagcauucuggcaucgucauugcugaaaaacgacauaccgaugacugggccuuuaguggccggaggucuccugaccguuugcuaugugcuuacgggccgaucugcggaucuggaauuggagcgcgcugccgacgucaagugggaggaucaggcagaaaucaguggguccagccccauucucucuaucacaauuagcgaggacggauccaugucaaucaaaaaugaagaggaggaacagacccugacuauacuaauccggacaggccugcuugugauuagugguguauucccagugagcauccccauuaccgccgcugcaugguaccucugggaggucaagaagcaaagagccgggguucugugggaugugccuucuccacccccugugggaaaagcggaauuggaggacggcgcuuauaggaucaagcagcguggcauauuaggguacucccagauuggagccggugucuauaaagaaggcacuuuucacacaauguggcaugugacccgcggggcaguucugaugcaccggggaaagagaaucgagccgucaugggccgauguaaaaaaggaccucaucaguuacggcgguggguggaagcuggagggagaauggaaagagggcgaagaggugcagguccuugcucuggaaccaggcaagaaccccagggccgugcaaacgaaaccuggguuguucaagacuaauaccggaacaauuggugcaguuagccuagauuuuuccccaggcaccucugggucgcccaucguggaccgaaaaggaaaggucgugggccuguacgguaacgggguagucacacggagcggagcuuaugugucagccauagcgcagacugagaaguccauugaggauaauccugaaaucgaggacgauauuuuccgcaaaaagagacucaccaucauggaccugcauccgggcgccggcaaaacgaagagguaccuucccgcaauaguucgggaagcuauuaaacgaggguuaagaacacugauccucgccccaacucgcguggucgcugcagagauggaagaggccuugaggggacugccuauccguuaucagacccccgccauucgggcugagcacacagguagagaaaucguggaccucaugugucaugcgaccuucacuaugaggcugcuuaguccaguucgcgugccuaacuacaaccugauuauaauggaugaggcacacuuuaccgaccccgccucuaucgcugcccgaggcuauauuagcacaagagucgaaaugggggaggcagccggaaucuucaugacggcuacuccaccgggcucccgggauccuuuuccccagucaaaugcgccaaucauggacgaggaaagggagauucccgaacgcucuuggaacagcggucacgagugggugaccgauuucaaggggaagacaguaugguuugugccuaguauaaaagccggaaaugacaucgcagcuugcuugcguaagaacggcaaaaagguuauucaacuauccagaaaaaccuucgauagcgaauacgucaagacucgggccaaugacugggauuuuguggugacaaccgacaucucugagaugggcgcaaacuucaaggccgagagggucauugauccacgccgauguaugaaacccguaauccugacggacggggaagagagagugauacucgcuggaccuaugccgguuacucauucauccgccgcgcagcggaggggucgcaucggcagaaauccaaagaacgaaaaugaccaguauauuuacaugggggagcccuuagaaaacgaugaggacugcgcacacuggaaagaggccaagaugcugcuugauaauaucaacacaccugaaggaauuauccccaguauguuugagccagaaagggagaaaguggacgcuauagauggcgaauaccggcugcguggugaggcccgcaagaccuucgucgaccucaugcgaagaggggauuugccuguguggcuggcuuauaggguugcagccgagggcauuaauuacgcugaccggcgcugguguuuugauggaaucaaaaacaaucaaauucucgaagagaacguggaagucgagaucuggaccaaggagggcgaaagaaagaaacugaagcccagguggcuugacgcccggauauauagcgauccacuagcacugaaagaguucaaggaauucgcggccgggcgaaaaucguugacuuuaaaccugaucacagagaugggaagacucccuaccuuuaugacacagaaggcucgcgacgcccuggauaaucuugcagugcugcauacugcugaagccgguggcagggcauacaaccacgcccucucugaguugccggagacgcuggaaacccuacugcuccuuacacuguuagcuacuguaaccgggggaauuuucuuguuucugauguccggcaaggguaucgggaaaaugacacucggcaugugcugcauuaucaccgcgagcauacugcuuugguaugcccagauucagccccacuggaucgcagcuucaaucauucuggaguucuuucucaucguguugcugauaccagaaccugagaagcaacggacuccccaggacaaucaguuaacguacguugucauugccauccuaaccgugguggccgcaacaauggcuaacgaaaugggauuccuggagaaaacuaagaaagaccucggccuugggaguauuaccacacaggagucugaauccaauauccuggauauagacuugcguccagccagcgcguggacccuguaugcugucgccacuacauuuguuacgccuaugcucagacauucaaucgagaacaguagcgugaauguaucccugaccgcaauugccaaccaagcuacugugcuuaugggacucgguaagggcuggccccugucuaagauggauaucggggucccguugcuggcaauuggauguuacagccaggugaauccaaucacauuaaccgccgcgcuacugcuccuuguugcucacuacgccauuaucggcccuggucugcaggcaaaagccaccagggaagcucagaagcgcgccgcagcugggauaaugaaaaaccccacaguggacggcauuacugucaucgauuuggagccaauccccuaugacccuaaguucgaaaaacaacugggacagguaaugcuccugauucuuugcgugacgcagguuuuaaugaugcggaccacaugggcccugugugaggcgcucacuuuggccaccggcccgauauccacacugugggaggggaaucccggacgauuuuggaacaccacuaucgcagugucaauggcuaauauuuucagaggcucuuaccuagccggugcagggcugcucuuuaguaucaugaagaacacgacaaauaccaggcgcggaacuggcaacauuggugaaacccuuggcgagaaguggaaaucgcggcugaaugcuuuggggaagagcgaauuccagaucuauaaaaaguccggaauacaagaggucgauagaacacuggccaaagagggcaucaagcguggggaaacugaccaucacgccgugucuaggggaucagcgaaacuccggugguuugucgagcgcaacauggugaccccagaaggcaagguuguggaucuggguugcgggcgaggaggcuggagcuacuauugugguggcuuaaagaacguaagagaggugaaagggcuuacaaagggaggcccugggcaugaagagcccauuccuauguccacguacggauggaaucuggucaggcuccagaguggcguugacguguucuucaccccacccgagaaaugcgauacucuacugugugacaucggugaaucuagcccuaacccaacaauugaggcugggcggaccuugcgcguccugaaucucguggaaaacuggcuuaauaacaauacucaguuuugcaucaagguacugaaccccuauaugccgucagugauagagaaaauggaaacauugcaaagaaaguacggaggcgcacugguuaggaauccucucucccgaaacaguacccacgagauguacugggugagcaaugccacgggcaacauugucucuuccgugaauaugaucucacggauguuaaucaaccguuucaccaugaagcacaaaaaggcuacauaugagccagaugucgaccuggggagcggaacuagaaauauugguauagaaucggagauccccaaccuugacauuaucggcaaacgcauugaaaagaucaaacaggagcaugaaaccucuuggcacuacgaucaggaccauccuuauaagacaugggccuaccacgggaguuaugagacuaagcagaccggauccgcaagcucaauggugaacggcguuguaaggcugcuaacaaaaccaugggaugugguccccauggugacccaaauggccaugacugacacgacaccguuuggucagcagcggguuuucaaggagaaaguggauaccagaacucaggaaccuaaggaggggaccaaaaagcucaugaagauaacagcugaauggcuguggaaagaguugggaaagaaaaagacgccccgcauguguaccagggaggaauuuacucgaaaaguccgguccaaugcggcccugggcgcaaucuucacagacgagaacaaguggaaaucugcuagagaagccguggaggauagcagguuuugggaacucauugaccgcgagcguaaucuucaccuggagggcaagugcgaaaccuguguauacaacaugauggggaagcgggagaaaaaguuaggagaauucgguaaagcaaagggcaguagagccaucugguauauguggcugggggcuagguuuuuggaguucgaagcccucggauuucugaaugaggaucauugguucucccgcggcaacagccuaucugguguggagggggaaggacuucaccgacugggcuacauucuccgggacguuucaaaaaaggagggcggggcgauguacgcagaugacacugccggaugggacacaagaaucacccuggaagauuugaagaaugaggaaauggucacaaaccauaugaaaggugagcacaagaaacuggcugaggccauuuuuaagcucacuuaucaaaauaaaguggugaggguccagcgcccaaccccuagaggcacgguuauggacauaaucagucggagggaucagcguggguccggacaggugggcaccuacggucuuaacacauucacuaauauggaagcacaacugauucgacagauggagggggaaggaaucuucaagagcauccagcauuuaaccguaacagaggagauugcugugcaaaacuggcuggcccgcgucggcagagaacgguugucuaggauggcuauaucgggcgacgauugcgugguuaagccccucgacgaucgcuuugccucagcacugacugcgcuaaaugacauggggaaagugagaaaggauauccagcagugggagccaagccggggauggaacgacuggacccagguccccuucugcucccaccacuuucaugaacuugugaugaaagaugguaggguacugguugugccuugucgaaaucaagacgagcucauuggccgugccagaaucagucagggggcuggauggucucugaaggaaacggccugcuugggcaaaagcuaugcacagauguggacauuaauguacuuccaccgccgggaucugaggcucgcugccaacgcaauuuguuccgccgucccaucacauugggugccgaccaguagaacuacauggucuauccacgcgaagcacgaguggaugaccacugaggacaugcuugcuguguggaaccgcgucuggauacaggaaaaucccuggauggaggacaagaccccuguugaaagcugggaggaagugccauaucuggguaaacgggaggaucaauggugcgggucccuaaucggacugacaucaagggccacgugggcaaagaacauucagaccgccaucaaucagguacgaagccucauuggcaacgaggaauacacugacuauaugcccucuaugaaaagauuucggagggaggaagaggaagcuggcguguugugguga

SEQ ID NO: 14735 - RNA, 9876 nt, Artificial Sequence
  derived and/or modified CDS sequence (opt3) from DENV-2__EU482590__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccgaaaaggacuccccugucaacaucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccguucucggggacaccgcaugggauuucggaucccugggcgguguguuuacaucaauugggaaggcccuucaccaaguauucggcgcuaucuacggagcggcauuuaguggcgucagcuggacuaugaaaauuuugaucggggugauaaucaccuggauuggaaugaacuccagaucuacgagccugucaguuagucucgugcuggucggcgugguaacacuuuaucugggugccauggugcaggcugacuccggguguguugucagcuggaagaauaaagaauugaagugcggaucuggcaucuucauuaccgauaacgugcacacuuggacagagcaguacaaguuucagcccgaaucaccaaguaaacucgccagcgcaauccaaaaggcccaugaggaagguauauguggcauuagguccgugacccggcuggagaauuuaauguggaaacagaucacucccgagcugaaccacauucuaucugaaaaugaggucaagcucaccaucaugacaggggacauaaaaggaaucaugcaggcuggcaagcgcucgcugagaccucagccaacggaacuuaaauauagcuggaagaccugggggaaggccaaaauguuguccacugagccgcauaaccaaacauuccugauugauggacccgaaaccgcagagugcccuaauacaaacagggcguggaauucacucgagguugaagacuacggcuuugguguguucacuaccaacaucuggcugaaguuacgugagaaacaggacguguuuugugauaguaagcugaugucugcugccauuaaagacaaucgggcaguacacgccgauaugggguauuggaucgaaagcgcucuuaacgacacguggaagauggagaaggccuccuucauagaggucaaaucaugccacuggccaaagagccauacauuguggucuaauggagugcucgaauccgagaugauuauccccaaaaacuucgcaggcccuguuagucagcacaacuaccgaccagguuaucauacccagacugcuggccccuggcaccuggggaagcuagaaauggauuuugacuucugugagggaaccacaguggucgugacugaagauugcggcaauagagggccgagccugaggaccacaacggccucuggaaaacucaucaccgaguggugcugucgcuccugcacucugccuccacuucgguacagaggcgaggacgguuguugguacgggauggaaauuaggcccuugaaggagaaggaagagaaccugguuaauucauuagugacagcgggacauggccaaaucgauaacuuuagucucgguguacugggcauggcccuuuuccuggaagagauguugcgcacccgagucgggacuaaacacgcuauucuccugguggcagugagcuuugucacacuaauaaccggaaauaugucguuccgggaccugggccguguuauggugaugguaggggccacgaugacugaugacaucggaaugggcgugaccuaucucgcucugcuugccgcauuuaaggucagaccuacauucgcggccgguuugcuguuaaggaaacucaccuccaaggagcugaugauggcuacuauugggaucgcccuucugucucagagcacaauucccgaaaccauccuagagcucacagaugcacuggcuuugggaaugauggugcugaaaauaguucgcaacauggaaaaguaccaguuagccgugacuaucauggcaauuucaugcgucccaaaugccgugauccuccaaaacgcuuggaagguuaguuguaccauucuggcggccguguccgucucuccucuucuguugacgagcucccagcagaaagcagacuggaucccccucgcucugacaauaaagggccuaaauccaaccgccauuuuucugacuacccuuucacggacaagcaaaaagagaaguuggccgcucaacgaggccaucauggcuguaggcauggugucuauccuggcauccagcuugcugaaaaaugacauuccuaugacugggcccuuaguugccggaggucuccugaccgugugcuauguccuuacgggcaggucggcggaucuggaauuggagcgagcugccgacgugaagugggaggaucaggcagaaauaucagggucuaguccaauccucuccauuacaaucagcgaggacggaucuaugagcauuaaaaacgaagaggaggaacaaacccugacuauccuaauacgcacaggccugcuuguaaucuccgguguguuccccgucucaauuccuaucaccgccgcugcaugguaccucugggagguuaagaagcagcgggccggggugcugugggaugugccaagucccccuccggucggaaaagcggaauuggaggacggcgcuuauagaauuaagcagaggggcaucuuaggguacagccagauaggagccgguguguauaaagaaggcacuuuucacacaauguggcauguuacccguggggcaguacugaugcaccgcggaaagcggauugagccaucuugggccgaugugaaaaaggaccucaucuccuacggcgguggguggaagcuggagggagaauggaaagagggcgaagagguccaagugcuugcucuggaacccggcaagaauccuagagccguucagacgaaaccaggguuguucaagacuaacaccggaacaaucggugcagugucacuagauuuuagucccggcaccagcggguccccuauugucgacaggaaaggaaaggugguaggccuguacgguaauggggucgugacacgaucuggagcuuauguuucggccaucgcgcagacugagaagagcauagaggauaacccggaaauugaggacgauaucuuccggaaaaagcgccucaccauuauggaccugcaucccggcgccggcaaaacgaagagauaccuuccagcaaucgugagggaagcuauaaaacggggguuacgaacacugauucucgccccuacuagagucguggcugcagagauggaagaggccuugcgcggacugcccaucagguaucagaccccagccauccgugcugagcacacaggucgggaaauuguugaccucaugugucaugcgaccuucacuaugagacugcuuucaccugugaggguccccaacuacaaucugaucauuauggaugaggcacacuuuaccgacccagccuccauagcugcccgcggcuauaucaguacacgaguggaaaugggggaggcagccggaauuuucaugacggcuacuccgccuggcucuagagaucccuuuccacaaagcaacgcgcccaucuuggacgaggaacgggagaucccugaaagguccuggaauucaggucacgaguggguaaccgauuucaaggggaagacagugugguuuguuccaucuauuaaagccggaaacgacauagcagcuugccuacgcaagaauggcaaaaaggucauccagcugagccguaaaaccuucgauagugaauacgugaagacuagagccaacgacugggauuuuguggucacaaccgacauuuccgagaugggcgcaaauuucaaggccgagcggguaaucgaucccaggcgcuguaugaaaccugugauucucacggacggggaagagcgaguuaucuuagcuggaccgaugccagugacucauagcucugccgcgcagagacgggguaggauaggccgcaaccccaagaaugaaaacgaccaauauaucuacaugggggagccucuggaaaaugaugaggacugcgcacacuggaaagaggccaagaugcuucuggauaacauuaauacacccgaaggaaucauuccaucaauguuugagccugaaagagagaaagucgacgcuaucgauggcgaauacaggcuccggggugaggcccguaagaccuucguggacuugaugcgccgaggggaucugcccguuuggcucgcuuauagaguggcagccgagggcauaaacuacgcugacaggcggugguguuuugauggaauuaaaaauaaccagauccuggaagagaacgucgaaguggagauuuggaccaaggagggcgaacgcaagaaacuuaagccaagauggcuagacgccaggaucuauuccgauccucuggcauugaaagaguucaaggaauucgcggccgggcggaaaaguuuaacucugaaucucauaacagagaugggacgacugccgaccuuuaugacacagaaggcuagagacgcccuugauaaccuggcaguacuccauacugcugaaguggguggccgcgccuacaaucacgcauugagcgagcugcccgagacgcuagaaacccugcuccuucugacauuauuggccacuguuaccgggggaaucuuccuguuucucaugucgggcaaggguauugggaaaaugacacugggcaugugcugcaucauuaccgcuucuauccuucugugguaugcgcagauacaaccacacuggauugccgcauccaucauccucgaguucuuuuugauuguccuguuaaucccugaacccgagaagcagaggacuccacaggacaaccagcuaacguacguggugauagcuauucugaccgucguugccgccacaauggcaaaugaaaugggauuccucgagaaaacuaagaaagaccuuggccuggggagcaucaccacacaagagucagaaaguaacauuuuggauaucgaccugcggccugcuucugccuggacccucuaugcgguggcuacuacauuuguaacgcccaugcugcgucauuccauagagaauagcucagugaacaucagucuuaccgccauugcaaaucaggccacuguccucaugggacuggguaagggcuggccguugagcaagauggauaucggggugccacuguuagcuauuggauguuacucccagguuaacccuaucacacuaaccgcagcccugcuccuucugguggcgcacuacgcuauuaucggccccgguuugcaggccaaagcaaccagagaagcccaaaagagggcugccgcagggauaaugaaaaauccaacagucgacggcauuacuguaaucgaucuggagcccaucccuuaugacccgaaguucgaaaaacagcucggacaggugaugcugcuuauuuuaugcguuacgcaggugcugaugaugcgcaccacaugggcucucugugaggccuugacucuggcgaccggccccauaucuacacuaugggaggggaacccaggacgguuuuggaauaccacuaucgccgucagcauggcaaacauuuuccgaggcuccuaccuggcuggugccgggcuccuuuuuucaaucaugaagaauacgacaaacaccagaaggggaacuggcaauauuggugaaacccugggcgagaaguggaaaucucgcuugaacgcacuggggaagagugaauuccaaaucuauaaaaagucgggaauacaggagguggaucggacacucgcuaaagagggcaucaagagaggggaaacugaccaucacgccgucagccguggauccgccaaacugaggugguuuguggagcggaacaugguuaccccugaaggcaaggugguagauuuagguugcgggcgcggaggcuggucuuacuauugugguggccuuaagaaugugcgagaggucaaagggcugacaaagggaggccccgggcaugaagagccuauuccaaugucaacguacggauggaaccucguuagacuacagagcggcguggacgucuucuucacccccccugagaaaugcgauacucuguugugugacaucggugaauccaguccaaaucccacaauugaggcggggaggacccugcgggugcucaaccuuguagaaaauuggcugaacaauaacacucaauuuugcaucaagguguugaauccguauaugccuucuguuauagagaaaauggaaacacugcagcgcaaguacggaggcgcucucgugagaaacccauuaagcaggaauucaacccacgagauguacugggucuccaacgcaacgggcaauauugugaguagcgucaacaugaucucucgaaugcugaucaaucgguucaccaugaagcacaaaaaggccacauaugagcccgauguggaccuuggguccggaacucguaacauugguauagaaucagagaucccuaaccuggacauuaucggcaaaagaauugaaaagaucaaacaggagcaugaaaccagcuggcacuacgaucaggaccauccauauaagacaugggcuuaccacgggucguaugagacuaagcaaaccggaucugccaguuccaugguuaauggcguagugcgccuacucacaaaacccugggaugucgugccgaugguuacccagauggcaaugacugacacgacaccuuuuggucagcagaggguguucaaggagaaagucgauacccggacucaagaacccaaggaggggaccaaaaagcugaugaagauaacagccgaaugguuguggaaagagcugggaaagaaaaagacgccaagaauguguacccgcgaggaauuuacuaggaaagugcgaagcaacgcugcgcucggcgccaucuucacagacgagaauaaguggaaaucagcacgggaagcuguagaggauuccagauuuugggaacuuauugacagggagcgcaaccugcacuuagagggcaagugcgaaaccuguguguacaauaugauggggaagcgugagaaaaagcugggagaauucgguaaagccaagggcucucgggcaaucugguauaugugguugggggccagauuucucgaguucgaagcucugggauuucuaaacgaggaucauugguucagcaggggcaauagucuuuccgguguugagggggaaggacugcaccgccucggcuacauucugcgagacgucagcaaaaaggagggcggggccauguacgcggaugacacugcaggaugggacacacggaucaccuuggaagaucugaagaacgaggaaauggugacaaaucauaugaaaggugagcacaagaaacucgccgaggcuauuuuuaagcuuacuuaucagaacaaaguggucagaguucagaggccuaccccccgcggcacggugauggacauaaucucuagacgggaucagagggggucaggacaaguaggcaccuacggucugaauacauucacuaacauggaagcccaguuaauucgucagauggagggggaaggaaucuucaagaguauccaacaucugaccgugacagaggagauugcaguccagaauugguuggcucgagugggccgcgaaagacucucccggauggccauaagcggcgacgauugcguugugaagccacuggacgauagguuugcuucugcccuaacugcacuuaacgacauggggaaaguccgcaaggauauccagcagugggagcccucgagaggauggaaugacuggacccaagugccuuucugcucacaccacuuucaugaacugguaaugaaagauggucggguucucguggucccauguaggaaccaggacgagcugauuggccgagcgcguaucagccagggggccggaugguccuugaaggaaacggcuugcuuaggcaaaaguuaugcccagauguggacacugauguacuuccacagacgcgaucuccggcuugcagcuaacgccauuuguucugcagugccgagccauugggugcccaccuccaggacuacauggucaauccacgccaagcacgaguggaugaccacugaggacaugcuggcggucuggaauagaguuuggauacaagaaaacccuuggauggaggacaagaccccaguggaaaguugggaggaaguacccuaucuagguaaacgcgaggaucaguggugcgggucucugaucggacucacaagccgggcuacgugggccaagaauauucagaccgcaaucaaccaggugagguccuugauuggcaaugaggaauacacugacuauaugccuucaaugaaacgauuuagacgggaggaagaggaagccggcguccugugguga

SEQ ID NO: 14736 - RNA, 9876 nt, Artificial Sequence
  derived and/or modified CDS sequence (opt3) from DENV-2__EU482594__SS-prME
accgccggcgugaucauuaugcugauacccaccgcuauggcauuccaccucacuacgcggaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaagacaaacgauuugugugcaagcauucuauggucgauagaggcugggguaacggguguggauuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauuguggccgaaaaggacuccccugucaacaucgaggcugaacccccauuuggagauagcuacaucauuauaggcguggagccugggcagcugaaacuaaauugguucaagaagggaucgucuaucggucagauguuugagaccacaaugcgaggcgccaaacgcauggcaauucucggggacacugccugggauuucggaucccugggcgguguuuuuaccucaaucgggaaggcacuucaccaaguguucggcgcgauuuacggagcagccuuuaguggcguaagcuggacaaugaaaaucuugauaggggucaucauuacuuggaucggaaugaacuccagaucuaccagccugucagugagucucguucuggugggcgucgugacgcuuuaucugggugcuaugguacaggccgacuccgggugugugguuagcuggaagucuaaagaauugaagugcggaucaggcauuuucaucacagauaauguccacaccuggacugagcaguacaaguuucagcccgaaaguccaagcaaacucgcauccgccauacaaaaggcucaugaggaagguauuuguggcaucaggucugugacacggcuggagaacuuaauguggaaacagauuacccccgagcugaaucacauccuaucggaaaacgaggugaagcucacuauaaugaccggggacaucaaaggaauuaugcaggccggcaagcgcagccugagaccucagccaacagaacuuaaauauuccuggaagacgugggggaaggcaaaaauguugucaaccgagagucauaaucaaacuuuccugaucgauggaccggaaacagcggagugccccaacaccaauagggcuuggaacucucucgaggucgaagacuacggcuuugguguuuucacaacuaauauuuggcugaaguuacgugagaaacaggacguguuuugugauagcaagcugauguccgccgcaaucaaagacaaccgggccgugcacgcugauaugggguauuggauagaaucagcccuuaaugacaccuggaagauggagaaggccagcuucauugagguaaaaucuugccacuggccuaagucccauacguuguggaguaacggaguccucgaaagcgagaugaucauccccaaaaauuucgcuggccccgugucucagcacaacuaccgaccugguuaucauacacagaccgccggcccauggcaccuggggaagcuagaaauggauuuugacuucugugagggaacuaccguuguggucacagaagauugcggcaacagagggcccucccugaggacuaccacagcgucaggaaaacucauuacggaguggugcugucgcaguugcacccugccgccucuucgguacagaggcgaggacgguuguugguacgggauggaaaucaggccauugaaggagaaggaagagaaucuggugaacagcuuaguuacugccggacauggccaaauugauaauuuuucgcucggugugcugggcauggcucuuuuccuggaagagauguugcgcacacgaguagggaccaaacacgcaauacuccuggucgccguguccuuugugacucuaaucacaggaaacaugucuuuccgggaccugggccgugucaugguuauggugggggcuaccaugacggaugacauuggaaugggcaucacuuaucucgcccugcuugcagcguuuaagguaagacccaccuucgccgcugguuugcugcucaaaaagcuaacaagcaaagagcugaugauggccaccauugggaucgcacuucugucacagaguacuauaccugaaacaauccuagagcucaccgaugcucuggccuugggaaugauggugcugaagauugucaggaauauggaaaaguaccaguuagcagugacaaucauggccauuuccugcguucccaacgcugugauccuccaaaaugcguggaaagucucuuguacuauacuggccgcagugagcguuuccccacuucuguugaccucaagccagcagaaggcugacuggauuccucucgcccugacgaucaaaggccuaaaccccacagccaucuuucugaccacucuuagucgcaccucuaagaaacgguccuggccacucaaugaggcuauuauggcagugggcauggucagcauacuggccucgucauugcugaagaacgacaucccgaugacagggccuuuaguagcgggaggucuccugacugugugcuauguucuuaccggcagaucugcugaucuggaauuggagagggccgcagacgugaaaugggaggaucaggccgaaauuaguggguccagccccauccucucuauuacgaucagcgaggacggauccaugucaauaaagaaugaagaggaggaacaaacacugaccauccuaauucgaacuggccugcuugucaucagugguguguucccaguaagcauucccaucacagcugcagccugguaccucugggaggugaagaaacagcgcgcggggguccugugggauguuccuucuccacccccugugggaaaggcugaauuggaggacggcgccuaucggauaaaacagagaggcauuuuaggguacucccagaucggagcugguguguauaaggaaggcaccuuucacacuauguggcaugucacaagaggggcagugcugaugcaccguggaaaacgcaucgagccgucaugggcugauguuaagaaggaccucauuaguuacggcgguggguggaaacuggagggagaauggaaggagggcgaagagguacaagugcuugcccuggaaccaggcaaaaacccccgggcaguccagaccaagccuggguuguucaaaacgaauacuggaaccaucggugcugugagccuagauuuuuccccaggcacaucugggucgcccauaguugacagaaagggaaagguggucggccuguacgguaacggggugguaaccaggagcggagccuaugucucagcgauugcccagacagagaaauccaucgaggauaauccugaaauugaggacgauaucuuccgaaagaaacggcucacuauaauggaccugcauccgggcgcaggcaagaccaaacgcuaccuucccgcuauugugagagaagccaucaagaggggguuacggacgcugauccucgcuccaacacgaguuguggcagccgagauggaagaggccuugagaggacugccuauucgcuaucagacucccgcuaucagggcggagcacaccggucgugaaauugucgaccucaugugucaugcaacauucaccaugcggcugcuuaguccagugagaguuccuaacuacaaccugauaaucauggaugaggcccacuuuacugaccccgcuucuauugccgcaaggggcuauaucagcacccgcguggaaaugggggaggccgcuggaaucuucaugacagcgacgccaccgggcucccgagauccuuuuccccaaucaaaugccccaauuauggacgaggaaagagagauacccgaacggucuuggaacagcggucacgagugggucacugauuucaaggggaaaaccgugugguuuguaccuaguaucaaggcaggaaaugacauugcugccugcuugaggaaaaacggcaagaaagugauccagcuaucccgcaagacauucgauagcgaauacguuaagacccgugcaaaugacugggauuuugucgugacuacagacauuucugagaugggcgccaacuucaaagcugagagagugaucgauccacggagguguaugaagcccgucauacugaccgaaggggaggaacgcguaauccucgccggaccuaugccggugacgcauucauccgcggcacagcgaagaggucggauuggcaggaaucccaaaaacgagaaugaccaauauaucuacaugggggaaccauuagagaacgacgaggauugcgcccacuggaaggaagcuaaaaugcugcuugacaauauuaacacuccugagggaaucauacccaguauguuugaaccagagcgcgaaaagguugaugccauugacggcgaguacagacugaggggugaggcucggaaaacauucguggaucucaugcgucgcggggacuugccugucuggcuggcauaucgaguggccgcugaaggcaucaauuacgccgauagaaggugguguuuugacggaauuaagaacaaucagauccucgaggaaaacguugagguggagauauggaccaaggaaggcgagcggaaaaagcugaaaccccgcuggcuugaugcaagaaucuauagcgacccacuagcgcugaaggaguucaaagaguucgccgcugggaggaagucguugaccuuaaaccugauuacugaaaugggacggcucccuacauuuaugacccagaaggcccgagaugcacuggacaaucuugcuguccugcauacagccgaggcaggagguagagccuacaaccacgcucucucugaguugccggaaacucuggagacgcuacugcuccuuacccuguuagcgacagugacugggggaaucuucuuguuucugauguccggcaaagguauugggaagaugacccucggcaugugcugcaucauaacagccagcauucugcuuugguaugcacagauccaaccccacuggaucgcugccucaauuauccuggaguucuuucucauaguauugcugauuccagagccugaaaaacagcgcacaccacaggauaaucaguuaacuuacgugguuaucgccauucuaacggucguggcagcuaccauggccaacgagaugggauuccuggagaagaccaaaaaggaccucggccuugggaguaucgcgacucaagaaucugaguccaauauacuggacaucgauuugaggccagcuagcgccuggacccuguaugcaguggccacaaccuuugucacuccuaugcuccggcauucaauugaaaacaguagcguuaaugugucccugacagcuaucgcaaaccaggccacgguacuuaugggacucgguaagggcuggccccugucuaaaauggacauuggggugccguugcuggcgaucggauguuacagccaggucaauccaauuaccuuaacugcugcccuacugcuccuuguggcacacuacgccaucauaggcccuggucugcaggcuaaggccacacgugaggcacagaaaagggcugccgcggggauuaugaagaaccccaccguugauggcaucaccgugaucgacuuggaaccaauucccuaugauccuaaauucgagaagcagcugggacaggucaugcuccugauacuuugcguaacacagguguuaaugaugaggacuacgugggcccugugugaggcacucaccuuggcuacaggcccgaucuccacucugugggaagggaaucccggacgcuuuuggaacaccacaauugccguuucaauggcaaauaucuuccggggcucuuaccuagcuggugccgggcugcucuuuaguauuaugaagaacaccacuaauacgcgaagaggaacaggcaacaucggugagacccuuggcgaaaaauggaagucgaggcugaaugccuuggggaaaagcgaguuccaaauauauaagaaauccggaauccaggagguggaccgcacucuggcgaaggaaggcauuaaaagaggggaaaccgaucaucacgcugucucuagaggaucagcaaagcuccguugguuuguggaaaggaacauggucacaccagagggcaaggugguugaccuggguugcgggcggggaggcuggagcuacuauugugguggccuuaaaaacgugcgcgaaguaaaggggcuaacuaaaggaggcccugggcaugaggagcccaucccuauguccaccuacggauggaaucuggugcgacuccagaguggcgucgauguuuucuucacaccacccgaaaagugcgacacgcuacugugugauauuggugagucuagcccuaacccaaccaucgaagccgggagaacuuugagggugcugaaucucgucgagaacuggcuuaauaacaauacacaauuuugcauaaaagugcugaaccccuauaugccgucaguaauugaaaagauggagaccuugcagcggaaguacggaggcgcucuggugcgcaauccucucuccagaaacaguacucacgagauguacuggguuagcaaugccacaggcaacaucgugucuuccgucaauaugaucucaaggauguuaauuaaccgauucaccaugaaacacaagaaagcaacguaugaaccagacguggaucuggggagcggaacccggaauauagguaucgagucggaaauucccaaccuugacaucauuggcaagcguaucgagaaaauaaagcaggaacaugagacaucuuggcacuacgaccaggaucauccuuauaagacuugggccuaccacgggaguuaugagaccaaacaaacaggauccgcuagcucaauggucaacggcgugguuagacugcuaacuaagccaugggacguagugcccauggucacccagauggcgaugacagauaccacuccguuuggucagcagcgcguguucaaagaaaagguugacacgaggacacaagagccuaaagaagggaccaagaagcucaugaaaaucacugccgaguggcuguggaaggaguugggcaaaaagaaaacaccccggauguguacaagagaagaguuuacgcgcaaggugagguccaaugcagcucugggcgccauuuucaccgaugaaaacaaauggaagucugcacgagaggccgucgaagacagccgguuuugggagcucaucgauagagagaggaaucuucaccuggaaggcaagugcgagacuuguguguacaacaugauggggaaacgcgaaaagaaauuaggagaguucgguaaggcuaaaggcagucgugccauuugguauauguggcugggggcgcgguuuuuggaguucgaggcacucggauuucugaaugaggaccauugguucuccagaggcaacagccuaucugguguagaaggggagggacuucacaggcugggcuacauccuccgcgaugugucaaagaaggaaggcggggccauguacgcugacgauacagccggaugggacacccgaauuacucuggaggacuugaaaaaugaagagaugguuacaaaccauaugaagggugagcacaaaaagcuggcagaagcuauauuuaaacucaccuaucagaauaaggucgugcgggugcagagaccaacaccuaggggcacugucauggauaucauuagucgcagagaccagcggggguccggacaaguuggcaccuacggucuuaacacguucaccaauauggaggcccagcugaucaggcagauggaaggggagggaaucuucaagagcauucaacauuuaacagugacugaggaaauagcuguacagaacuggcuggcccgugugggccgagagcgcuugucuagaauggcaaucucgggcgaugacugcgucgugaaaccccucgaugaccgguuugcgucagcccugaccgcucuaaaugauauggggaagguuaggaaagacauucagcagugggaaccaagccgcggauggaacgauuggacacaagugcccuucugcucccaccacuuucaugagcuugucaugaaggacgguagagugcugguaguuccuugucggaaucaggaugaacucaucggcagggcccgaauuagucagggggcaggauggucucugaaagagacugcuugcuugggcaagagcuaugcccagauguggaccuuaauguacuuccaccguagagaccugcgccucgcagccaacgcgaucuguuccgcugugccaucacauugggucccgacgagucggacaaccuggucuauacacgccaagcacgaguggaugacuacagaagauaugcuugcaguguggaacaggguguggauccaagagaaucccuggauggaagacaaaaccccugucgagagcugggaagagguuccauaucuggguaagagagaggaccaguggugcgggucccuaauuggacugacuucacgcgccaccugggcuaaaaacauccagacagccauuaaucaggugcggagccucaucggcaacgaagaguacacggauuauaugcccucuaugaagagguuucgaagagaagaggaagaggcaggcguauugugguga

SEQ ID NO: 14737 - RNA, 9876 nt, Artificial Sequence
  derived and/or modified CDS sequence (opt3) from DENV-2__EU482604__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgucaaagaaauugcugagacucagcacggcaccaucgugauuagaauacaguaugagggugacgggucuccaugcaagauccccuucgaaauuacggauuuggagaaaaggcauguacucggccggcugaucaccguuaacccgaucgugauugaaaaggacuccccugucaacauagaggccgaacccccauuuggagauagcuacaucauuaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaauagggaaggcccugcaccagguguucggcgcuaucuacggagcggcauuuaguggcguuagcuggacuaugaaaauucuuaucggggugguaauuaccuggaucggaaugaacuccagaucuacgagcuugucagucagucuggugcucguuggcguggucacacuguaucuuggugccauggugcaggcugacuccggguguguagugagcuggaagaauaaagaacugaagugcggaucuggcauauucauuaccgauaacguucacacuuggacagagcaguacaaguuucaacccgaaucaccaaguaaauuggccagcgcaauccagaaggcccaugaggaagguauuuguggcaucagguccgucacccggcucgagaaucugauguggaaacagauaacucccgaguuaaaccacauccugucugaaaaugaggugaagcuaaccauuaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguuuuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauuccaaaaaacuucgcaggccccgucagccagcacaacuaccgaccugguuaucauacucaaaccgcuggcccauggcaccucgggaagcuggaaauggauuuugacuucugugagggaacaacugugguugugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggucaauagucuggugaccgcgggacauggccagauagauaacuuuagcuuagguguucucggcauggcccuguuccuugaagagaugcugcgcacucgaguggggacaaaacacgcuaucuugcucguagcagucucguuugugacccugauuacgggaaauauguccuuccgggaccuaggccgugugauggucaugguuggggccacuaugaccgaugacaucggaaugggcgugacauaucuggcucuccuggccgcauuuaagguaagacccaccuucgcggccggucuuuugcugaggaaauuaacuucuaaggagcucaugauggcuacaauugggaucacccugcuuagccagucaacaauaccugaaacuauccuggagcuaaccgaugcccucgcacugggaaugaugguguugaaaauuguccgcaacauggaaaaguaccaacuggcugugacgaucauggccauuaguugcguucccaaugcagugaucuuacggaacgccuggaaggucuccuguacaauacucgcugcggugucuguuagcccacugcuucugaccuccucacagcagaaagccgacuggauuccuuuggcacucacuaucaagggccugaaucccaccgcuaucuuucuaacaacucugagcagaaccaguaaaaagaggucuuggccacuuaacgaggccauuauggccgugggcauggucuccauacucgcuagcucgcuguugaaaaaugacaucccgaugacggggccucugguagcaggagguuuacucacagugugcuauguucugaccggccgaucagccgaucuugaacuggagcgcgcggcugacgugaagugggaggaucaggccgaaauuucugggaguucccccaucuugagcauuacuaucucugaggacggaagcauguccauaaaaaacgaagaggaggaacaaacacucaccauccugauucggacuggccuacuggucaucucagguguguucccaguaaguauucccaucacagcagccgcuugguaccuuugggaggugaagaagcagagagcagggguccucugggauguuccuagcccacccccugugggaaaagccgaacuggaggacggcgcguauaggauaaagcagcguggcauuuugggguacucucagaucggagcugguguguauaaagaaggcaccuuucacacgauguggcaugucacucgcggggccguguuaaugcaccggggaaagagaaucgagccguccugggcagauguuaaaaaggaccugauuucauacggcgguggguggaagcucgagggagaauggaaagagggcgaagagguacaagugcuggcccuugaaccaggcaagaaucccagggcuguccagaccaaaccugggaucuucaagacaaacaccggaacaauaggugccgugagucuggauuuuagcccaggcacuuccgggucucccauuguugaccgaaaaggaaagguggucggcuuguacgguaauggggugguaacccggucgggagcauaugucagcgcuaucgcccagacggagaagucaauugaggauaacccugaaaucgaggacgauauauuccgcaaaaagagacuaacaauuauggaccugcauccgggcgcgggcaaaacuaagagguaccuccccgccaucgugcgggaagcaaucaaacgagggcugagaacccuuauuuuagcuccaacacgcguuguggccgcugagauggaagaggcacugaggggacucccuauccguuaucagacccccgccauuaaggccgagcacacuggucgggaaauagucgacuugaugugucaugcuaccuucacaaugagacugcucuccccagugaggguuccuaacuacaaucugaucauuauggaugaggcgcacuuuacggaccccgcaaguaucgccgcucgcggcuauaucucuacucgaguggaaaugggggaggccgcaggaauuuucaugaccgccacaccaccgggcagcagagauccuuuuccccaauccaacgcuccaauaauggacgaggaacgggagauccccgaaaggucauggaauucuggucacgagugggucaccgauuucaaggggaaaacugugugguuuguaccuagcauuaaggcgggaaacgacaucgccgcaugccuucgcaaaaauggcaagaaagugauucagcugagucguaagacauucgauuccgaauacguuaagaccagagcuaacgacugggauuuugucgugacgacugacaucagcgagaugggcgccaauuucaaagcagagcgggugauagauccaaggcgcuguaugaagcccgucaucuugacagacggggaagagcgaguaauucuagccggaccuaugccggugacccauucuucagcugcccagagacgggguaggaucggccgcaacccaaaaaaugaaaacgaccaauauauuuacaugggggagccccuggaaaaugaugaggacugcgcgcacuggaaggaggcaaaaaugcucuuagauaacaucaauaccccugaaggaauaauucccuccauguuugagccagaaagagagaagguugacgccaucgauggcgaauacaggcugcggggugaggcucguaaaacuuucguggaccuuaugcgccgaggggaucugccugucuggcucgccuauaagguggcugcagagggcauuaacuacgccgacagaaagugguguuuugauggaaucaaaaauaaccagauauuggaagagaacguugaaguggagaucuggacaaaggagggcgaaaggaaaaagcugaaaccccgguggcucgacgcucgcauuuauagugauccacuggcccuuaaggaguucaaggaauucgcagcggggagaaaaagccuaacccugaauuugaucacagagaugggaagguuaccuacuuuuaugacgcagaaggcccggaacgcucuggacaaucucgccguccugcauaccgcagaagcugguggccgagccuacaaccacgcacuuucggagcugccggagacacucgaaacuuugcugcuacugacccuccuugccacagugaccgggggaauuuuccuguuuuuaaugucuggcaaagguaucgggaagaugacuuugggcaugugcugcauaauuacggcuuccguacugcucugguaugcgcagauccaaccccacuggaucgccgcaagcauuauccuggaguucuuucuuauagugcugcucauuccagaaccugagaaacagagaaccccccaggauaaucaguugacauacguugucaucgcuauucugacugugguggccgccaccauggcaaacgaaaugggauucuuagagaagacaaagaaagaccuaggccuggggucaaucaccacucaagagagugaaucuaauauacucgacaucgaucuucgcccagcuuccgccuggacacuguaugcggucgcuacgaccuuuguuacuccuauguugaggcauagcauugagaacucaagugugaauguaagccugacagccaucgcaaaccaggccaccgugcucaugggacuggguaagggcuggccccuuuccaaaauggacauuggggucccgcuccuggcuaucggauguuacucucaggugaauccaauuaccuugacagcagcccuguuacuacugguugcgcacuacgcuaucauaggcccuggucuccaggccaaggcaacucgggaagcccaaaaacgugcugccgcagggauuaugaagaaccccacgguggauggcaucaccgucaucgaccuugagccaauucccuaugauccuaaguucgaaaaacagcugggacagguaauguugcugauacucugcgugacacagguucugaugaugagaacuaccugggcucuuugugaggccuuaacacuggcgaccggcccgaucagcacucucugggaggggaaucccggaagguuuuggaacacgacaauugccguguccauggcaaauaucuuccgcggcucauacuuggcuggugccgggcugcuauuuucuauuaugaagaacaccacuaauacccggcgaggaacaggcaacaucggugaaacucugggcgagaaauggaagaguagacucaacgcacuugggaaaucggaauuccaaauauauaagaaaagcggaauccaggaggucgacaggacccuggcuaaggagggcauuaagcgcggggaaacagaucaucacgccgugucccggggaucugccaaauugagaugguuugucgagcguaauauggugacgccagaaggcaagguuguggaccuggguugcgggaggggaggcuggucauacuauugugguggccucaaaaacguacgggaggugaaggggcugaccaaaggaggcccugggcaugaagagcccaucccuaugagcacuuacggauggaauuuaguccgccuucaguccggcguugauguguucuucacaccacccgagaagugcgacacccugcucugugauauuggugaaaguucuccuaacccaacuaucgaggcggggcgaacacuaagaguccugaauuugguggaaaacuggcugaauaacaauacccaauuuugcauaaagguacucaaccccuauaugccgagcgugauugagaaaauggaaacgcuucagaggaaguacggaggcgcucugguucggaauccuuugucacgcaacuccacccacgagauguacugggugaguaaugcaacaggcaacaucgucagcucugugaauaugaucuccagaaugcugauuaacagguucacuaugaaacacaagaaagccaccuaugagccagacgucgaucucgggucaggaacacgaaacauagguaucgaaagcgagauucccaauuuagacaucauuggcaagcggaucgaaaagauaaaacaggagcaugaaacuucguggcacuacgaccaggaucauccuuauaagaccugggcuuaccacgggucuuaugagacaaaacaaaccggaagugccuccagcauggugaacggcguuguacgucugcuuacuaagccaugggacgugguccccauggugacgcagauggcaaugacagauaccacuccguuuggucagcagagaguuuucaaagagaagguggacacccgcacacaagaaccuaaggaggggacgaaaaagcugaugaggaucaccgccgaauggcuauggaaagagcucggaaagaaaaagacuccccggauguguacaagagaggaauuuacccgcaaagucaggucaaaugcugcgcugggcgccauuuucacugaugagaacaaguggaaguccgcacgagaagcuguggaggacggccgguuuugggaauugguagauaaagagagaaaucugcaccucgaggggaagugcgaaacauguguguacaacaugaugggaaaaagggagaagaaacuuggugaauucggcaaggccaaggggucucgcgcaaucugguauauguggcugggagcccguuuuuuagaguucgaagcucugggcuuuuugaaugaggaccauugguucagccgggguaacagucucuccgggguugagggagaaggccugcacagacuaggcuacauucuuagggaugucgggaaaaaggagggaggugccauguacgcggacgauaccgcaggcugggacacacgcaucacucuggaagaccucaaaaaugaggaaauggugaccaaccauaugaagggggagcacaaaaagcuggccgaggcuauuuuuaaguugacguaucagaauaaagugguccgaguucagcggccaaccccuagaggaacagugauggauauaaucagcaggcgcgaccagagaggcucuggucaaguagggacuuacggacugaacaccuucacaaauauggaagcccagcucauucggcagauggagggcgaaggcaucuucaagucaauccaacaucuuacugcaaccgaggagauugcugugcagaacuggcuggccagggucgggcgugaacgauuaagucgcauggcuauauccggagaugacugcgugguuaaacccaucgaugacagauuugccagcgcacugacggcguugaaugauauggguaaggugcggaaagacauucagcagugggagccaucuaggggcuggaacgauuggacacaaguccccuucugcucgcaccacuuucaugaacucgugaugaaggacgggcgcguacugguugugccuuguagaaaccaggaugagcuaaucggacgggccaggauuucacagggcgcugguuggagccuuaaggaaaccgccugccuggggaaauccuaugcacagauguggacucucauguacuuccaccgacgugaccugagauuggcugccaaugcaaucuguagugccgucccaucucauugggugccgacaagccgcaccacuugguccauacacgcgaagcacgaguggaugaccacagaggauauguuagcuguguggaaccgggucuggauccaagaaaaucccuggauggaggacaaaacgccuguugaaucaugggaggaagugccauaucugggaaagagggaggaccaguggugcggcagucucauuggccuuaccucuagagccacuugggcaaaaaacauccagacagccauuaaucagguacgcagccugaucgggaacgaggaauacaccgauuauaugcccuccaugaagcgguuuaggcgagaggaagaggaagcuggagugcuaugguga

SEQ ID NO: 14738 - RNA, 9876 nt, Artificial Sequence
  derived and/or modified CDS sequence (opt3) from DENV-2__EU482605__SS-prME
accgccggagugauaauuaugcugauaccaacagcuauggcauuccaccucacuacgagaaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuggucaccggccaucucaaaugccgucugcgcauggauaaacuucaacugaaagggaugagcuacaguauguguacaggaaaguuuaagaucgugaaagaaauugcugagacucagcacggcaccaucguaauuagaauacaguaugagggugacgggucuccaugcaagauccccuucgaaauuacggauuuggagaaaaggcauguucucggccggcugaucaccgugaacccgaucgucauugaaaaggacuccccugugaacauagaggccgaacccccauucggagauagcuacaucauuaucggcgucgagccugggcaguuaaaacugaauugguuuaagaagggaucgucuauuggucaaauguucgagacaacuaugcgaggcgcuaaacgcauggccauccuaggggacaccgcaugggauuuuggaucccucggcgguguguucacaucaauagggaaggcccugcaccagguuuuuggcgcuaucuacggagcggcauucaguggcgugagcuggacuaugaaaauucuuaucgggguagucauuaccuggaucggaaugaacuccagaucuacgagcuugucagugagucugguucucgugggcgucgugacacuguaucuuggugccaugguacaggcugacuccgggugugugguuagcuggaagaauaaagaacugaagugcggaucuggcauauuuauuaccgauaacguccacacuuggacagagcaguacaaguuccaacccgaaucaccaaguaaauuggccagcgcaauccagaaggcccaugaggaagguauuuguggcaucagguccgugacccggcucgagaaucugauguggaaacagauaacucccgaguuaaaccacauccugucugaaaaugaggugaagcuaaccauuaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuuuuugauugauggaccggaaacagcagagugccccaauacuaacagggcguggaauagucuggaggucgaagacuacggcuucgguguuuuuaccacgaacaucuggcucaagcugcgugagaaacaggacguguucugugauucuaaguuaaugagcgcugccauaaaagacaaucgggcagugcacgccgauaugggguauuggauugaauccgcucugaacgacacauggaagauggagaaggccucauuuaucgagguaaaaagcugccacuggccuaagucucauacccuuugguccaauggagucuuggaaagugagaugaucauucccaagaacuucgcaggccccgugagccagcacaacuaccgaccugguuaucauacucaaaccgcuggcccauggcaccucgggaagcuggaaauggauuucgacuuuugugagggaacaacuguuguggucaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggugaauagucugguuaccgcgggacauggccagauagauaacuucagcuuaggugugcucggcauggcccuguuucuugaagagaugcugcgcacucgaguagggacaaaacacgcuaucuugcucgucgcagugucguucgugacccugauuacgggaaauauguccuuucgggaccuaggccgugucaugguuauggugggggccacuaugaccgaugacaucggaaugggcguaacauaucuggcucuccuggccgcauucaaggugagacccaccuuugcggccggucuuuugcugaggaaauuaacuucuaaggagcucaugauggcuacaauugggaucacccugcuuagccagucaacaauaccugaaacuauccuggagcuaaccgaugcccucgcacugggaaugauggucuugaaaauugugcgcaacauggaaaaguaccaacuggcuguuacgaucauggccauuaguugcgugcccaaugcagucaucuuacggaacgccuggaagguguccuguacaauacucgcugcgguuucugugagcccacugcuucugaccuccucacagcagaaagccgacuggauuccuuuggcacucacuaucaagggccugaaucccaccgcuaucuuccuaacaacucugagcagaaccaguaaaaagaggucuuggccacuuaacgaggccauuauggccgucggcaugguauccauacucgcuagcucgcuguugaaaaaugacaucccgaugacggggccucugguggcaggagguuuacucacaguuugcuaugugcugaccggccgaucagccgaucuugaacuggagcgcgcggcugacgucaagugggaggaucaggccgaaauuucugggaguucccccaucuugagcauuacuaucucugaggacggaagcauguccaucaagaacgaagaggaggaacaaacacucaccauccugauucggacuggccuacuggugaucucagguguauuuccagugaguauucccaucacagcagccgcuugguaccuuugggaggucaagaagcagagagcagggguucucugggaugugccuagcccacccccugugggaaaagccgaacuggaggacggcgcguauaggauaaagcagcguggcauuuugggguacucucagaucggagcuggugucuauaaagaaggcaccuuccacacgauguggcaugugacucgcggggccguuuuaaugcaccggggaaagagaaucgagccguccugggcagaugucaaaaaggaccugauuucauacggcgguggguggaagcucgagggagaauggaaagagggcgaagaggugcaaguccuggcccuugaaccaggcaagaaucccagggcugugcagaccaaaccugggaucuuuaagacaaacaccggaacaauaggugccguuagucuggauuucagcccaggcacuuccgggucucccauuguggaccgaaaaggaaaggucgugggcuuguacgguaaugggguagucacccggucgggagcauaugugagcgcuaucgcccagacggagaagucaauugaggcgaacccugaaaucgaggaugccauauuucgcaaaaagagacuaacaauuauggaccugcauccgggcgcaggcaaacccaagaggucccucccagcuaucguucgggaagccaucaaacgagggcugagaccucuuauuuuagcucccccacgcguggucccugcagagauggaggaaccacugaggggacucccaauccguuaccagacuccggccauuaagccugaucacaccggucgggagauaguggccuugaugugucaugcucccuucacaaugagacugcucaguccaguuagggugcccaacuauaaucugaucauuauggacgaagcgcacuucaccgacccugcaucuaucgccgcucgcggcuacaucagcacucgagucgagaugggggaagccgcaggaauuuuuaugaccgccacaccacccggcuccagagauccuuucccgcaaucaaacgcuccaauaauggacgaggagcgggaaauccccgagaggucuuggaauagcggucacgaaugggugacggauuuuaaggggaaaacuguaugguucgugccuaguauuaaggcgggaaacgacaucgccgcaugccuucgcaaaaauggcaagaaaguuauucagcugucccguaagaccuuugauagcgaguaugucaagacaagagcuaacgacugggauuucguggugaccacugacaucucugaaaugggcgccaauuuuaaagcagagcgggucauagaucccaggcgcuguaugaagccaguaaucuugacagacggggaggaacgagugauucuagccggaccuaugcccguuacccauucauccgcugcccagagacgggguaggaucggccgcaaccccaaaaaugagaacgaucaauacauuuauaugggggaaccucuggagaaugacgaagacugcgcgcacuggaaggaggcaaaaaugcucuuagauaacaucaauacgccggagggaauaauucccaguauguucgaaccagagagagaaaagguggacgccaucgauggcgaguacaggcugcggggugaagcucguaaaacuuuugucgaccuuaugcgccgaggggaucugccuguguggcucgccuacaagguugcugcagagggcauuaacuaugccgacagaaagugguguuucgauggaaucaaaaauaaccagauauuggaggaaaacguggaggucgaaaucuggacaaaggagggcgagaggaaaaagcugaaaccccgguggcucgacgcucgcauuuacagcgauccacuggcccuuaaggaauuuaaggaguucgcagcggggagaaaaucgcuaacccugaauuugaucaccgaaaugggaagguuaccuacuuucaugacacagaaggcccggaacgcucuggacaaucucgccgugcugcauaccgcagaggcugguggccgagccuauaaccacgcacuuucugaacugcccgagacacucgagacuuugcugcuacugacgcuccuugccaccguaacagggggaauuuuucuguucuuaauguccggcaaagguaucgggaagaugacuuugggcaugugcugcauaauuaccgcuagcgugcugcucugguacgcgcagauccaaccgcacuggaucgccgcaucaauuauccuggaauuuuuccuuauaguucugcucauuccagagccugaaaaacagagaacaccccaggauaaucaguugaccuaugucgugaucgcuauucugacuguggucgccgccacgauggcaaacgagaugggauuuuuagaaaagaccaagaaagaccuaggccuggggaguaucacaacucaagagucugaguccaauauacucgauaucgaccuucgcccagcuagcgccuggacccuguacgcgguugcuacaaccuucgugacucccauguugaggcauucaauugaaaacaguagcguaaaugugucccugacagccaucgcaaaccaggccacgguccucaugggacuggguaagggcuggccucuuucuaaaauggacauuggggugccgcuccuggcuaucggauguuauagccagguuaaucccauuaccuugacugcagcccuguuacuacugguggcgcacuacgcuaucauaggcccaggucuccaggccaaggcaacacgggaggcccaaaaacgugcugccgcagggauuaugaagaacccuaccgucgauggcaucaccguaaucgaccuugaacccauuccuuacgauccaaaguuugagaaacagcugggacaggugauguugcugauacucugcguuacacaggugcugaugaugagaacuacgugggcucuuugugaagccuuaacccuggcgacaggccccaucuccacucucugggaggggaauccuggaagguucuggaacaccacaauugccgucucaauggcaaauaucuuucgcggcucuuauuuggcuggugccgggcugcuauucaguauuaugaagaacaccacuaauacgcggcgaggaacaggcaacaucggugagacccugggcgaaaaauggaagucgagacucaacgcacuugggaaaagcgaguuucaaauauacaagaaauccggaauccaggaaguggacaggacucuggcuaaggagggcauuaagcgcggggagaccgaucaucacgccgucucucggggaucagccaaauugagaugguucguggaacguaauaugguuacaccagagggcaaggugguagaccuggguugcgggaggggaggcuggagcuauuacugugguggccucaaaaacgugcgggaagucaaggggcugacuaaaggaggccccgggcaugaggaaccgaucccuauguccaccuauggauggaauuuaguucgccuucagaguggcguggaugucuuuuucacaccacccgagaagugcgacacgcugcucugugauauuggugagucuagcccuaacccaaccaucgaagcggggcgaacucuaagagugcugaauuugguagagaacuggcugaauaacaauacacaauucugcauaaaggugcucaaccccuacaugccgucaguuauugagaaaauggagacccuucagaggaaguauggaggcgcucuggugcggaauccuuugucccgcaacaguacucacgaaauguacugggucagcaaugcaacaggcaacaucgugucuuccgucaauaugaucucaagaaugcugauuaacagguuuaccaugaaacacaagaaagccacguacgagcccgacguggaucucgggagcggaacccgaaacauagguaucgagucggaaauuccaaauuuagacaucauuggcaagcggaucgagaagauaaaacaggaacaugagacaucuuggcacuaugaucaggaccauccuuacaagacuugggcuuaucacgggaguuacgaaaccaaacaaacaggauccgccagcucaaugguuaacggcguagugcgucugcuuacuaagcccugggacgucgugccaaugguuacccagauggcaaugacagauaccacucccuucggucagcagagaguguuuaaagagaaggucgacacgcgcacacaagagccuaaggaagggaccaaaaggcugaugcggaucacugccgaguggcuauggaaggaacucggcaaaaagaaaaccccaagaauguguacacgcgaggaguucacgaggaaggugcgauccaaugcugcgcugggcgccauuuuuaccgaugaaaacaaauggaagucugcacgggaggcuguagaagacggcagauucugggaguugguggauaaggaaaggaaucugcaccucgaggggaaaugcgagacuuguguuuauaacaugaugggaaagcgcgagaagaaacuuggugaguuuggcaaagccaaagggagccgugcaaucugguacauguggcugggagcccgguucuuagaauuugaggcucugggcuucuugaaugaagaccauugguuuaguagagguaacucccucagcggggucgagggagagggccugcacaggcuaggcuauauucuucgcgauguggggaagaaagaaggaggugccauguacgcggacgauacagcaggcugggacacccgaaucacucuggaggaucucaagaaugaagagauggugacaaaccauaugaaaggggaacacaagaaacuggccgaggcuauuuucaaguugaccuaccagaauaaggucguucgggugcagagaccgacacccaggggaacuguaauggacauaaucucucgcagagaccagcggggcucaggucaaguggggaccuauggacugaacacguuuaccaauauggaggcccagcucauuaggcagauggaaggcgagggcaucuucaaaaguauccaacaucuuacagcaacugaagagauugcuguccagaacuggcuggcccguguggggcgagagcgcuuauccagaauggcuauaagcggagaugacugcguugugaagccuaucgaugaccgguucgccucugcacugaccgcguugaaugauauggguaaagucaggaaggacauucagcagugggaaccaucgcgcggcuggaacgauuggacacaagugcccuuuugcucacaccacuuccaugagcucguaaugaaagacgggagaguucugguggucccuugucggaaccaggaugaacuaaucggaagggcccgaauuagccagggcgcugguuggucccuuaaggagacugccugccuggggaagaguuacgcacagauguggacccucauguauuuucaccguagagaccugcgcuuggcugccaaugcaaucuguucugccgugccaagccauugggugcccacgucccggacaaccuggucaauacacgcgaaacacgaauggaugacuacagaggauauguuagcugucuggaacaggguuuggauccaagagaauccuuggauggaagacaagaccccgguggagaguugggaagagguaccauaccugggaaaaagagaagaucaguggugcggcucucucauuggccuuacuagccgcgccaccugggcaaagaacauccagacagccauuaaucaggugcggucccugaucgggaacgaggaguauacggacuacaugcccucaaugaaaagguuccgaagagaagaggaagaggcuggaguccuaugguga

SEQ ID NO: 14739 - RNA, 9876 nt, Artificial Sequence
  derived and/or modified CDS sequence (opt3) from DENV-2__EU482606__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgucaaagaaauugcugagacucagcacggcaccaucgugauuagaauacaguaugagggugacgggucuccaugcaagauccccuucgaaauuacggauuuggagaaaaggcauguacucggccggcugaucaccguuaacccgaucgugauugaaaaggacuccccugucaacauagaggccgaacccccauuuggagauagcuacaucauuaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaauagggaaggcccugcaccagguguucggcgcuaucuacggagcggcauuuaguggcguuagcuggacuaugaaaauucuuaucggggugguaauuaccuggaucggaaugaacuccagaucuacgagcuugucagucagucuggugcucguuggcguggucacacuguaucuuggugccauggugcaggcugacuccggguguguagugagcuggaagaauaaagaacugaagugcggaucuggcauauucauuaccgauaacguucacacuuggacagagcaguacaaguuucaacccgaaucaccaaguaaauuggccagcgcaauccagaaggcccaugaggaagguauuuguggcaucagguccgucacccggcucgagaaucugauguggaaacagauaacucccgaguuaaaccacauccugucugaaaaugaggugaagcuaaccauuaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguuuuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauuccaaaaaacuucgcaggccccgucagccagcacaacuaccgaccugguuaucauacucaaaccgcuggcccauggcaccucgggaagcuggaaauggauuuugacuucugugagggaacaacugugguugugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggucaauagucuggugaccgcgggacauggccagauagauaacuuuagcuuagguguucucggcauggcccuguuccuugaagagaugcugcgcacucgaguggggacaaaacacgcuaucuugcucguagcagucucguuugugacccugauuacgggaaauauguccuuccgggaccuaggccgugugauggucaugguuggggccacuaugaccgaugacaucggaaugggcgugacauaucuggcucuccuggccgcauuuaagguaagacccaccuucgcggccggucuuuugcugaggaaauuaacuucuaaggagcucaugauggcuacaauugggaucacccugcuuagccagucaacaauaccugaaacuauccuggagcuaaccgaugcccucgcacugggaaugaugguguugaaaauuguccgcaacauggaaaaguaccaacuggcugugacgaucauggccauuaguugcguucccaaugcagugaucuuacggaacgccuggaaggucuccuguacaauacucgcugcggugucuguuagcccacugcuucugaccuccucacagcagaaagccgacuggauuccuuuggcacucacuaucaagggccugaaucccaccgcuaucuuucuaacaacucugagcagaaccaguaaaaagaggucuuggccacuuaacgaggccauuauggccgugggcauggucuccauacucgcuagcucgcuguugaaaaaugacaucccgaugacggggccucugguagcaggagguuuacucacagugugcuauguucugaccggccgaucagccgaucuugaacuggagcgcgcggcugacgugaagugggaggaucaggccgaaauuucugggaguucccccaucuugagcauuacuaucucugaggacggaagcauguccauaaaaaacgaagaggaggaacaaacacucaccauccugauucggacuggccuacuggucaucucagguguguucccaguaaguauucccaucacagcagccgcuugguaccuuugggaggugaagaagcagagagcagggguccucugggauguuccuagcccacccccugugggaaaagccgaacuggaggacggcgcguauaggauaaagcagcguggcauuuugggguacucucagaucggagcugguguguauaaagaaggcaccuuucacacgauguggcaugucacucgcggggccguguuaaugcaccggggaaagagaaucgagccguccugggcagauguuaaaaaggaccugauuucauacggcgguggguggaagcucgagggagaauggaaagagggcgaagagguacaagugcuggcccuugaaccaggcaagaaucccagggcuguccagaccaaaccugggaucuucaagacaaacaccggaacaauaggugccgugagucuggauuuuagcccaggcacuuccgggucucccauuguugaccgaaaaggaaagguggucggcuuguacgguaauggggugguaacccggucgggagcauaugucagcgcuaucgcccagacggagaagucaauugaggauaacccugaaaucgaggacgauauauuccgcaaaaagagacuaacaauuauggaccugcauccgggcgcgggcaaaacuaagagguaccuccccgccaucgugcgggaagcaaucaaacgagggcugagaacccuuauuuuagcuccaacacgcguuguggccgcugagauggaagaggcacugaggggacucccuauccguuaucagacccccgccauuaaggccgagcacacuggucgggaaauagucgacuugaugugucauccaaccuucacaaugagacugcucuccccugugaggguucccaacuacaaucugaucauuauggaugaggcucacuuuacggacccagcgaguaucgcagcccgcggcuauaucucuacucgaguggaaaugggggaggcugccggaauuuucaugaccgcaacaccgccuggcagcagagaucccuuuccacaauccaacgcccccauaauggacgaggaacgggagaucccugaaaggucauggaauucuggucacgagugggucaccgauuucaaggggaaaacugugugguuuguaccaagcauuaaggcuggaaacgacaucgcggccugccuucgcaaaaauggcaagaaagugauucagcugagucguaagacauucgauuccgaauacguuaagaccagagcaaacgacugggauuuugucgugacgacugacaucagcgagaugggcgcuaauuucaaagccgagcgggugauagaucccaggcgcuguaugaagccugucaucuugacagacggggaagagcgaguaauucuagcaggaccgaugccagugacccauucuucagccgcucagagacgggguaggaucggccgcaaccccaaaaaugaaaacgaccaauauauuuacaugggggagccucuggaaaaugaugaggacugcgcccacuggaaggaggcgaaaaugcucuuagauaacaucaauacccccgaaggaauaauuccauccauguuugagccugaaagagagaagguugacgcaaucgauggcgaauacaggcugcggggugaggcccguaaaacuuucguggaccuuaugcgccgaggggaucugcccgucuggcucgcuuauaagguggccgcugagggcauuaacuacgcagacagaaagugguguuuugauggaaucaaaaauaaccagauauuggaagagaacguugaaguggagaucuggacaaaggagggcgaaaggaaaaagcugaaaccacgguggcucgacgcccgcauuuauagugauccucuggcucuuaaggaguucaaggaauucgccgcagggagaaaaagccuaacccugaauuugaucacagagaugggaagguuaccgacuuuuaugacgcagaaggcgcggaacgcccuggacaaucucgcuguccugcauaccgccgaagcagguggccgagcuuacaaccacgcccuuucggagcugcccgagacacucgaaacuuugcugcuacugacccuccuugcaacagugaccgggggaauuuuccuguuuuuaaugucuggcaaagguaucgggaagaugacuuugggcaugugcugcauaauuacggccuccguacugcucugguaugcucagauccaaccacacuggaucgcggccagcauuauccuggaguucuuucuuauagugcugcucauuccugaacccgagaaacagagaaccccacaggauaaucaguugacauacguugucaucgcaauucugacugugguggcugccaccauggccaacgaaaugggauucuuagagaagacaaagaaagaccuaggccuggggucaaucaccacucaagagagugaaucuaauauacucgacaucgaucuucgcccugcauccgcuuggacacuguaugccgucgcgacgaccuuuguuacucccauguugaggcauagcauugagaacucaagugugaauguaagccugacagcuaucgccaaccaggcaaccgugcucaugggacuggguaagggcuggccgcuuuccaaaauggacauuggggucccacuccuggccaucggauguuacucucaggugaauccuauuaccuugacagcugcacuguuacuacugguugcccacuacgcgaucauaggccccggucuccaggcuaaggccacucgggaagcacaaaaacgugccgcugccgggauuaugaagaacccaacgguggauggcaucaccgucaucgaccuugagcccauuccuuaugauccgaaguucgaaaaacagcugggacagguaauguugcugauacucugcgugacacagguucugaugaugagaacuaccugggcacuuugugaggcuuuaacacuggccaccggccccaucagcacucucugggaggggaauccaggaagguuuuggaacacgacaauugcgguguccauggccaauaucuuccgcggcucauacuuggcaggugcugggcugcuauuuucuauuaugaagaacaccacuaauacccggcgaggaacaggcaacaucggugaaacucugggcgagaaauggaagaguagacucaacgcccuugggaaaucggaauuccaaauauauaagaaaagcggaauccaggaggucgacaggacccuggcaaaggagggcauuaagcgcggggaaacagaucaucacgcugugucccggggaucugccaaauugagaugguuugucgagcguaauauggugacgccugaaggcaagguuguggaccuggguugcgggaggggaggcuggucauacuauugugguggccucaaaaacguacgggaggugaaggggcugaccaaaggaggccccgggcaugaagagccuaucccaaugagcacuuacggauggaauuuaguccgccuucaguccggcguugauguguucuucacacccccugagaagugcgacacccugcucugugauauuggugaaaguucuccaaaccccacuaucgaggccgggcgaacacuaagaguccugaauuugguggaaaacuggcugaauaacaauacccaauuuugcauaaagguacucaacccguauaugccuagcgugauugagaaaauggaaacgcuucagaggaaguacggaggcgcgcugguucggaauccauugucacgcaacuccacccacgagauguacugggugaguaaugcuacaggcaacaucgucagcucugugaauaugaucuccagaaugcugauuaacagguucacuaugaaacacaagaaagcaaccuaugagcccgacgucgaucucgggucaggaacacgaaacauagguaucgaaagcgagauuccuaauuuagacaucauuggcaagcggaucgaaaagauaaaacaggagcaugaaacuucguggcacuacgaccaggaucauccauauaagaccugggccuaccacgggucuuaugagacaaaacaaaccggaagugcuuccagcauggugaacggcguuguacgucugcuuacuaagcccugggacguggucccgauggugacgcagauggccaugacagauaccacuccuuuuggucagcagagaguuuucaaagagaagguggacacccgcacacaagaacccaaggaggggacgaaaaagcugaugaggaucaccgcagaauggcuauggaaagagcucggaaagaaaaagacuccacggauguguacaagagaggaauuuacccgcaaagucaggucaaaugccgcucugggcgcgauuuucacugaugagaacaaguggaaguccgcccgagaagcaguggaggacggccgguuuugggaauugguagauaaagagagaaaucugcaccucgaggggaagugcgaaacauguguguacaacaugaugggaaaaagggagaagaaacuuggugaauucggcaaggcuaaggggucucgcgccaucugguauauguggcugggagcacguuuuuuagaguucgaagcccugggcuuuuugaaugaggaccauugguucagccgggguaacagucucuccgggguugagggagaaggccugcacagacuaggcuacauucuuagggaugucgggaaaaaggagggaggugcuauguacgccgacgauaccgcgggcugggacacacgcaucacucuggaagaccucaaaaaugaggaaauggugaccaaccauaugaagggggagcacaaaaagcuggcagaggccauuuuuaaguugacguaucagaauaaagugguccgaguucagcggccuacccccagaggaacagugauggauauaaucagcaggcgcgaccagagaggcucuggucaaguagggacuuacggacugaacaccuucacaaauauggaagcucagcucauucggcagauggagggcgaaggcaucuucaagucaauccaacaucuuacugccaccgaggagauugcagugcagaacuggcuggcuagggucgggcgugaacgauuaagucgcauggccauauccggagaugacugcgugguuaaaccaaucgaugacagauuugcuagcgcccugacggcauugaaugauauggguaaggugcggaaagacauucagcagugggagcccucuaggggcuggaacgauuggacacaagucccuuucugcucgcaccacuuucaugaacucgugaugaaggacgggcgcguacugguugugccauguagaaaccaggaugagcuaaucggacgggcgaggauuucacagggcgccgguuggagccuuaaggaaaccgcuugccuggggaaauccuaugcccagauguggacucucauguacuuccaccgacgugaccugagauuggcagcuaaugccaucuguagugcagucccgucucauugggugcccacaagccgcaccacuugguccauacacgccaagcacgaguggaugaccacagaggauauguuagcgguguggaaccgggucuggauccaagaaaauccuuggauggaggacaaaacgccaguugaaucaugggaggaagugcccuaucugggaaagagggaggaccaguggugcggcagucucauuggccuuaccucuagagcuacuugggccaaaaacauccagacagcaauuaaucagguacgcagccugaucgggaacgaggaauacaccgauuauaugccuuccaugaagcgguuuaggcgagaggaagaggaagccggagugcuaugguga

SEQ ID NO: 14740 - RNA, 9876 nt, Artificial Sequence
  derived and/or modified CDS sequence (opt3) from DENV-2__EU482607__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucggggucucuaacagggauuuuguggaaggaguaucggguggcucauggguugacauagugcucgagcacgggagcugugucacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuauuugcaagcauucuaugguggauagaggcugggguaacggguguggacuauucggcaagggcgggaucgugaccugcgccauguuuacaugcaaaaagaauauggaaggaaaagucguucagccugagaaccucgaauacaccaucgugauuacuccacacagcggugaggagcaugcuguaggcaaugacacggggaagcacggaaaagaaauaaagaucacaccgcaguccucaauuaucgaggccgaacugaccggcuaugguacugugaccauggaguguagucccaggacagggcuugauuucaacgaaaugguccuguugcaaauggaggacaaagcauggcucgugcaccggcagugguuucuggauuuaccucugccauggcuccccggcgcugacacccagggaagcaauuggauacagaaggagacucuuguuacauucaagaacccucaugccaaaaagcaagacguggucgugcugggcucucaggaaggggcgaugcacacggccuugaccggagcaacugagauucagauguccucagguaaucuacuguuuacaggccaucucaaaugccgucugcgcauggauaagcuucaacugaaagggaugagcuacaguauguguaccggaaaguucaagaucguaaaagaaaucgcugagacacagcacggcacuauuguuaucagagugcaguaugagggugacgggucuccaugcaagauucccuucgaaauaaccgauuuggagaaaaggcauguccucggccggcugaucacggugaacccgauugucaccggaaaggacuccccugugaacaucgaagccgagcccccauuuggcgauagcuacaucauuauagggguugaaccuggacaguuaaaacugaauugguucaagaaggguucgucuaucggccaaauguuugagacaacuaugcgaggggcuaaacgcauggccauucuaggagacaccgcaugggauuucggcucccucggugggguguuuacaucaaucggcaaggcccugcaccagguauucggagcuauuuacggcgcggcauuuaguggggucagcuggacuaugaaaauccuuauaggagugaucauuaccuggaucggcaugaacuccagaucuacgagcuugucaguuagucuggugcucgucggugugguaacacuguaucuuggggccauggugcaggcugacuccggauguguugucagcuggaagaauaaagagcugaagugcggcucugguauuuucaucaccgauaacgugcacacuuggacagaacaguacaaguuucaacccgagucaccaaguaaauuggccagcgcaauacagaaggcccaugaagagggcauuugugggaucagguccgugacccggcucgaaaaucugauguggaaacagauuacucccgaguuaaaccacauccugucugagaaugaagucaagcuaaccauaaugacaggagacaucaaaggcauuaugcaggcugggaagcgcucgcucagaccucaaccaacggagcugaaauauagcuggaagaccuggggaaaggccaaaaugcuuuccacugaaucacauaaccagacauucuugaucgauggcccggagaccgcagaaugccccaauacaaacagggcguggaauagucuggagguugaggacuacgguuuugggguguucacuaccaacauuuggcucaagcugcgugaaaaacaggacguguuuugugauucuaaguuaaugagcgcugccaucaaagacaaucgggcaguacacgccgauaugggauauuggauagaguccgcucugaacgacacguggaagauggaaaaggccucauucauugaggucaaaagcugccacuggccuaagucucauacacuuugguccaauggcguguuggagagugaaaugaucaucccaaaaaacuucgcaggucccguuagccagcacaacuaccgaccuggcuaucauacccaaacugcugggccauggcaccucggaaagcuggagauggauuuugacuucugugaaggcaccacaguggucgugacugaggauugcgggaauagaggacccucucuaaggaccacaacggccuccggcaaacugauuaccgaauggugcugucgcucaugcacucucccgccucugcgguacagaggugaggacggguguugguacggaauggagaucaggccacuuaaggaaaaggaggaaaacuugguuaauagucuggugacagcgggccauggucagauugauaacuuuagcuuaggcguacucgggauggcccuguuccuugaggaaaugcugcgcacccgagucggaacuaaacacgcuauauugcucguggcagugucguuugucacacugaucaccggcaauauguccuuccgggaccuagggcguguuauggugaugguaggagccacgaugacugaugacauuggcaugggugugaccuaucuggcucuccuggccgcauuuaaggucagacccacauucgcggccgggcuuuugcugaggaaauuaaccucuaaggagcucaugauggcuacuaucggaauugcccugcuuagccagucaacaaucccugagaccauacuggaacuaacagaugcacucgcucugggcaugaugguguugaaaaucguucgcaacauggagaaguaccaacuggccgugacugucauggcaauuaguugcgugcccaaugccguuaucuuacagaacgcuuggaagguguccuguaccauucucgcggccgucucuguaagcccacugcuucugacguccucacagcagaaagcagacuggaucccuuuggcucucacaauaaagggccugaaucccaccgccauuuuucuaacuacccugagccggacaaguaaaaagagaucuuggccacuuaacgaagccaucauggcuguggggaugguuuccauccucgcaagcucgcuguugaaaaaugacauuccgaugacuggaccucugguggccgguggcuuacucaccgucugcuaugugcugacggggaggucagcggaucuugagcuggaacgagcugccgacguaaagugggaggaucaagcagagauaucuggaaguucccccaucuugagcauuacaaucucugaagacggcagcauguccauuaaaaacgaggaagaggagcagacccucacuauccugauacgcacaggucuacuggugaucucaggggucuucccaguuaguauucccaucaccgccgcugcaugguaccuuugggaagugaagaagcagcgggccggagugcucugggaugucccuagcccacccccugugggcaaagcggagcuggaagacggcgcuuauagaauuaagcagagggggaucuugggauacucucaaauaggugccggcguuuauaaagaggggacuuuucacacaauguggcauguaacccguggagcaguguuaaugcaccgcggcaagcggauugaaccguccugggccgaugucaaaaaggaccugaucucauacggugggggauggaagcucgagggcgaguggaaagaaggcgaggaagugcagguucuggcucuugagccagggaagaaucccagagccgugcagacgaaaccuggaaucuucaagacugauaccgguacaauuggcgcagucagucuggacuuuagcccagggaccuccggaucucccaucguggauaggaaaggcaagguagucgguuuguacgggaacggagugguuacacgaucgggcgcuuaugugagcgccauagcgcagacugaaaagucaauugaggacaauccugagaucgaagaugacauuuuccggaaaaagcgccuaaccaucauggaccugcauccgggcgccgggaaaacgaagagauaccuccccgcaauagucagggaggcuauuaaacggggacugcgaacacuuaucuuagccccaacuagagugguugcugcagaaauggaggaagcccugcgcggucucccuaucagguaucaaacccccgccauuaaggcugagcacacaggccgugagaucguggauuugaugugucaugcgaccuucacuaugcggcugcucuccccagucagagugccuaacuacaaccugauuauaauggacgaagcacacuuuaccgaucccgccaguaucgcugccaggggguauauuucuacacgcguagagaugggagaagcagccggcaucuucaugacggcuacuccaccggguagccgagacccuuuuccccaguccaaugcgccaaucauggaugaggagagagaaauucccgagcggucauggaacucugggcacgaaugggugaccgacuucaagggaaaaacaguuugguuugucccuagcauaaaggccggcaaugauaucgcagcuugccuuaggaaaaacggcaagaaagugauucagcugagucgcaagaccuucgacuccgaguacgugaagacucgugccaaugauugggacuuugucguaacaaccgauaucagcgaaaugggggcaaacuucaaagccgagagagugauugacccacggagguguaugaagcccguuaucuugacggacggagaggaacgcgugauacuagcugguccuaugccggucacucauucuucagccgcgcaacgaagaggccggaucgggaggaauccaaaaaacgagaaugaucaguauauuuacaugggagaaccccuggagaacgacgaagauugcgcacacuggaaggaggccaaaaugcucuuagacaauaucaacacaccugagggcauuauccccuccauguuugaaccagagcgcgaaaagguggaugcuauagacggugaguacagacugaggggggaagcccggaaaaccuucguugaucuuaugcgucgcggcgaccugccuguguggcucgcuuauaaggucgcagccgagggaauuaauuacgcugaucgaaagugguguuuugacggcaucaaaaacaaucagauuuuggaggaaaacguggagguagaaaucuggaccaaggagggggagagaaaaaagcugaaacccagguggcucgaugcccggauauauagugacccacuggcacuuaaggaauucaaggaguucgcggccggacgcaaaagccuagcucugaacuugaucacugaaauggguagauuaccuacauuuaugacccagaaggccaggaaugcacuggauaaccucgcugugcugcauacagccgaggcaggcgggcgggccuacaaucacgcucuuucggaacugccggagacucucgagacguugcugcuacugacccuccuugcgacaguuacuggaggcauuuuccuguuuuuaaugucugguaaagggaucggcaagaugaccuugggaaugugcugcauuaucacagccuccguccugcucugguaugcacaaauacagccccacuggauugcugccagcaucauccuggaauucuuucuuauugugcugcucaucccagagccugaaaaacagcgaaccccccaggacaaccaauugacuuacguggucauagccauucugacgguuguggcagcuaccauggccaaugagaugggcuucuuagaaaagacaaagaaagaccuagggcugggaucaaucacuacccaggagagugagucuaacauucucgauaucgaccuuagaccagcguccgcuuggacacuguaugccguagcaaccacuuuugugacaccuauguugcgccauagcauagaaaauucaagugucaacgugagccugacggccaucgcuaaucaggcaaccguucucaugggucugggcaagggguggccccuuuccaaaauggauauuggagugccgcuccuggccaucggcuguuacucucaggucaacccaauuacuuugacagcggcucuguuacuacugguagcccacuacgcaaucauugguccugggcuccaagccaaggcuaccagggaggcccagaaacgggcagcugccggcaucaugaagaaucccaccguggacggaauaacaguuauugaucuugaaccaauccccuaugacccuaaguucgagaaacagcugggccaggugauguugcugauccucugcgucacucaagugcugaugaugcguacgaccugggcgcuuugugaagccuuaacacuggcaacugggccgauuagcacccucugggagggaaaccccggcagauuuuggaauacaaccauagcugucuccauggccaacaucuucagggguucauacuuggcaggggcuggacugcuauuuucuauuaugaagaauacuacgaacacacgccggggcaccgguaauaucggcgagacucugggggaaaaauggaagagucgacucaacgcccuuggaaaaucggaguuccagauuuauaagaaaagcggcauccaggaaguggauagaacccuggccaaggaggggauaaagaggggagagacagaccaucacgcgguuucccgcggcucugcuaaauugcggugguuuguggaaagaaacaugguaacuccagaggguaagguggucgaucuggggugcggacguggcgguuggucauacuauuguggcgggcucaaaaauguuagggaagugaagggacugaccaaaggcgggccuggacaugaggaacccaucccuaugagcacauacggcuggaacuuaguccggcuucaauccgguguggacguauucuucacgccacccgagaagugcgauacccugcucugugacauuggggagaguucuccuaauccaacuaucgaagcaggacgcacacuacgagugcugaacuugguugagaauuggcugaacaauaacacccaguuuugcauuaaggugcucaaucccuauaugccgagcgucaucgaaaaaauggagacucuucagagaaaguacggcggcgcccuggugaggaacccuuugucacggaauuccacacacgaaauguacugggucaguaacgcuaccgggaauauagugagcucuguuaacaugauuucccgcaugcugaucaauagauucacgaugaaacacaagaaagccaccuaugagccagauguagaccucggaucagguacaaggaacaucggcauugagagcgaaauacccaacuuagacaucauugggaagcgaaucgagaagauuaaacaggaacaugagacuucguggcacuacgaucaagaccauccuuauaagaccugggcauaccacggaucuuaugaaacaaaacagacuggcagugccuccagcauggugaauggugucgugcggcugcuuaccaagccaugggauguugugcccauggucacacagauggcuaugaccgacacuacgccguuugggcagcaacguguguucaaagagaagguagauacaagaacccaggagccuaaggaaggaacuaaaaagcugaugaaaaucaccgcggaguggcuauggaaggaacucggcaaaaagaaaacaccccgcauguguacgagggaggaguuuacccggaaggugagaucaaacgccgcacugggcgcuauauucacugacgaaaauaaguggaaauccgcccgcgaggcaguugaagaugggagguuuugggaguuggucgaccgagaacggaaccugcaccucgagggaaagugcgagacauguguguacaauaugauggguaaaagagaaaagaaacuuggcgaguucgggaaggccaagggaucuagggcuaucugguauauguggcugggcgcccgcuuuuuagaauucgaggcgcuggguuuuuugaacgaagaucauugguucagccgugggaauagucucuccggaguggagggcgagggccugcaccggcuaggguacauucuuagagacgucggaaaaaaggaagguggcgcaauguacgccgaugacaccgcugggugggacacuaggaucacacuggaggaucucaaaaacgaagagaugguuaccaaucauaugaagggagaacacaaaaagcuggccgaggcaauuuuuaaguugacauaucagaacaaagugguacgcgugcagcgaccaacuccucggggcaccgucauggacaucauuagcagaaaggaucaaagggguucugggcaggugggaacguacggccugaauaccuucacaaacauggaggcucagcucauacgccaaauggaaggcgaggggaucuucaaaucaauucagcaucuuacugccaccgaagagaucgcuguucagaauuggcugacaagagugggacgggagagguuaagucguauggccaucuccggugacgauugcgucgugaagcccauugacgaucgauuugcaagcgcgcugacugccuugaacgacaugggcaaaguacgcaaggauauacagcaaugggaaccaucuagaggguggaaugacuggacccagguucccuucugcucgcaccacuuucaugagcucgugaugaaggauggacggguccugguggugccuuguaggaaccaggacgaacuaaucggccgcgcuagaauuucacagggugccggguggagccuuaaagagacggcaugccugggaaaguccuaugcucaaauguggacacucauguacuuccaccggagggaucugcgauuggccgcaaacgccaucuguagugcggucccaucucauuggguuccgaccagccguacuacaugguccauucacgcuaaacacgaauggaugaccacugaggacauguuagccguguggaauagaguauggauccaggagaaccccuggauggaagacaagaccccuguggagucaugggaagaggucccauaucugggcaaacgcgaagaucaguggugcggcagucucauagggcuuacaucucgggcaacgugggccaagaauauccagaccgcuauuaaccaagugaggagccugaucggaaaugaggaguacacugacuauaugcccuccaugaagagauuucgccgggaagaggaagaggccgguguucuaugguga

SEQ ID NO: 14741 - RNA, 9876 nt, Artificial Sequence
  derived and/or modified CDS sequence (opt3) from DENV-2__EU482608__SS-prME
accgccggagugauaauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaauacaguaugagggugacgggucuccaugcaagauccccuucgaaauuacggauuuggagaaaaggcauguacucggccggcugaucaccguuaacccgaucgugauugaaaaggacuccccugucaacauagaggccgaacccccauuuggagauagcuacaucauuaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaauagggaaggcccugcaccagguguucggcgcuaucuacggagcggcauuuaguggcguuagcuggacuaugaaaauucuuaucggggugguaauuaccuggaucggaaugaacuccagaucuacgagcuugucagucagucuggugcucguuggcguggucacacuguaucuuggugccauggugcaggcugacuccggguguguagugagcuggaagaauaaagaacugaagugcggaucuggcauauucauuaccgauaacguucacacuuggacagagcaguacaaguuucaacccgaaucaccaaguaaauuggccagcgcaauccagaaggcccaugaggaagguauuuguggcaucagguccgucacccggcucgagaaucugauguggaaacagauaacucccgaguuaaaccacauccugucugaaaaugaggugaagcuaaccauuaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguauuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauucccaagaauuucgcaggccccgucagccagcacaacuaccgaccugguuaucauacucaaaccgcuggcccauggcaccucgggaagcuggaaauggauuuugacuucugugagggaacaacugugguugugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggucaauagucuggugaccgcgggacauggccagauagauaacuuuagcuuagguguucucggcauggcccuguuccuugaagagaugcugcgcacucgaguggggacaaaacacgcuaucuugcucguagcagucucguuugugacccugauuacgggaaauauguccuuccgggaccuaggccgugugauggucaugguuggggccacuaugaccgaugacaucggaaugggcgugacauaucuggcucuccuggccgcauuuaagguaagacccaccuucgcggccggucuuuugcugaggaaauuaacuucuaaggagcucaugauggcuacaauugggaucacccugcuuagccagucaacaauaccugaaacuauccuggagcuaaccgaugcccucgcacugggaaugaugguguugaaaauuguccgcaacauggaaaaguaccaacuggcugugacgaucauggccauuaguugcguucccaaugcagugaucuuacggaacgccuggaaggucuccuguacaauacucgcugcggugucuguuagcccacugcuucugaccuccucacagcagaaagccgacuggauuccuuuggcacucacuaucaagggccugaaucccaccgcuaucuuucuaacaacucugagcagaaccaguaaaaagaggucuuggccacuuaacgaggccauuauggccgugggcauggucuccauacucgcuagcucgcuguugaaaaaugacaucccgaugacggggccucugguagcaggagguuuacucacagugugcuauguucugaccggccgaucagccgaucuugaacuggagcgcgcggcugacgugaagugggaggaucaggccgaaauuucugggaguucccccaucuugagcauuacuaucucugaggacggaagcauguccaucaagaacgaagaggaggaacaaacacucaccauccugauucggacuggccuacuggucaucucagguguguucccaguaaguauucccaucacagcagccgcuugguaccuuugggaggugaagaagcagagagcagggguccucugggauguuccuagcccacccccugugggaaaagccgaacuggaggacggcgcguauaggauaaagcagcguggcauuuugggguacucucagaucggagcugguguguauaaagaaggcaccuuucacacgauguggcaugucacucgcggggccguguuaaugcaccggggaaagagaaucgagccguccugggcagauguuaaaaaggaccugauuucauacggcgguggguggaagcucgagggagaauggaaagagggcgaagagguacaagugcuggcccuugaaccaggcaagaaucccagggcuguccagaccaaaccugggaucuucaagacaaacaccggaacaauaggugccgugagucuggauuuuagcccaggcacuuccgggucucccauuguugaccgaaaaggaaagguggucggcuuguacgguaauggggugguaacccggucgggagcauaugucagcgcuaucgcccagacggagaagucaauugaggauaacccugaaaucgaggacgauauauuccgcaaaaagagacuaacaauuauggaccugcauccgggcgcgggcaaaacuaagagguaccuccccgccaucgugcgggaagcaaucaaacgagggcugagaacccuuauuuuagcuccaacacgcguuguggccgcugagauggaagaggcacugaggggacucccuauccguuaucagacccccgccauuaaggccgagcacacuggucgggaaauagucgacuugaugugucaugcuaccuucacaaugagacugcucuccccagugaggguuccuaacuacaaucugaucauuauggaugaggcgcacuuuacggaccccgcaaguaucgccgcucgcggcuauaucucuacucgaguggaaaugggggaggccgcaggaauuuucaugaccgccacaccaccgggcagcagagauccuuuuccccaauccaacgcuccaauaauggacgaggaacgggagauccccgaaaggucauggaacucuggucacgagugggucaccgauuucaaggggaaaacugugugguuuguaccuagcauuaaggcgggaaacgacaucgccgcaugccuucgcaaaaauggcaagaaagugauucagcugagucguaagacauucgauuccgaauacguuaagaccagagcuaacgacugggauuuugucgugacgacugacaucagcgagaugggcgccaauuucaaagcagagcgggugauagauccaaggcgcuguaugaagcccgucaucuugacagacggggaagaacgaguaauucuagccggaccuaugccggugacccauucuucagcugcccagagacgggguaggaucggccgcaaccccaaaaaugaaaacgaccaauauauuuacaugggggagccccuggaaaaugaugaggacugcgcgcacuggaaggaggcaaaaaugcucuuagauaacaucaauaccccugaaggaauaauucccuccauguuugagccagaaagagagaagguugacgccaucgauggcgaauacaggcugcggggugaggcucguaaaacuuucguggaccuuaugcgccgaggggaucugccugucuggcucgccuauaagguggcugcagagggcauuaacuacgccgacagaaagugguguuuugauggaaucaaaaauaaccagauauuggaagagaacguugaaguggagaucuggacaaaggagggcgaaaggaaaaagcugaaaccccgguggcucgacgcucgcauuuauagugauccacuggcccuuaaggaguucaaggaguucgcagcggggagaaaaagccuaacccugaauuugaucacagagaugggaagguuaccuacuuuuaugacgcagaaggcccggaacgcucuggacaaucucgccguccugcauaccgcagaagcugguggccgagccuacaaccacgcacuuucggagcugccggagacacucgaaacuuugcugcuacugacccuccuugccacagugaccgggggaauuuuccuguuuuuaaugucuggcaaagguaucgggaagaugacuuugggcaugugcugcauaauuacggcuuccguacugcucugguaugcgcagauccaaccccacuggaucgccgcaagcauuauccuggaguucuuucuuauagugcugcucauuccagaaccugagaaacagagaaccccacaggauaaucaguugacauacguugucaucgcuauucugacugugguggccgccaccauggcaaacgaaaugggauucuuagagaagacaaagaaagaccuaggccuggggucaaucaccacucaagagagugaaucuaauauacucgacaucgaucuucgcccagcuuccgccuggacacuguaugcggucgcuacgaccuuuguuacuccuauguugaggcauagcauugagaacucaagugugaauguaagccugacagccaucgcaaaccaggccaccgugcucaugggacuggguaagggcuggccccuuuccaaaauggacauuggggucccgcuccuggcuaucggauguuacucucaggugaauccaauuaccuugacagcagcccuguuacuacugguugcgcacuacgcuaucauaggcccuggucuccaggccaaggcaacucgggaagcccaaaaacgugcugccgcagggauuaugaagaaccccacgguggauggcaucaccgucaucgaccuugagccaauucccuaugauccuaaguucgaaaaacagcugggacagguaauguugcugauacucugcgugacacagguucugaugaugagaacuaccugggcucuuugugaggccuuaacacuggcgaccggcccgaucagcacucucugggaggggaaucccggaagguuuuggaacacgacaauugccguguccauggcaaauaucuuccgcggcucauacuuggcuggugccgggcugcuauuuucuauuaugaagaacaccacuaauacccggcgaggaacaggcaacaucggugaaacucugggcgagaaauggaagaguagacucaacgcacuugggaaaucggaguuccaaauauauaagaaaagcggaauccaggaggucgacaggacccuggcuaaggagggcauuaagcgcggggaaacagaucaucacgccgugucccggggaucugccaaauugagaugguuugucgagcguaauauggugacgccagaaggcaagguuguggaccuggguugcgggaggggaggcuggucauacuauugugguggccucaaaaacguacgggaggugaaggggcugaccaaaggaggcccugggcaugaagaaccaaucccuaugagcacuuacggauggaauuuaguccgccuucaguccggcguugauguguucuucacaccacccgagaagugcgacacccugcucugugauauuggugaaaguucuccuaacccaacuaucgaggcggggcgaacacuaagaguccugaauuugguggaaaacuggcugaauaacaauacccaauuuugcauaaagguacucaaccccuauaugccgagcgugauugagaaaauggaaacgcuucagaggaaguacggaggcgcucugguucggaauccuuugucacgcaacuccacccacgagauguacugggugaguaaugcaacaggcaacaucgucagcucugugaauaugaucuccagaaugcugauuaacagguucacuaugaaacacaagaaagccaccuaugagccagacgucgaucucgggucaggaacacgaaacauagguaucgaaagcgagauucccaauuuagacaucauuggcaagcggaucgaaaagauaaaacaggagcaugaaacuucguggcacuacgaccaggaucauccuuauaagaccugggcuuaccacgggucuuaugagacaaaacaaaccggaagugccuccagcauggugaacggcguuguacgucugcuuacuaagccaugggacgugguccccauggugacgcagauggcaaugacagauaccacuccguuuggucagcagagaguuuucaaagagaagguggacacccgcacacaagaaccuaaggaggggacgaaaaggcugaugcggaucaccgccgaauggcuauggaaggagcucggcaaaaagaaaacucccagaauguguacacgcgaggaauuuaccaggaagguccgaucaaaugcugcgcugggcgccauuuucacugaugagaacaaauggaaguccgcacgggaagcuguggaggacggcagauuuugggaauugguagauaaggagaggaaucugcaccucgaggggaaaugcgaaacauguguguacaacaugaugggaaagcgcgagaagaaacuuggugaguucggcaaagccaaagggucucgugcaaucugguauauguggcugggagcccgguuuuuagaguucgaagcucugggcuuuuugaaugaggaccauugguucagcagagguaacagucucuccgggguugagggagaaggccugcacaggcuaggcuacauucuucgcgaugucgggaagaaagagggaggugccauguacgcggacgauaccgcaggcugggacacacgaaucacucuggaagaccucaagaaugaggaaauggugaccaaccauaugaaaggggagcacaagaaacuggccgaggcuauuuuuaaguugacguaucagauaaaggugguccggguucagagaccaaccccuaggggaacagugauggauaucauuagccgcagagaccagcggggcucuggucaaguagggacuuacggacugaauaccuucacaaacauggaagcccagcucaucaggcagauggagggcgaaggcaucuucaaaucaauucaacaucuuacugcaaccgaggagauagcugugcagaauuggcuggcccgugucgggcgagaacgcuuaaguagaauggcuaucuccggagaugacugcgugguuaagcccauugaugaccgguuugccagcgcacugacggcguugaacgauauggguaaagugaggaaggacauccagcagugggagccaucucgcggcuggaaugauuggacacaaguccccuucugcucgcaccacuuucaugaacucgugaugaaagacgggagaguacugguugugccuugucggaaccaggaugagcuaauuggaagggcccgaaucucacagggcgcugguuggagccuuaaggaaaccgccugccuggggaaguccuaugcacagauguggacucucauguacuuccaccguagagaccugcgcuuggcugccaacgcaauauguagugccgucccaucucauugggugccgacaagccggaccacuugguccauccacgcgaaacacgaguggaugaccacagaggauauguuagcuguguggaauagggucuggauucaagaaaaccccuggauggaggacaagacgccuguugaaucaugggaggaagugccauaucugggaaaaagagaggaccaguggugcggcagucucaucggccuuaccucucgcgccacuugggcaaagaauauucagacagccaucaaccagguacggagccugauagggaaugaggaauacaccgauuauaugcccuccaugaaaagguuucgaagagaggaagaggaagcuggagugcuaugguga

SEQ ID NO: 14742 - RNA, 9876 nt, Artificial Sequence
  derived and/or modified CDS sequence (opt3) from DENV-2__EU687220__SS-prME
accgcaggcgugaucauuaugcugauacccaccgcuauggcauuccaccucacuacgcgaaacggggaaccucauaugaucgucgggaggcaggaaaaggguaaaagccuucuguuuaagaccgaagacggcguuaauaugugcacauugauggcaauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagaaggcacucauuuucauccugcugacugccguugcuccauccaugacaaugcgcugcauagggauuucuaacagagauuuuguggaaggagucucggguggcucauggguggacaucguacucgagcacgggagcuguguuaccacuauggccaagaauaaacccacauuagauuucgaacugauuaagaccgaggcgaaacagccugcaacgcuuaggaaguauugcaucgaagccaaauugaccaacacaacuaccgagagucgguguccaacacaaggagagcccucccugaaugaagaacaggacaagcgcuuuaucugcaagcauucuaugguggaucgaggcugggguaacggguguggacuauucggcaaaggcgggauugucacuugcgcuauguuuaccugcaagaaaaauauggaaggaaagguggugcucccugagaaccuggaauacacaauagucaucaccccacacagcggugaggagcaugccguuggcaaugacacugggaaacacggaaaggaaauuaaaaucacgccgcaguccucaauaacagaggcagaacuuaccggcuaugguacugugaccauggaguguagucccagaacagggcuggauuucaacgaaaugguauugcuccagauggaggagaaggcuuggcuggugcacaggcaaugguuuuuagaccugccucucccauggcuucccggcgccgauacccagggaagcaauuggauucagaaggaaacucuggucacauucaaaaacccucaugcgaagaaacaggacgugguuguguugggcucucaagagggggccaugcacacggcacuaaccggagcuacugaaauccagauguccucagguaaucugcucuuuacaggccaucugaagugccggcuucguauggacaaacugcaguugaaggggaugagcuacaguauguguaccggaaaguucaaaaucgucaaggagauugccgagacacaacacggcacuaucgugauucgcguacaguaugaaggugaugggucuccaugcaaaauacccuucgagaucauggaccucgaaaagagacauguucugggcagguuaauuaccgugaacccgaucgucacggagaaagauuccccuaucaacauugaagcugagcccccauuuggagacagcuacauaaucauuggcguggagccugggcagcugaagcuaaauugguucaagaaaggaucgucuaucggucagauguuugaaaccacaaugcggggcgccaagcgaauggcaauucucggggauacugccugggacuucggaucccugggcggugucuuuaccucaaucgggaaagcacuucaccaaguguucggcgcgauauacggagcagccuuuaguggcguuagcuggacaaugaagaucuugauuggggugaucauuacuuggaucggaaugaacucccgcucuaccagccugucaguaagucucguccuggugggcguugugacgcuuuaucugggugcuaugguccaggccgauuccgggugugugguaagcuggaaaaauaaggaguugaagugcggaucuggcauauucauuacagacaacgugcacaccuggacugaacaguacaaauuucagcccgagucaccaaguaagcucgcaagcgccauccaaaaagcucaugaagaggguauuuguggcaucagauccguuacaaggcuggagaauuuaauguggaagcagauaacccccgaacugaaccacauccuaucugagaaugaagucaaacucacuauuaugaccggggauaucaagggaauuaugcaggccggcaaacggucgcugcgcccucagccaacagagcuuaaguauagcuggaagacgugggggaaagcaaagauguuguccaccgaaucacauaaccaaacuuuccugaucgacggaccggagacagcggagugccccaauaccaacagagcuuggaauagucucgaaguggaggauuacggcuuugguguguucucuacaaacauauggcugaaauuaagggaaaagcaggacgucuuuugugacagcaaacugauguccgccgcaauuaaggauaaucgugccguucacgcugacaugggguauuggaucgagucagcccuuaacgauacuuggaagauggagaaagccagcuucaucgaagugaagucuugccacuggccuaaaucccauaccuuguggaguaauggagugcucgagagcgaaaugauuaucccaaagaacuucgcuggccccguaucucagcacaacuaccggccugguuaucauacgcagacagccggcccauggcaccuggggaaacuagagauggacuuugauuucugugaaggaaccacugucgugguuaccgaggacugcggcaaucgagggcccucccugagaacaacuaccgcgucaggaaagcucauuacagaguggugcuguaggaguugcacgcugccgccucuucgcuaccggggcgaagaugguuguugguacgggauggagauaagaccauugaaggaaaaagaggaaaaccuggugaauagcuuagucaccgccggacauggccaaaucgacaacuuuucgcucggugugcugggcauggcucuuuuccuggaggagauguugaggacucgcguugggacaaagcacgcaauucuccugguggccguauccuuugucacccuaaucacuggaaauaugucuuuccgagaucugggccgggugauggugauggucggggcuacaaugaccgacgauauuggaaugggcguuacguaucucgcccugcuugcagcguuuaaagugcgucccacuuucgccgcugguuugcuguuaagaaagcucaccagcaaagaacugaugauggccacaaucgggauagcacuucugucacagaguaccaucccugagacuauucuagaacucacagacgcucuggccuugggaaugaugguacugaagaucgugaggaacauggagaaguaccaguuagcagucaccauuauggccaucuccugcgugcccaaugcuguuauacuccugaacgcguggaaagugucuuguacaauucuugccgcagucagcguguccccacuguugcucacuucaagccaacagaaggcugauuggaucccucuggcccuaaccaucaaaggccugaaucccacggccauuuuucuuacaacccucagucgcacuucuaagaaacgguccuggccacugaacgaagcuguuauggcagugggcauggucagcauauuggccucgucacuguuaaagaaugacaucccgaugaccgggccucucguagcgggaggucugcuuacagugugcuauguucugacuggcagaucugcugacuuggagcucgagagggccgcagaugugaaaugggaagaccacgccgagauuaguggguccagccccauccugucuauuaccaucagcgaagauggauccaugucaauaaagaacgaggaggaagaacagacgcuaacaauccugauucgaaccggccuucucgucaucagugguguguucccaguaagcauucccaucacugcugcagccugguaccugugggaagugaagaaacagcgcgcgggggucuugugggacguuccuucuccacccccugugggaaaggcugaguuagaagauggcgccuaucggauaaaacaaagaggcauucugggguacucccagaucggagcugguguguauaaggagggcacauuucauaccauguggcacgucacuagaggggcagugcucaugcaucguggaaaacgcaucgagccgucaugggcugacguuaagaaggaucugauuaguuacggcgguggguggaaacuugaaggagaguggaaggaaggcgaggaaguacaggugcuggccuuggagccaggcaaaaauccccgggcaguccagacaaagccugggcuauucaaaaccaacacgggaacuaucggugcugugagccuggacuuuuccccaggcaccucugggucgcccauaguugauagaaagggaaagguggucggccucuacgguaauggggugguaacaaggagcggagccuaugucucagcgauugcccaaaccgagaaauccaucgaagacaacccugagauugaagaugacaucuuccgaaagaaacggcugacaauaauggaucuucacccgggcgcaggcaagacuaaacgcuacuuacccgcuauugugagagaggccaucaagagggggcugcggacccucaucuuggcuccaacgcgaguuguggcagccgaaauggaggaggcccugagaggacucccuauucgcuaucagacacccgcuaucagggcggaacauacuggucgugagauugucgaccugaugugucacgcaaccuucacaaugcggcuucugaguccagugagaguuccuaacuacaauuugauaaucauggacgaagcccacuuuaccgaucccgcuucuauugccgcaaggggcuauaucagcacucgcguggagaugggggaggccgcuggaaucuucaugaccgcgacaccaccgggcucccgagacccuuuuccccagucaaacgccccaauuauggaugaagagagagaaauacccgagcggucuuggaauagcggucaugaaugggucacggacuucaaggggaaaacugugugguuuguaccuaguaucaaggcaggaaacgauauugcugccugccuaaggaaaaauggcaagaaagugauccagcugucccgcaagaccuucgacagcgaguacguuaagacacgugcaaacgauugggacuuugucgugaccacugauauuucugagaugggcgccaauuucagagcugaacgggugaucgacccaaggcgcuguaugaaacccgucauacucacagauggggaggaacgaguaaucuuagccggaccuaugccggugacccacucauccgcggcacaaagacgggguaggauuggccgcaacccaaagaaugagaacgaccaguauaucuacaugggggaaccccuggagaaugacgaggauugcgcccauuggaaagaagcuaagaugcuucuggacaacauuaauacgccugagggaaucauacccaguauguuugaaccagagagagaaaaaguugaugccauugacggcgaguacaggcuccggggugaggcucguaagacuuucguggauuugaugcgccgaggggaccugccugucuggcucgcauauagaguggccgcugaaggcaucaacuacgccgauaggcggugguguuuugacggaauuaaaaauaaccagauccuggaggaaaacguugagguggagauauggacaaaggaaggcgagcgcaagaaacuuaagcccagauggcuagaugcaaggaucuauagcgacccacuggcguugaaagaguucaaggaguucgccgcugggcggaaaucguuaacccugaaucucauuaccgaaaugggacgacugccuacuuuuaugacacaaaaggccagagaugcacuugacaaccuggcuguccuccacaccgccgaggccgguggacgcgcauacaaucacgcuuugucugagcugccggaaacacuagagacucugcuccuucugacguuauuggcgaccgugacagggggaaucuuccuguuucucauguccggcaaggguauugggaaaaugacucugggcaugugcugcaucauaaccgccagcauucuucugugguaugcacagauccagccccauuggaucgcugccucaauuauccucgaguucuuuuugauaguacuguuaauuccagagccugaaaagcagaggacaccccaagauaaccagcuaaccuacgugguuaucgccauucugacugucguggcagcuacgauggccaaugagaugggauuccucgagaaaaccaagaaagaccuuggccuggggaguaucacaacucaggaaucugaguccaacauauuggacaucgaucugcggccagcgagcgcuuggacccucuaugccguggcaacaaccuuugucacuccuaugcugcgucacucaauugaaaauaguagcguuaacgugucccuuacagccaucgcuaaucaggcaacgguacucaugggacuggguaagggcuggcccuugucuaagauggacauuggggugccgcuguuagccaucggauguuacagccaagucaacccaauuacccuaacugcggcucugcuccuucugguggcccauuacgcaaucauaggcccugguuugcaggccaaagcuacaagagaggcccagaagagggcagcugccgggauuaugaaaaaucccaccguugauggcaucaccgugaucgaccuggaaccaauucccuaugauccuaaguucgagaaacagcucggacaagucaugcugcuuauauuaugcguaacacaggugcugaugaugcgcacuacgugggcgcucugugaggccuugacccuggcaacaggcccgaucuccacucuaugggaagggaaccccggacgguuuuggaauaccacaauugcuguuucaauggccaacaucuuccgaggcucuuaccuggccggugcugggcuccuuuuuaguauuaugaagaauaccacuaacacgagaaggggaacaggcaauaucggugagacccugggcgaaaaguggaaaucgcgcuugaacgcccugggaaagagcgaguuccagauauauaaaaaguccggaauccaggagguggaccggacucucgccaaagaaggcauuaagagaggggagaccgaucaccaugcggucucucguggaucagcuaaacugaggugguuuguggaacggaacauggucacaccagagggcaaggugguugacuuagguugcgggcgcggaggcuggagcuacuauugugguggccuuaagaaugugcgagaaguaaaagggcugacuaagggaggcccugggcacgaggagcccaucccuauguccaccuacggauggaaccucgugagacuacaaaguggcgucgauguuuucuucacaccacccgaaaaaugcgacacgcuguugugugauauuggugagucuagcccuaauccaaccaucgaagcagggaggacucugcgggugcucaaccuugucgagaauuggcugaacaauaacacacaguuuugcauaaagguguugaaucccuauaugccgucaguaauugagaaaauggagacccugcagcgcaaguacggaggcgcccucgugagaaacccuuuauccaggaauaguacucacgagauguacuggguuagcaacgcuacaggcaauaucgugucuuccgucaacaugaucucacgaaugcugauuaaucgguucaccaugaagcauaaaaaggccacguaugaaccagacguggaucuugggagcggaacccguaacauagguaucgagucggaaauucccaaccuggacaucauuggcaaaagaaucgagaagauaaaacaagaacacgagacaucuuggcauuacgaccaggaucacccuuauaagacuugggcauaccacgggaguuaugagaccaagcagacaggauccgccagcucaauggucaauggcgugguucgccuacucacuaaaccaugggacguagugcccauggucacccagauggcuaugacagauaccacuccguuuggucaacagaggguguucaaggaaaaaguugacacgcggacacaggagccuaaggaagggaccaaaaagcugaugagaaucacugcggagugguuguggaaggagcugggcaaaaagaaaacaccccgcauguguacaagggaagaguuuacgcgaaaggugcgguccaacgccgcacucggcgcuauuuucaccgaugaaaauaaauggaagucugccagagaggcagucgaagacagcagguuuugggagcuuguggaucgcgagcguaaccugcauuuagaaggcaaaugcgagacuuguguauacaauaugauggggaagcgggaaaagaaacugggagaguucgguaaggccaaaggcaguagagcuaucugguauaugugguugggggccagguuucucgaguucgaggcgcugggauuucuaaacgaggaccacugguucucccgcggcaauagccuuucugguguggaaggggagggacugcaucgacucggcuacauucugcgggauguuucaaagaaagaaggcggggcaauguacgccgacgauacagcuggaugggacaccagaaucacuuuggaggaccugaagaacgaagagauggucacaaaucacaugaagggugagcauaaaaagcucgccgaagcaauuuuuaaacuuaccuaucagaacaagguggugaggguccaacgcccaacaccuagaggcacuguuauggauauaaucagucggagggaccagcguggguccggacaggugggcaccuacggucugaauacguucaccaacauggaggcucaguuaauucgacaaauggaaggggagggaaucuucaaaagcauccagcaccugacaguaacugaggaaauugccgugcagaauugguugguccgcgugggcagagagcggcucucuaggauggcuauaucgggcgaugacugcguugugaagccccuggaugaccgcuuugccucagcacuaaccgcgcuuaacgauauggggaaggucagaaaagacauccaacagugggaaccaagccggggauggaaugauuggacacaggugcccuucugcucccaccauuuucacgagcugguaaugaaggacgguaggguucucguggucccuugucgaaaccaggaugaacugauuggccgugccagaaucagucaaggggcuggauggucuuugaaagagacugccugcuuaggcaagagcuaugcacagauguggacccugauguacuuccaucgccgggaccucaggcuugcugccaacgcaauuuguuccgccgugccaucacacugggugccgacgaguagaacaaccuggucuauccacgcgaaacaugaguggaugacuacagaagauaugcuggcugucuggaaucgcguuuggauacaggagaaccccuggauggaagacaagaccccuguggagagcugggaagagguaccauaucuagguaagcgggaggaccaguggugcgggucccugaucggacucacuucaagggccaccugggccaaaaauauucaaacagccaucaaccaggugaggagcuugauuggcaaugaagaguacacggauuauaugcccucuaugaagagauuucggagggaagaggaagaggcuggcguccugugguga

SEQ ID NO: 14743 - RNA, 9876 nt, Artificial Sequence
  derived and/or modified CDS sequence (opt3) from DENV-2__EU726775__SS-prME
accgccggagugaucguaaugcugauucccacggcuauggcauuccaccucacuacgcguaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaucaaaggaauuaugcaggcuggcaagcgcucgcucagaccucaaccaaccgaacugaaauauagcuggaagacuugggggaaggccaaaaugcuuuccacagagucacauaaccagaccuucuugaucgauggaccggaaacagcagagugccccaauacuaacagggcguggaauagucuggaggucgaagacuacggcuuugguguuuucaccacgaacauuuggcucaagcugcgugagaaacaggacguguuuugugauucuaaguuaaugagcgcugccaucaaagacaaucgggcagugcacgccgauaugggguauuggauagaauccgcucugaacgacacauggaagauggagaaggccucauucauugagguaaaaagcugccacuggccuaagucucauacccuuugguccaauggagucuuggaaagugagaugaucauccccaagaauuucgcaggccccgugagccagcacaacuaccgaccugguuaucauacucaaaccgcuggcccauggcaccucgggaagcuggaaauggauuuugacuucugugagggaacaacuguuguggucaccgaagauugcggcaauagagggcccucucuaaggacaacgaccgccuccggaaaacugauuacugaguggugcugucgcucaugcacacucccgccucugcgguacagaggcgaggacgguuguugguacgggauggaaaucaggccacuuaaggagaaggaagagaacuuggugaauagucugguuaccgcgggacauggccagauugauaacuuuagcuuaggugugcucggcauggcccuguuccuugaagagaugcugcgcacucgaguagggacaaaacacgcuauauugcucgucgcagugucguuugugacccugaucacgggaaauauguccuuccgggaccuaggccgugucaugguuauggugggggccacuaugaccgaugacauuggaaugggcguaacauaucuggcucuccuggccgcauuuaaggugagacccaccuucgcggccggucuuuugcugaggaaauuaacuucuaaggagcucaugauggcuacaaucgggauugcccugcuuagccagucaaccaucccugaaacaauacuggagcuaacugaugcacucgcucugggaaugauggucuugaaaaucgugcgcaacauggaaaaguaccaacuggccguuaccauuauggcaaucaguugcgugcccaaugccgucauuuuacagaacgcuuggaagguguccuguacgauccucgcggccguuucugugagcccacugcuucugacauccucacagcagaaagcagacuggauaccuuuggcucucaccauuaagggccugaaucccacugccaucuuucuaaccacacugagccggacaaguaaaaagagaucuuggccacuuaacgaggccaucauggcugucggcaugguauccauucucgcaagcucgcuguugaaaaaugacauaccgaugaccgggccucugguggccggagguuuacucacgguuugcuaugugcugacaggcaggucagcggaucuugaacuggagcgagcugccgacgucaagugggaggaucaagcagaaaucucugggaguucccccauuuugagcaucaccauuucugaggacggaagcauguccaucaaaaacgaagaggaggaacagacucucacaauacugauccgcaccggccuacuggugauuucagguguauucccagugaguauccccauuacugccgcugcaugguaccuuugggaggucaagaagcagcgggccgggguucucugggaugugccuagcccacccccugugggaaaagcggaacuggaggacggcgcuuauagaaucaagcagaggggcauauugggguacucucaaauuggagccggugucuauaaagaaggcacauuucacaccauguggcaugugacgcguggggcaguuuuaaugcaccgcggaaagcggaucgagccguccugggccgaugucaagaaggaccugaucucauacggcgguggguggaagcucgagggagaauggaaagagggcgaagaggugcagguccuggcucuugaaccaggcaagaaucccagagccgugcagacuaaaccugggauuuucaggaccaacacaggaaccaucggugcaauaagucuggauuuuagcccaggcacauccgggucucccauuguugaccgaaagggaaaaguggucggcuuguacgguaauggggugguaacucggucgggagcuuaugucagcgccaucgcgcagaccgagaagucaauugaggauaacccugaaaucgaggacgauauauuccgcaagaaaagacuaacgauuauggaccugcauccgggcgccggcaagacaaaaagguaccuccccgcaaucgugcgggaagcuaucaagcgagggcugagaacucuuauuuuagccccaacccgcguuguggcugcagagauggaagaggcccugaggggacucccuauccguuaucaaacacccgccauuaaagcugagcacaccggucgggaaauagucgacuugaugugucaugcgacuuucaccaugagacugcucuccccagugaggguuccuaacuacaaucugaucauuauggaugaggcacacuuuacagaccccgccaguaucgcugcccgcggcuauaucucuacgcgaguggaaaugggggaggcagccggaauuuucaugacugcuaccccaccgggcagcagagauccuuuuccccaguccaacgcgccaauaauggacgaggaacgggagauccccgaaaggucauggaacucuggucacgagugggucacagauuucaaggggaagaccgugugguuuguaccuagcauuaaagccggaaacgacaucgcagcuugccuucgcaagaauggcaaaaaggugauucagcugagucguaaaacuuucgauuccgaauacguuaagacaagagccaacgacugggauuuugucgugaccacggacaucagcgagaugggcgcaaauuucaaggccgagcgggugauagauccaaggcgcuguaugaaacccgucaucuugacugacggggaagaacgaguaauucuagcuggaccuaugccggugacacauucuucagccgcgcaaagacgggguaggaucggccgcaacccaaagaaugaaaacgaccaguauauuuacaugggggagccccuggaaaaugaugaggacugcgcacacuggaaagaggccaagaugcucuuagauaacaucaauaccccugaaggaauaauucccuccauguuugagccagaaagagagaaaguugacgcuaucgauggcgaauacaggcugcggggugaggcccguaagaccuucguggaccuuaugcgccgaggggaucugccugucuggcucgcuuauaaaguggcagccgagggcauuaacuacgcugacagaaagugguguuuugauggaaucaagaauaaccagauauuggaagagaacguugaaguggagaucuggacuaaagagggcgaaaggaagaaacugaagccccgguggcucgacgcccgcauuuauagugauccacuggcacuuaaagaguucaaggaguucgcggccgggagaaagagccuaacacugaauuugaucaccgagaugggaagguuaccuacauuuaugacucagaaagcucggaacgcccuggacaaucucgcaguccugcauacggcugaagccgguggccgagcauacaaccacgcccuuucggagcugccggagacccucgaaacauugcugcuacugacucuccuugcuaccgugacagggggaauuuuccuguuuuuaaugucuggcaaggguaucgggaaaaugaccuugggcaugugcugcauaauuacugcguccauccugcucugguaugcccaaauccagccccacuggauugcagcuagcaucauacuggaguucuuucuuauuguacugcucaucccagaaccugagaagcagagaacgccccaggauaaucaauugaccuacgugguuauugccauccugacagucguggccgcaacuauggcuaacgaaaugggauucuuagagaaaaccaagaaggaccuaggccuggggucaauaacaacccaggagagugaaucuaauauccucgacauugaucuucgcccagccuccgcguggacucuguaugcuguggccacaacguuugucaccccuauguugaggcauagcaucgagaacucaaguguuaaugugagccugacugcaauugccaaccaggcuacaguacucaugggacuggguaaaggcuggccccuuuccaagauggacaucggggugccgcuccuggcaauuggauguuacucucaggucaauccaaucaccuugaccgccgcgcuguuacuacugguggcucacuacgccauaauuggcccuggucuccaagcaaaagccacacgggaagcucagaagcgugccgcagcugggaucaugaaaaaccccacuguugauggcaucacggugauugaccuugagccaauacccuaugauccuaaguucgaaaagcagcugggacaggucauguugcugauccucugcguaacccaagugcugaugaugagaacaacuugggcccuuugugaggcguuaacccuggccacaggcccgauuagcacccucugggaggggaaucccggaagguuuuggaacacuacgaucgcaguuuccauggcuaauauuuuccgcggcucauacuuggccggugcagggcugcuauuuucuaucaugaaaaacacaaccaauacucggcgaggaaccggcaacauaggugaaacacugggcgagaaguggaaaaguagacucaacgcucuugggaagucggaguuccagaucuauaaaaagagcggcauucaggagguggacaggacucuggccaaagagggcaucaagcgcggggaaaccgaucaucacgccgucucccggggaucugcgaaguugagaugguuuguggagcguaauauggucacaccagaaggcaaagugguugaccuggguugcgggaggggaggcuggucauacuauugugguggccucaagaacgugcgggagguaaaagggcugacgaagggaggcccugggcaugaagaaccaauuccuaugagcaccuacggauggaauuuagugcgccuucaauccggcgucgauguuuucuucacuccacccgagaaaugcgacacacugcucugugauaucggugaaaguucuccuaacccaaccauagaggcugggcgaacucuaagagugcugaauuuggucgaaaacuggcugaauaacaauacacaguuuugcauuaaggugcucaaccccuauaugccgagcguaaucgagaagauggaaacccuucagaggaaauacggaggcgcacuggugcggaauccuuugucacgcaacuccacgcacgagauguacuggguuaguaaugccaccggcaacaucgugagcucugucaauaugauuuccagaaugcugauaaacagguucacaaugaagcacaaaaaggcuacuuaugagccagacguggaucucgggucaggaacccgaaacaucgguauugaaagcgagauccccaauuuagacauuaucggcaaacggauagaaaagaucaagcaggagcaugaaacaucguggcacuacgaccaagaucauccuuauaaaacuugggccuaccacgggucuuaugagaccaagcagacaggaagugcauccagcauggucaacggcgugguucgucugcuuaccaaaccaugggacguagugcccauggucacucagauggccaugacggauacaaccccguuuggucagcaaagaguguucaaggagaaaguugacacucgcacccaggaaccuaaggaggggacaaagaaacugaugaagauuacggcugaauggcuauggaaagagcucggaaagaaaaagacccccaggauguguacucgggaggaauuuacaagaaaagugcgcucaaaugcggcccugggcgcaaucuucaccgaugagaacaaguggaaguccgcuagggaagccgucgaggacggccgauuuugggaauugguggaucgggagagaaaucugcaccucgaggggaaaugcgaaacuuguguauacaacaugaugggaaagagggagaagaaacuuggugaguucggcaaagcaaaagggucucgcgccauuugguauauguggcugggagcuagauuuuuagaguucgaagcccugggcuuuuugaaugaggaccauugguucagccgggguaacagucucuccgggguggagggagaaggccugcacagacuaggcuacauccuuagggauguugggaagaaagagggaggugcgauguacgcagacgauacagccggcugggacacccgcauuacacuggaagaccucaagaaugaggaaauggucacuaaccauaugaaaggggagcacaagaaacuggcugaggccauauuuaaguugaccuaucagaauaagguggugcgaguccagcggccaacgccuagaggaaccguuauggauaucauuagcaggcgcgaccaaagaggcucuggucagguggggacauacggacugaacacuuucaccaauauggaagcacagcucauccggcaaauggagggcgaaggcaucuucaggucaauucagcaucuuacagcuacugaggagauagccguacagaacuggcuggcucguguggggcgagaacgcuuaaguagaauggccaucuccggagaugacugcgucgugaaacccauugaugaccgguuugcaagcgcgcugaccgccuugaaugauauggguaagguuaggaaagacauccagcaaugggagccaucucgcggcuggaacgauuggacacaggugcccuucugcucgcaccacuuucaugaacucgucaugaaggacgggagagugcugguaguuccuugucggaaccaggaugagcuaauuggaagggcucgaaucucacagggcgccgguuggagccuuaaagaaacagcaugccuggggaaguccuaugcucaaauguggacccucauguacuuccaccguagagaccugcgcuuggccgcaaaugccauauguagugcggugccaucucauugggucccgacuagccggacaaccugguccauccacgcuaagcacgaguggaugacuaccgaggauauguuagccguguggaacaggguguggauucaggaaaaucccuggauggaggacaaaacaccugucgaaucaugggaggaaguuccauaucugggaaagagagaggaccaguggugcggcagucucaucggccuuacgucucgcgcaaccugggccaaaaacauucagacugcuaucaaucaagugcggagccugauagggaacgaggaauacacagauuauaugcccuccaugaagagguuucgaagagaggaagaggaagccggaguacuaugguga

SEQ ID NO: 14744 - RNA, 9876 nt, Artificial Sequence
  derived and/or modified CDS sequence (opt3) from DENV-2__FJ639732__SS-prME
accgccggagugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugaucgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucgugauuaccuggaucggaaugaacuccagaucuacgagcuugucaguuagucuggugcucgucggcgugguaacacuguaucuuggugccauggugcaggcugacuccggguguguugucagcuggaagaauaaagaacugaagugcggaucuggcauuuucaucaccgauaacgugcacacuuggacagagcaguacaaguuucaacccgaaucaccaaguaaauuggccagcgcaauacagaaggcccaugaggaagguauuuguggcaucagguccgugacccggcucgagaaucugauguggaaacagauuacucccgaguuaaaccacauccugucugaaaaugaggucaagcuaaccauaaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguugaagacuacggcuuugguguguucaccacgaacaucuggcucaagcugcgugagaaacaggacguguuuugugauucuaaguuaaugagcgcugccguaaaagacaaucgggcaguccacgccgauaugggguauuggauugaauccgcucugaacgacacauggaagauggagaaggccucauucaucgaggugaaaagcugccacuggccuaagucucauacccuuugguccaauggaguuuuggaaagugagaugauaauucccaagaauuucgcaggccccgugagccagcacaacuaccgaccugguuaucauacucaaaccgcuggcccauggcaccucgggaagcuggaaauggauuuugacuucugugagggaacaacugucgugguuaccgaagauugcggcaauagagggcccucucuaaggacaacgaccgccuccggaaaacugaucacugaguggugcugucgcucaugcacacucccgccucugcgguacagaggcgaggacgguuguugguacgggauggaaaucaggccacuuaaggagaaggaagagaacuuggugaauagucugguaaccgcgggacauggccagauugauaacuuuagcuuagguguccucggcauggcccuguuccuugaagagaugcugcgcacucgaguggggacaaaacacgcuaucuugcucguggcagucucguuuguuacccugauuacgggaaauauguccuuccgggaccuaggccgugugaugguaauggugggggccacuaugaccgaugacauaggaaugggcgucacauaucuggcucuccuggccgcauuuaaggugagacccaccuucgcggccggucuuuugcugaggaaauuaacuucuaaggagcucaugauggcuacaaucgggauuacccugcuuagccagucaacaaucccugaaacuauucuggagcuaaccgaugcccucgcacugggaaugaugguuuugaaaaucgugcgcaacauggaaaaguaccaacuggcugucacgauaauggccaucaguugcgugcccaaugcaguuauuuuacggaacgccuggaagguguccuguacaauccucgcugcggucucuguaagcccacugcuucugaccuccucacagcagaaagccgacuggauuccuuuggcacucacuaucaagggccugaaucccaccgcuauauuucuaacaacucugagcagaaccaguaaaaagaggucuuggccacuuaacgaggccauuauggccgugggcaugguuuccauccucgcuagcucgcuguugaaaaaugacaucccgaugacggggccucugguggcaggagguuuacucacagucugcuaugugcugaccggccgaucagccgaucuugaacuggagcgcgcggcugacguaaagugggaggaucaggccgaaauuucugggaguucccccauauugagcaucacuauuucugaggacggaagcauguccaucaaaaacgaagaggaggaacaaacacucaccauucugauccggacuggccuacuggugauaucaggugucuucccaguuaguauccccauuacagcagccgcuugguaccuuugggaggugaagaagcagagagcaggggugcucugggaugucccuagcccacccccugugggaaaagccgaacuggaggacggcgcguauaggaucaagcagcguggcauuuugggguacucucagaucggagcugguguuuauaaagaaggcaccuuucacacgauguggcauguaacucgcggggccguguuaaugcaccggggaaagagaauagagccguccugggcagaugucaaaaaggaccugauuucauacggcgguggguggaagcucgagggagaauggaaagagggcgaagaggugcaaguucuggcccuugaaccaggcaagaaucccagggcugugcagaccaaaccugggaucuucaagacaaacaccggaacaaucggugccgucagucuggauuuuagcccaggcacuuccgggucucccauuguggaccgaaaaggaaagguagucggcuuguacgguaauggggugguuacccggucgggagcauaugugagcgcuaucgcccagacggagaagucaauagaggauaacccugaaauugaggacgauaucuuccgcaaaaagagacuaacaauuauggaccugcauccgggcgcgggcaaaacuaagagguaccuccccgccaucguccgggaagcaauaaaacgagggcugagaacccuuauuuuagcuccaacacgcgugguugccgcugagauggaagaggcacugaggggacucccuauccguuaucagacccccgccaucaaggccgagcacacuggucgggaaauuguggacuugaugugucaugcuaccuucacaaugagacugcucuccccagucagggugccuaacuacaaucugaucauuauggaugaggcgcacuuuacggaccccgcaaguauagccgcucgcggcuauaucucuacucgaguagaaaugggggaggccgcaggaauuuucaugaccgccacaccaccgggcagcagagauccuuuuccccaauccaacgcuccaaucauggacgaggaacgggagauccccgaaaggucauggaacucuggucacgagugggugaccgauuucaaggggaaaacuguuugguuugucccuagcauuaaggcgggaaacgacauagccgcaugccuucgcaaaaauggcaagaaagugauccagcugagucguaagacauucgauuccgaauacgugaagaccagagcuaacgacugggauuuugucguaacgacugacauuagcgagaugggcgccaauuucaaagcagagcgggugaucgauccaaggcgcuguaugaagcccguuauuuugacagacggggaagaacgagugauccuagccggaccuaugccggucacccauucuucagcugcccagagacgggguaggauaggccgcaaccccaagaaugaaaacgaccaauauaucuacaugggggagccccuggaaaaugaugaggacugcgcgcacuggaaggaggcaaaaaugcucuuagauaacauuaauaccccugaaggaaucauucccuccauguuugagccagaaagagagaagguggacgccaucgauggcgaauacaggcugcggggugaggcucguaaaacuuucguugaccuuaugcgccgaggggaucugccuguguggcucgccuauaaggucgcugcagagggcauaaacuacgccgacagaaagugguguuuugauggaauuaaaaauaaccagaucuuggaagagaacguggaaguagagauuuggacaaaggagggcgaaaggaaaaagcugaaaccccgguggcucgacgcucgcaucuauagugauccacuggcccuuaaggaguucaaggaguucgcagcggggagaaaaagccuaacccugaauuugauaacagagaugggaagguuaccuacuuuuaugacgcagaaggcccggaacgcucuggacaaucucgccgugcugcauaccgcagaagcugguggccgagccuacaaccacgcacuuucggagcugccggagacacucgaaacuuugcugcuacugacccuccuugccacaguuaccgggggaaucuuccuguuuuuaaugucuggcaaagguauugggaagaugacuuugggcaugugcugcaucauuacggcuuccguccugcucugguaugcgcagauccaaccccacuggauagccgcaagcauuauccuggaguucuuucuuaucgugcugcucauuccagaaccugagaaacagagaaccccacaggauaaucaguugacauacguggucaucgcuauacugacuguuguggccgccaccauggcaaacgaaaugggauucuuagagaagacaaagaaagaccuaggccuggggucaauuaccacucaagagagugaaucuaauauccucgacauugaucuucgcccagcuuccgccuggacacuguaugcgguagcuacgaccuuugugacuccuauguugaggcauagcaucgagaacucaagugucaaugugagccugacagccauagcaaaccaggccaccguucucaugggacuggguaagggcuggccccuuuccaaaauggacaucggggugccgcuccuggcuauuggauguuacucucaggucaauccaaucaccuugacagcagcccuguuacuacugguagcgcacuacgcuauuaucggcccuggucuccaggccaaggcaacucgggaagcccaaaaacgugcugccgcagggauuaugaagaaccccacgguggauggcaucaccguuauagaccuugagccaauucccuaugauccuaaguucgaaaaacagcugggacaggugauguugcugauccucugcgucacacaggugcugaugaugagaacuaccugggcucuuugugaggccuuaacacuggcgaccggcccgaucagcacucucugggaggggaaucccggaagguuuuggaacacgacaauugccgucuccauggcaaauauauuccgcggcucauacuuggcuggugccgggcugcuauuuucuaucaugaagaacaccacuaauacccggcgaggaacaggcaacauuggugaaacucugggcgagaaauggaagaguagacucaacgcacuugggaaaucggaguuccaaaucuauaagaaaagcggcauucaggagguggacaggacccuggcuaaggagggcaucaagcgcggggaaacagaucaucacgccguuucccggggaucugccaaauugagaugguuuguggagcguaauaugguaacgccagaaggcaagguggucgaccuggguugcgggaggggaggcuggucauacuauugugguggccucaaaaacguucgggaggugaaggggcugaccaaaggaggcccugggcaugaagaaccaauaccuaugagcacuuacggauggaauuuaguccgccuucaguccggcguggauguauucuucacaccacccgagaagugcgacacccugcucugugauaucggugaaaguucuccuaacccaacuauugaggcggggcgaacacuaagagugcugaauuugguugaaaacuggcugaauaacaauacccaauuuugcaucaaggugcucaaccccuauaugccgagcgucauugagaaaauggaaacgcuucagaggaaguacggaggcgcucuggugcggaauccuuugucacgcaacuccacccacgagauguacugggucaguaaugcaacaggcaacaucgugagcucuguuaauaugauauccagaaugcugauuaacagguucacuaugaaacacaagaaagccaccuaugagccagacguagaucucgggucaggaacacgaaacaucgguaucgaaagcgagauucccaauuuagacauaaucggcaagcggauugaaaagaucaaacaggagcaugaaacuucguggcacuacgaccaggaucauccuuauaagaccugggcuuaccacgggucuuaugagacaaaacaaaccggaagugccuccagcauggugaacggcgucgugcgucugcuuacuaagccaugggacguugugcccauggucacgcagauggcaaugacagauaccacuccguuuggucagcagagaguguucaaagagaagguagacacccgcacacaagaaccuaaggaggggacgaaaaagcugaugaggauuaccgccgaauggcuauggaaagagcucggaaagaaaaagacuccccggauguguacaagagaggaauuuacccgcaaagugaggucaaaugcugcgcugggcgccaucuucacugaugagaacaaguggaaguccgcacgagaagcuguugaggacggccgguuuugggaauuggucgauagagagaggaaucugcaccucgaggggaaaugcgaaacauguguguacaacaugaugggaaagcgcgagaagaaacuuggugaguucggcaaagccaaagggucucgugcaauaugguauauguggcugggagcccgguuuuuagaguucgaagcucugggcuuuuugaaugaggaccauugguucagcagagguaacagucucuccgggguggagggagaaggccugcacaggcuaggcuacauccuucgcgaugucgggaagaaagagggaggugccauguacgcggacgauaccgcaggcugggacacacgaauuacucuggaagaccucaagaaugaggaaaugguuaccaaccauaugaaaggggagcacaagaaacuggccgaggcuaucuuuaaguugacguaucagaauaaggugguacgggugcagagaccaaccccuaggggaacagucauggauauuaucagccgcagagaccagcggggcucuggucaaguggggacuuacggacugaacaccuucacaaauauggaagcccagcucauuaggcagauggagggcgaaggcauauucaaaucaauccaacaucuuacugcaaccgaggagauugcuguucagaacuggcuggcccguguggggcgagaacgcuuaaguagaauggcuaucuccggagaugacugcgucgugaagcccaucgaugaccgguuugccagcgcacugacggcguugaaugauauggguaaaguaaggaaggacauucagcagugggagccaucucgcggcuggaacgauuggacacaaguucccuucugcucgcaccacuuucaugaacucgugaugaaagacgggagaguccugguggugccuugucggaaccaggaugagcuaauaggaagggcccgaaucucacagggcgcugguuggagccuuaaggaaaccgccugccuggggaaguccuaugcacagauguggacucucauguacuuccaccguagagaccugcgcuuggcugccaaugcaauuuguagugccgucccaucucauuggguuccgacaagccggaccacuugguccauccacgcgaaacacgaguggaugaccacagaggauauguuagcuguguggaacaggguauggauucaagaaaaucccuggauggaggacaagacgccuguggaaucaugggaggaagucccauaucugggaaaaagagaggaccaguggugcggcagucucaucggccuuaccucucgcgccacuugggcaaagaacauacagacagccaucaaucaggugcggagccugauugggaacgaggaauacaccgauuauaugcccuccaugaaaagguuucgaagagaggaagaggaagcuggaguucuaugguga

SEQ ID NO: 14745 - RNA, 9876 nt, Artificial Sequence
  derived and/or modified CDS sequence (opt3) from DENV-2__FJ639733__SS-prME
accgcaggcgugaucauuaugcugauacccacugcuauggcauuccaccucacuacgcguaacggggaaccucauaugaucgucggaaggcaggaaaaggguaaaagccuucuguuuaagaccgaggacggcguuaauaugugcaccuugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguccucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggacuauucggcaagggcgggauuguaaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucaucgaaaaggacuccccugugaacauugaggccgaacccccauuuggagauagcuacauaaucauuggcgucgagccugggcaguuaaaacugaauugguucaagaagggaucgucuaucggucaaauguuugaggcuacaaugcgaggcgccaaacgcauggcaauucuaggggacacugccugggauuucggaucccucggcggugcuuuuaccucaaucgggaaggcgcugcaccagguguucggcgcaauauacggagccgcuuuuaguggcguuagcuggacaaugaaaauccuuauuggggugguaaucacuuggauuggaaugaacuccagaucuaccagcuugucagucagucuggugcucguuggcguggucacgcuguaucuuggugccauggugcaggcagacuccggguguguagugagcuggaagaauaaagaacugaagugcggaucuggcaucuucauaacagauaacguucacaccuggacugagcaguacaaguuucaacccgaaucaccaaguaaauuggccagcgcuauucagaaggcccaugaggaagguaucuguggcauuagguccgucacacggcucgagaaucugauguggaaacagaucacccccgaguuaaaccacauacugucugaaaaugaggugaagcuaacuaucaugaccggggacacaaaaggaauuaugcaggcaggcaagcgcucgcucagaccucaaccaacggaacugaaauauagcuggaagaccugggggaaggcgaaaaugcuuuccacugagucacauaaccagacauucuugaucgauggaccggaaaccgcugagugccccaauacaaacagggccuggaauagucuggagguggaagacuacggcuuuggugucuucacuaccaacauuuggcucaagcugcgugagaaacaggacguauuuugugauucuaaguuaaugagcgcagccaucaaagacaaucgggcugugcacgccgauaugggguauuggauagaauccgcacugaacgacacguggaagauggagaaggcuucauucauugaggugaaaagcugccacuggccuaagucucauacacuuugguccaauggaguauuggaaagugagaugaucauccccaagaacuucgccggccccgucagccagcacaacuaccgaccugguuaucauacccaaacugcgggcccauggcaccucgggaagcuggaaauggauuuugacuucugugagggaaccacagugguugugacugaagauugcggcaauagagggcccucucuaaggaccacaacggccuccggaaaacugauuaccgaguggugcugucgcucaugcacucucccgccucugcgguacagaggcgaggacgguuguugguacgggauggaaaucaggccacuuaaggagaaggaagagaacuuggucaauagucuggugacagcuggacauggccagauugauaacuuuagcuuagguguucucggcauggcacuguuccuugaagagaugcugcgcacccgaguggggacuaaacacgccauauugcucguagcugucucguuugugacacugaucaccggaaauauguccuuccgggaccuaggccgugugauggucaugguuggggccacgaugacugaugacauuggaaugggcgugaccuaucuggcacuccuggcggccuuuaagguaagacccacauucgcugccggucuuuugcugaggaaauuaaccucuaaggagcucaugauggcaacuaucgggauuacacugcuuagccagucaaccaucccugaaacaauacuggagcuaacugaugcucucgcccugggaaugaugguguugaaaaucguccgcaagauggaaaaguaccaacuggcagugaccauuauggccaucaguugcguucccaacgcugugauuuuacggaaugcguggaaagucuccuguacgauccucgccgcagugucuguuagcccacugcuucugacauccucacagcagaaggcugacuggauaccuuuggcccucaccauuaaaggccugaaccccacugccaucuuucuaaccacacugagcagaacaaguaagaaaaggucuuggccacuuaaugaggcuaucauggcagugggcauggucuccauucucgccagcucgcuguugaagaacgacauaccgaugaccgggccucugguagcgggagguuuacucacggugugcuauguucugacaggccgaucagcugaucuugaacuggagcgcgccgcagacgugaaaugggaggaucaggccgaaaucucugggaguucccccauuuugagcaucaccauuucugaggacggaagcauguccaucaagaaugaagaggaggaacaaacucucacaauacugauccggaccggccuacuggucauuucagguguguucccaguaaguauccccauuacugcugcagccugguaccuuugggaggugaagaaacagagagcggggguccucugggauguuccuagcccacccccugugggaaaggcugaacuggaggacggcgccuauaggaucaaacagcguggcauauugggguacucucagauuggagccgguguguauaaggaaggcacauuucacaccauguggcaugucacgcgcggggcaguguuaaugcaccggggaaaaagaaucgagccguccugggcugauguuaagaaggaccugaucucauacggcgguggguggaaacucgagggagaauggaaggagggcgaagagguacaagugcuggcccuugaaccaggcaaaaaccccagggcaguccagacuaagccugggauuuucaaaaccaauacaggaaccaucggugcugugagucuggauuuuagcccaggcacauccgggucucccauaguugaccgaaagggaaagguggucggcuuguacgguaacggggugguaacucggucgggagccuaugucagcgcgauugcccagaccgagaaaucaaucgaggauaauccugaaauugaggacgauaucuuccgcaagaaaagacuaacgauaauggaccugcauccgggcgcaggcaagacaaaaagguaccuccccgcuauugugcgggaagccaucaagcgagggcugagaacucuuaucuuagcuccaacccgcguuguggcagccgagauggaagaggcccugaggggacucccuauucguuaucagacacccgcuaucaaggcggagcacaccggucgggaaauugucgacuugaugugucaugcaacuuucaccaugagacugcucuccccagugaggguuccuaacuacaaccugauaaucauggaugaggcccacuuuacagaccccgcuaguauugccgcacgcggcuauaucucuacgcgaguggaaaugggggaggccgcuggaaucuucaugacugcgaccccaccgggcagcagagauccuuuuccccaauccaaugccccaauuauggacgaggaacgggagauacccgaaaggucauggaacucuggucacgagugggucacagauuucaaagggaagaccgugugguuuguaccuagcaucaaagcaggaaaugacauugcugccugccuucgcaagaacggcaaaaaggugauccagcugagucguaagacuuucgauuccgaauacguuaaaacaagagcaaaugacugggauuuugucgugaccacggacauuagcgagaugggcgccaacuucaaggcugagcgggugaucgauccaaggcgcuguaugaaacccgucauauugacugacggggaagaacgaguaauccuagccggaccuaugccggugacacauucuucagcggcacagagacgggguaggauuggccgcaauccaaagaacgaaaaugaccaauauaucuacaugggggagccccuggaaaacgaugaggacugcgcccacuggaaagaggcuaagaugcucuuagauaauauuaacaccccugaaggaaucauacccuccauguuugagccagaaagagagaaaguugacgccauugauggcgaauacaggcugcggggugaggcucguaagaccuucguggaccuuaugcgccgaggggaucugccugucuggcucgcauauaagguggccgcugagggcaucaauuacgccgacagaaaaugguguuuugauggaauuaagaacaaucagaucuuggaagagaacguugaaguggagauauggacuaaagagggcgaaaggaagaaacugaagccccgguggcucgacgcacgcaucuauagugauccacuggcgcuuaaggaguucaaagaguucgccgcugggagaaagagccuaacacugaacuugauuaccgagaugggaagguuaccuacauuuaugacucagaaagcccggaaugcacuggacaaccucgcuguccugcauacggccgaagccgguggacgagcauacaaucacgcucuuucggagcugccggagacccucgaaacauugcugcuacugacucuccuugcgaccgugacagggggaaucuuccuguuuuuaaugucuggcaaggguauugggaaaaugaccuugggcaugugcugcaucauaacugccuccguacugcucugguaugcacagauucaaccccacuggaucgcugccagcaucauucuggaguucuuucuuaucgugcugcucauaccagaaccugagaagcagagaacgccccaggauaaccaguugaccuacguugucauugccauccugacagugguggcagcuacuauggccaaugaaaugggauucuuagagaagaccaaaaaggaccuaggccuggggucaauuacaacccaagagagugaaucuaacauccucgacauagaucuucgcccagcguccgcuuggacucuguaugccgucgcaacaacguuuguuaccccuauguugaggcauagcaucgaaaauucaagugugaacguaagccugacugccauugcuaaucaggcaacagugcucaugggacuggguaaaggcuggccccuuuccaagauggacaucggggucccgcuccuggccauuggauguuacucucaggugaacccaaucaccuugaccgcggcucuguuacuacugguugcccacuacgcaauuaucggcccuggucuccaggccaaagcuacacgggaagcccaaaagcgugcagcugccgggauaaugaagaaucccacuguggauggcauuacggucaucgaccuugagccaauccccuaugauccuaaauucgaaaagcagcugggacagguaauguugcugauucucugcgugacccagguucugaugaugagaacaacuugggcgcuuugugaggccuuaacccuggcaacaggcccgauaagcacccucugggaggggaaccccggaagguuuuggaauacuacgaucgcuguguccauggccaacauuuuccgcggcucauacuuggccggugcugggcugcuauuuucuaucaugaaaaauacaaccaacacucggcgaggaaccggcaauauuggugaaacacugggcgagaaguggaaaaguagacucaacgcccuugggaagucggaguuccaaaucuauaaaaagagcggaauacaggaggucgacaggacucuggccaaggagggcaucaaacgcggggaaaccgaucaucacgcggugucccggggaucugcuaaguugagaugguuugucgagcguaacauggugacaccagaaggcaaaguuguggaccuggguugcgggaggggaggcuggucauacuauugugguggccucaagaauguacgggaggugaaagggcugacgaagggaggcccugggcaugaagaaccaauuccuaugagcaccuacggauggaacuuaguccgccuucaguccggcguugauguguucuucacuccacccgagaagugcgacacacugcucugugauaucggugaaaguucuccuaauccaaccauugaggcagggcgaacucuaagaguccugaacuugguggaaaauuggcugaacaauaacacacaauuuugcaucaaaguacucaaucccuauaugccgagcgugauagagaagauggaaacccuucagaggaaauacggaggcgcccugguucggaacccuuugucacgcaauuccacgcacgagauguacugggugaguaacgcuaccggcaauauugucagcucugugaacaugaucuccagaaugcugaucaauagguucacaaugaagcacaaaaaggccacuuaugagccagacgucgaucucgggucaggaacccgaaacauugguauagaaagcgagauccccaacuuagacauuaucggcaagcggauugagaagaucaagcaggagcaugaaacaucguggcacuacgaccaggaucauccuuauaaaacuugggcauaccacgggucuuaugagaccaagcaaacaggaagugccuccagcauggugaauggcguuguacgucugcuuaccaaaccaugggacgugguccccauggugacucagauggcuaugacggauacaaccccguuuggucagcagagaguuuucaaggagaagguggacacucgcacccaagaaccuaaagaggggacaaagaaacugaugaggauaacggcggaauggcuauggaaggagcucggcaaaaagaaaacaccccggauguguacuagagaggaauuuacacgcaaggucaggucaaacgccgcacugggcgcuaucuucaccgaugagaauaaguggaaauccgcccgagaagcaguggaggacggccgguuuugggaauugguagauaaggagagaaaccugcaccucgaggggaaaugcgaaacuuguguguacaauaugaugggaaagagggagaagaaacuuggugaguucggcaaagccaaagggucucgcgcuauuugguauauguggcugggagccagauuuuuagaguucgaagcgcugggcuuuuugaacgaggaccauugguucagccgggguaauagucucuccgggguugagggagaaggccugcacagacuaggcuacauccuuagggaugucgggaagaaagagggaggugcaauguacgccgacgauacagcuggcugggacacccgcauuacacuggaagaccucaagaacgaggaaauggugacuaaucauaugaaaggggagcacaagaagcuggccgaggcaaucuuuaaauugaccuaucagaacaaggugguccgaguucagcggccaacgccuagaggaaccgugauggauauuauaagcaggcgcgaccagagaggcucuggucaaguagggacauacggacugaauacuuucaccaacauggaagcucagcucauccggcagauggagggcgaaggcauuuucaaaucaauccaacaucuuacagccacugaggagaucgcugugcagaauuggcuggccagggucgggcgugaacgauuaagucgcauggcaauuuccggagaugacugcgugguuaagcccauagaugacagauuugcgagcgcccugaccgcuuugaacgauauggguaaagugcggaaggacauccagcagugggagccaucuaggggcuggaaugauuggacgcaaguccccuucugcucgcaccacuuucaugaacucgugaugaaggacgggcgcguacugguugugccuuguagaaaccaggaugagcuaauuggacgggccaggaucucacagggcgcagguuggagccuuaaagaaacagcuugccuggggaaguccuaugcccagauguggacccucauguacuuccaccgacgugaccugagauuggcagccaacgcgauuuguagugcugucccaucucauugggugccgacuagccgcacaaccugguccauccacgccaaacacgaguggaugacuaccgaggauauguuagcaguguggaaucgggucuggauacaagaaaaccccuggauggaggacaagacaccuguugaaucaugggaggaagugccauaucugggaaaaagggaggaccaguggugcggcagucucaucggccuuacgucuagagccaccugggcuaagaauauucagacugccaucaaccagguacgcagccugauugggaaugaggaauacacagauuauaugcccuccaugaagcgguuuaggcgagaggaagaggaagcaggagugcuaugguga

SEQ ID NO: 14746 - RNA, 9876 nt, Artificial Sequence
  derived and/or modified CDS sequence (opt3) from DENV-2__FJ639734__SS-prME
accgccggcgugaucgucaugcugauucccacagcuauagcauuccaccucacuacgagaaacggggagccucauaugaucguuggaaggcaggaaaaggguaaaagccuucuguuuaagaccgaggacggcgugaauaugugcacauugauggccauugauuuaggggaacugugugaggacacuaucaccuacaaaugcccacuacuccggcaaaacgaaccggaggauauugacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggaucgagaccuggauacugcggcauccuggcuucacaaucauggccgcaauuuuggccuacaccaucggcacgacucacuuucagcgcgcucucauuuucauccugcugacagcaguggccccauccaugaccaugagaugcauagggauuucuaacagggauuuugucgaaggagugucggguggcucauggguagacaucguucucgagcacgggagcugugugacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggauugugaccugcgccauguuuacaugcaaaaagaauauggaaggaaaagugguccagccugagaaccucgaauacaccauaguuaucacuccacacagcggugaggagcaugcugugggcaaugacacggggaagcacggaaaagaaauuaagaucacaccgcaguccucaauaaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauucagaaggagacacuugugacguucaagaacccucaugccaaaaagcaagacguugugguccugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgugaaagaaauugcugagacucagcacggcaccaucguaauuagaguucaguaugagggugacgggucuccaugcaagauacccuucgaaaucacggauuuggagaaaaggcaugugcucggccggcugauuaccgucaacccgaucgugacagaaaaggacuccccugucaacaucgaggccgaacccccauuuggagauagcuacauuauaaucggcguggagccugggcaguuaaaacugaauugguucaagaagggaucgucuauuggucaaauguuugagacuaccaugcgaggcgcuaaacgcauggccauccuaggggacacagcaugggauuucggaucccucggcgguguuuuuacuucaauugggaaggcccugcaccagguguucggcgcuaucuacggagcggcauuuaguggcguaagcuggaccaugaaaauacuuaucggggucgugauuacguggaucggaaugaacuccagaucuacaagcuugucaguuagucuggugcucgucggcgugguaacccuguaucuuggugccauggugcaggcugacuccggguguguugucagcuggaagaauaaagaacugaagugcggaucuggcauuuucaucacugauaacgugcacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggucaagcuaacaauaaugacgggggacaccaaaggaaucaugcaggcuggcaagcgcucgcucagaccucaaccaacugaacugaaauauagcuggaagacaugggggaaggccaaaaugcuuuccaccgagucacauaaccagacauucuugauugauggaccggaaacugcagagugccccaauaccaacagggcguggaauagucuggagguugaagacuacggcuuugguguguucacgacaaacaucuggcucaagcugcgugagaaacaggacguguuuugugauucuaaguuaaugagcgcugccauuaaagacaaucgggcaguacacgccgauaugggguauuggaucgaauccgcucugaacgacaccuggaagauggagaaggccucauucauagaggucaaaagcugccacuggccuaagucucauacucuuugguccaauggaguguuggaaagugagaugauuaucccaaaaaacuucgcaggccccguuagccagcacaacuaccgaccugguuaucauacccaaacagcuggcccauggcaccucgggaagcuggaaauggauuuugaccuaugugagggaacuaccguggucgugacagaagauugcggcaauagagggcccucucugaggacgaccacugccuccggaaaacucaucacagaguggugcugucgcucaugcacccugccgccucuucgguacagaggcgaggacgguuguugguacgggauggaaauuaggccauugaaggagaaggaagagaaccugguuaauaguuuagugacugcgggacauggccagaucgauaacuucagccucgguguacugggcauggcccuuuuucuggaagagauguugcgcacacgagucgggaccaaacacgcuauucuccugguggcagugucguucgucacgcuaauaacuggaaauauguccuuucgggaccugggccguguuauggugaugguaggggccaccaugacagaugacaucggaaugggcgugaccuaucucgcucugcuugccgcauucaaggucagacccacuuuugcggccgguuugcuguuaaggaaacucacaucuaaggagcugaugauggcuaccauugggaucgcccuucugagccagucaacaauuccugaaacuauccuagagcucaccgaugcacuggcuuugggaaugauggugcugaaaauaguucgcaacauggaaaaguaccaauuagccgugacgaucauggcaauuaguugcguccccaaugccgugauccuccggaacgcuuggaagguuuccuguacaauucuggcggccgugucugucagcccacuucuguugaccuccucacagcagaaagcagacuggaucccucucgcucugacuauaaagggccuaaaucccaccgccauuuuccugacaacucuuagcagaaccaguaaaaagaggucuuggccacucaacgaggccaucauggcuguaggcaugguguccauccuggcaagcucguugcugaaaaaugacauuccgaugacggggccuuuaguugccggaggucuccugacagugugcuauguccuuaccggccgaucagcggaucuggaauuggagcgcgcugccgaggugaagugggaagaccaggcagagauaucugggaguucccccauccucagcauuacuaucucugaagauggaagcauguccauuaaaaacgaggaggaagagcaaacacugaccauccuaauacggacuggccugcuuguaaucucagguguguuuccagucaguauucccaucacagccgcugcaugguaccucugggaaguuaagaagcagagagccggggugcugugggacgugccuagcccacccccugucggaaaagcggaguuggaagauggcgcuuauaggauuaagcagcguggcaucuuaggguacucucagauaggagccgguguguauaaagagggcaccuuccacacgauguggcauguuacucgcggggcaguacugaugcaccggggaaagagaauugagccguccugggccgacgugaaaaaggaucucaucucauacggcgguggguggaagcuggaaggagaguggaaagaaggcgaggaaguccaagugcuugcucuggagccaggcaagaaucccagggccguucagaccaaaccugggaucuuuaagacaaacaccggaacaauuggugcagugaguuuggacuucagcccaggcacuuccgggucucccaucgucgaucgaaaaggaaaggugguaggccuauacgguaauggggucgugacccggucgggagcuuauguuagcgccauagcgcagacggagaagucaauugaagacaacccugagaucgaagaugacauuuuucgcaaaaagagacugacaaucauggaucuccauccgggcgccggcaaaacuaagagguaccugcccgcaauagugcgggaggcuauuaaacgagggcuuagaaccuuaauccuggccccaacacgcgucguggcugcagaaauggaggaggcccucaggggauugccuauccguuaucagacccccgccauuaaggcugaacacacuggucgggagaucguugaccugaugugucaugcgaccuucacaaugagacuccuguccccagugagggucccuaacuacaaucuuauuauaauggacgaagcacacuucacggaucccgccaguaucgcugcccgcggcuauauuucuacucgaguggagaugggggaggcagccggaaucuuuaugaccgcuacaccaccgggcagcagagacccuuucccccaauccaacgcgccaaucauggaugaagagcgggaaauucccgagaggucauggaauucuggucacgaauggguaaccgacuuuaaggggaaaacugugugguucguuccuagcauaaaggccggaaacgauaucgcagcuugccugcgcaaaaauggcaagaaagucauucaguugagucguaagacauuugacuccgaguacgugaagaccagagccaacgauugggacuucguggucacgacugauaucagcgagaugggcgcaaauuuuaaagccgaacggguaauugacccaaggcgcuguaugaagcccgugauccuaacagauggggaggaacgaguuauacuggcuggaccuaugccggugacccauucuucagccgcgcagagacgggguaggaucggccgcaacccaaaaaaugagaacgaccaauauauuuacaugggggaaccccucgagaaugacgaggauugcgcacacuggaaggaagccaaaauguuacuggacaacaucaauaccccugagggaauuauccccuccauguucgaaccagagagagaaaaggucgaugcuauagacggcgaguacaggcuucggggugaggcccguaaaacuuuuguggaucugaugcgccgaggggaccucccuguuugguuggcuuauaagguggcagccgaaggcauuaacuacgcugauagaaagugguguuucgacggaaucaaaaauaaccagauucuggaggaaaacgucgagguggagaucuggacaaaggaaggcgagaggaaaaagcucaaaccccgguggcuggaugcccgcauauauagugacccacuugcacuaaaggaauuuaaggaguucgcggccgggagaaaaagccugaccuugaauuuaaucacagaaaugggaaggcugccuacuuucaugacgcagaaggcucggaacgcccucgauaaucuggcaguacuucauaccgcugaggccgguggccgagcauacaaccacgcccugucggagcucccggaaacauuggagacucugcuacugcucacccuucuggcuacagugaccgggggaauuuuuuuauucuugaugucuggcaaagguaucgggaagaugacucugggcaugugcugcauuaucacggcguccguucuccugugguaugcccagauacaaccccacuggauugcagcuagcaucauccuugaauuuuuccugauuguccucuugaucccagagccugaaaaacagagaaccccccaggacaaucagcugacauacguggugauagccauuuuaacugucguugccgcaaccauggcuaacgagaugggauuucuagagaagacaaagaaagaucugggccucgggucaaucaccacucaagaaagugagucuaauauucuugacaucgaccugcgcccagccuccgcguggacauuguaugcuguggccacgaccuucguaacuccuaugcugaggcauagcauagaaaacucaagugugaaugucagccucacagcaaucgccaaccaggcuaccgugcugaugggacuugguaagggcuggccccucuccaaaauggauauugggguuccgcuguuggcaaucggauguuacucucaggugaauccaauuacccugacagccgcguuacuacugcucgucgcucacuacgccaucauuggcccuggucuucaggcaaaggccacucgggaggcucaaaaacgugccgcagcugggaucaugaagaaccccacgguagacggcauaaccgugauugaucuggaaccaauccccuaugacccuaaguuugagaaacaguugggacagguuaugcugcucauccugugcgugacacagguccuuaugaugagaacuaccugggccuuaugugaggcgcugacacucgccaccggcccgauuagcacuuugugggaagggaaucccggaagguucuggaacacgacaauagcaguguccauggcuaauaucuuucgcggcucauaccuggccggugcagggcuacuguucucuauuaugaagaacaccacuaauacccggcgaggaacaggcaacaucggugagacucucggcgaaaaauggaagaguagacuuaacgcucuggggaaaucggaguuucaaauuuauaagaaaagcggaauccaggaggucgauaggaccuuggccaaggaaggcauaaagcgcggggagacagaccaucacgccgugucccggggaucugcgaaacugagaugguucguugaacguaauauggugacgccagagggcaagguaguggaucucgguugcgggaggggaggcuggucauacuauugugguggccugaaaaacguccgggaaguuaagggguuaaccaaaggaggcccugggcaugaggagcccaucccuaugagcacuuacggauggaaucuugugcgccugcaguccggcgucgacguguuuuucacaccacccgaaaagugcgauacccuccuaugugacauuggugagaguucuccuaacccaacuaucgaagcugggcgaacacugagaguauugaaucugguggagaacuggcucaauaacaauacccaauucugcauuaagguucuuaaccccuauaugccgagcgugaucgaaaaaauggagacgcugcagaggaaguacggaggcgcauugguccggaauccucugucacgcaacuccacccacgagauguacugggugaguaaugccacaggcaacauagucagcucugugaauaugauuuccagaaugcucaucaacagguuuacuaugaaacacaagaaagcuaccuaugaaccagauguugacuuagggucaggaacacgaaacaucgguauugagagcgaaauacccaaucuggauaucauuggcaagcggaucgagaagauuaaacaggaacaugagacuucguggcacuacgaccaggaccauccuuauaagaccugggccuaccacgggucuuaugagacaaaacaaaccggaagugcauccagcaugguaaacggcgugguccgucuucugacuaagccaugggaugugguucccauggugacgcagauggccaugacagacaccacuccguucggucagcagagagucuuuaaagaaaagguggauacccgcacacaagagccuaaggaagggacgaaaaagcuaaugaaaaucaccgcugaguggcucuggaaggagcugggaaaaaagaaaacucccaggauguguacacgggaagaguucaccagaaagguacgcucaaaugcggccuugggcgcaauauuuacugacgaaaacaaguggaaauccgcuagggaggccguggaagauggccgauucugggagcugguugaccgggagagaaaucuccaccuugaagggaagugcgagacaugugucuacaacaugaugggaaaaagggaaaagaaacugggugaguuuggcaaggcaaaggggucucgcgccaucugguauaugugguuaggagcucguuuccuggaauuugaggccuugggcuuccucaaugaggaucauugguuuagccgggguaacagucuguccgggguggaaggagagggccuacacagacuuggcuacauucugagggacgugagcaaaaaggaagggggagcgauguacgcagaugacaccgccgguugggauacacgcaucacucucgaggaccugaaaaaugaagagauggucaccaaccauaugaagggcgagcacaaaaaguuggcugaagccauuuucaagcugacguaucagaauaaaguugugcgaguacagcggccaaccccuagagggacagugauggacaucauuucuaggcgcgaucagagaggaucaggccaagucgguacuuacgggcucaacaccuuuacaaauauggaggcacagcuuauacggcagauggaaggagagggcaucuucaagaguauucaacaucugacugcuaccgaggaaaucgccgugcagaacugguuagcuaggguuggccgugagcgacugucccgcauggccaucagcggggacgauugcguggucaaacccauugacgauagauucgcaucugcguugacggcccucaaugacaugggaaaggugcggaaagauauacagcagugggaaccaucgagggguuggaacgacuggacacaaguacccuuuugcucacaccacuuccaugagcugguuaugaaggauggccgcgcucuaguggucccuuguagaaaccaggacgaacuuaucgggcgggccaggaccagccagggagcaggcuggucccugaaggagacugcuugccucgguaaaaguuaugcccagauguggacacugauguacuuucaccgacgugauuugagauuagcagccaaugcgauuuguucugcugugccaagccauugggugccgaccucccgcacuaccuggucaauccacgccaagcacgaguggaugacaacggaagacaugcuggcagucuggaaccggguuuggauucaagagaaucccuggauggaagauaaaaccccuguggagaguugggaagagguaccauaucucgggaagagggaggaccaguggugcggaucucuuaucggccugacuagcagagccacaugggcuaaaaacauacagaccgccaucaaucaggugcgcucccuaauuggcaacgaagaguacacugacuauaugcccucaaugaagcgguucaggcgagaagaggaagaggcagggguccugugguga

SEQ ID NO: 14747 - RNA, 9876 nt, Artificial Sequence
  derived and/or modified CDS sequence (opt3) from DENV-2__JN819408__SS-prME
accgcaggcgugaucgucaugcugauucccacagcuauggcauuccaccucacuacgagaaacggggagccucauaugauuguugggaggcaggaaaaggguaaaagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagaaggcccaugaggaagguauuuguggcaucagguccgugacucggcucgagaaucugauguggaaacagauuacccccgaguuaaaccacauccugucugaaaaugaggugaagcuaacaauaaugacgggggacaccaaaggaaucaugcaggcuggcaagcgcucgcucagaccucaaccaacugaacugaaauauagcuggaagacaugggggaaggccaaaaugcuuuccaccgagucacauaaccagacauucuugauugauggaccggaaacugcagagugccccaauaccaacagggcguggaauagucuggaggucgaagacuacggcuuugguguuuucacgacaaacaucuggcucaagcugcgugagaaacaggacauauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucauccccaagaauuucgcaggccccgucagccagcacaacuaccgaccugguuaucauacccaaacagcuggcccauggcaccucgggaagcuggaaauggauuuugacuucugugagggaacuaccgugguugugacagaagauugcggcaauagagggcccucucuaaggacgaccacugccuccggaaaacugauuacagaguggugcugucgcucaugcacccucccgccucugcgguacagaggcgaggacgguuguugguacgggauggaaaucaggccacuuaaggagaaggaagagaacuuggucaauagucuggugacugcgggacauggccagauugauaacuuuagcuuagguguucucggcauggcccuguuccuugaagagaugcugcgcacacgaguggggaccaaacacgcuauauugcucguagcagucucguuugugacgcugaucacuggaaauauguccuuccgggaccuaggccgugugauggucaugguuggggccaccaugacagaugacauuggaaugggcgugaccuaucuggcucuccuggccgcauuuaagguaagacccacuuucgcggccggucuuuugcugaggaaauuaacaucuaaggagcucaugauggcuaccaucgggauugcccugcuuagccagucaacaaucccugaaacuauacuggagcuaaccgaugcacucgcucugggaaugauggccuugaaaaucgugcgcaacauggaaaaguaccaacuggcagucacgauuauggccaucaguugcgugcccaaugcuguuauuuuacagaacgcguggaagguguccuguacaauccucgccgcagucucugugagcccacugcuucugaccuccucacagcagaaagcugacuggauaccuuuggcccucacuauuaagggccugaaucccaccgccaucuuucuaacaacucugagccggaccaguaaaaagagaucuuggccacuuaacgaggcuaucauggcaguuggcaugguguccauucucgccagcucgcuguugaaaaaugacauaccgaugacggggccucuggucgcgggagguuuacucacaguaugcuaugugcugaccggcaggucagcugaucuugaacuggagcgagccgcagacguuaagugggaggaucaagccgaaaucucugggaguucccccauuuugagcaucacuauuucugaggacggaagcauguccaucaaaaacgaagaggaggaacagacacucaccauacugauccgcacuggccuacuggugauuucaggugucuucccagugaguauccccauuacagcugcagccugguaccuuugggagguaaagaagcagcgggcgggggugcucugggaugucccuagcccacccccuguuggaaaagcugaacuggaggacggcgccuauagaaucaagcagaggggcauauugggguacucucaaauuggagccgguguguauaaagaaggcaccuuucacacgauguggcaugugacucguggggcagucuuaaugcaccgcggaaagcggaucgagccguccugggcugaugugaaaaaggaccugaucucauacggcgguggguggaagcucgagggagaauggaaagagggcgaagagguucagguacuggcccuugaaccaggcaagaaucccagagcagugcagaccaaaccugggauuuucaggacaaacaccggaacaaucggugcugucagucuggauuuuagcccaggcacuuccgggucucccauaguggaccgaaagggaaaaguugugggcuuguacgguaauggggucgugacccggucgggagccuauguaagcgcgauugcccagacggagaagucaaucgaggauaacccugaaauugaggacgauaucuuccgcaagaaaagacuaacaauaauggaccugcauccgggcgcaggcaagacuaaaagguaccuccccgcuauuguccgggaagccaucaagcgagggcugagaacccuuaucuuagcuccaacacgcgugguugcagccgagauggaagaggcccugaggggacucccuauucguuaucaaacccccgcuaucaaagcggagcacacuggucgggaaauuguggacuugaugugucaugcaaccuucacaaugagacugcucuccccagucagggugccuaacuacaaucugauaaucauggaugaggcccacuuuacggaccccgcuaguauugccgcacgcggcuauaucucuacucgaguugaaaugggggaggccgcuggaaucuucaugaccgcgacaccaccgggcagcagagauccuuuuccccaguccaacgccccaauuauggacgaggaacgggagauacccgaaaggucauggaacucuggucacgagugggugaccgauuucaaggggaagacugucugguuugugccuagcaucaaagcaggaaacgacauugcugccugccuucgcaagaauggcaaaaagguaauccagcugagucguaaaacauucgauuccgaauacgugaagaccagagcaaacgacugggauuuuguugucacgacugacauuagcgagaugggcgccaauuucaaggcugagcgggugaucgauccaaggcgcuguaugaaacccgugauauugacagacggggaagaacgagucauccuagccggaccuaugccgguaacccauucuucagcggcacaaagacgggguaggauuggccgcaacccaaagaaugaaaacgaccaguauaucuacaugggggagccccuggaaaaugaugaggacugcgcccacuggaaagaggcuaagaugcucuuagauaacauuaauaccccugaaggaaucauacccuccauguuugagccagaaagagagaaaguggacgccauugauggcgaauacaggcugcggggugaggcucguaagacuuucguugaccuuaugcgccgaggggaucugccuguguggcucgcauauaaagucgccgcugagggcaucaacuacgccgacagaaagugguguuuugauggaauuaagaauaaccagaucuuggaagagaacguggaaguugagauauggacaaaagagggcgaaaggaagaaacugaagccccgguggcucgacgcacgcaucuauagugauccacuggcgcuuaaagaguucaaggaguucgccgcugggagaaagagccuaacccugaauuugauuacagagaugggaagguuaccuacuuuuaugacgcagaaagcccggaacgcacuggacaaucucgcugugcugcauaccgccgaagccgguggacgagcauacaaccacgcucuuucggagcugccggagacacucgaaacuuugcugcuacugacccuccuugcgacagucaccgggggaaucuuccuguuuuuaaugucuggcaaggguauugggaaaaugacuuugggcaugugcugcaucauaacggccuccauucugcucugguaugcacaaauccagccccacuggaucgcugccagcauuauccuggaguucuuucuuauagugcugcucauuccagaaccugagaagcagagaacaccacaggauaaucaauugacauacguagugaucgccauucugacuguugucgcagcuaccauggccaacgaaaugggauucuuagagaaaacaaagaaggaccuaggccuggggucaaucauaacccaggagagugaaaauaacauccucgacauugaucuucgcccagcgucugcuuggacucuguaugccguggcaacaacguuugugaccccuauguugaggcauuccaucgagaauagcucagucaacguuagucugacugccauugcuaaucaggcaacagugcucaugggacuggguaaaggcuggccccuuagcaagauggacaucgggguaccgcuccuggccauuggauguuacucccaggugaacccaaucaccuugaccgcggcucuguuacuacuggucgcccacuacgcaauaauuggcccuggucuccaagccaaagcuacacgggaagcccagaagcgugcagcugccgggaucaugaaaaaucccacuguggauggcaucacgguuauugaccuugagccaauacccuaugauccuaaguucgaaaagcagcugggacaggugauguugcugauccucugcgucacccaaguacugaugaugagaacaacuugggcgcuuugugaggccuuaacccuggcaacaggcccgauuucuacccucugggaggggaaccccggaagguuuuggaauacuacgaucgcugugagcauggccaacauuuuccgcggcuccuacuuggccggugcugggcugcuauuuucaaucaugaaaaauacaaccaacacucggcgaggaaccggcaacauaggugaaacacugggcgagaaguggaaaucuagacucaaugcccuugggaagagugaguuccagaucuauaaaaagucggguauucaggagguugacaggacucuggccaaagagggcaucaagcgcggggaaaccgaucaucacgcggugagccggggauccgcuaaguugagaugguuugucgagcguaacauggugacaccagaaggcaaagucguggaccuggguugcgggaggggaggcuggucuuacuauugugguggccucaagaauguucgggaggugaaagggcugacgaagggaggcccugggcaugaagaacccauuccuaugucaaccuacggauggaacuuaguacgccuucaaagcggcguggaugucuucuucacuccacccgagaaaugcgacacacugcucugugauaucggugaauccaguccuaauccaaccauagaggcagggcgaacucuaagaguucugaacuugguggaaaauuggcugaacaauaacacacaguuuugcauuaagguccucaaucccuauaugccgucugugaucgagaagauggaaacccuucagaggaaauacggaggcgcccugguacggaacccuuugagccgcaauucaacgcacgagauguacuggguguccaacgcuaccggcaauaucguuaguagcgugaacaugauuucuagaaugcugauaaacagguucacaaugaagcacaaaaaggccacuuaugagccagacgucgaucucggguccggaacccgaaauaucgguauugaaggcgagauccccaacuuagacauuaucgggaaacggauagaaaagaucaagcaggagcaugaaacaucauggcacuacgaccaagaucauccuuauaaaacuugggcauaccacggaagcuaugagaccaagcagacaggcucggccucuaguauggugaauggugucgugcgucugcuuaccaaaccaugggacguuguacccauggugacucagauggcuaugacggauacaaccccguuugggcagcaaagagucuucaaggagaaaguggacacucgcacccaggaaccuaaggagggaacaaagaaacugaugaagauuacggcggaauggcuauggaaagagcucggcaagaaaaagacccccaggauguguacucgggaggaauuuaccaaaaagguuagauccaacgccgcacugggcgcuaucuucaccgaugagaauaaguggaaaagcgcccgcgaagcaguggaggacgggagguuuugggaauuggucgaucgagagcggaaccugcaccucgagggaaagugcgaaacuuguguguacaauaugauggguaaaagagagaagaaacuuggcgaguucgggaaggccaagggaucaagggcuauuugguauauguggcugggcgcccgcuuuuuagaguucgaagcgcugggauuuuugaacgaggaccauugguucucccguggaaauucucucagcggaguagagggcgaaggccugcaccggcuaggguacauccuuagagaugugggcaaaaaggaggguggcgcaauguacgccgacgauacagcugggugggacaccaggauuacacuggaagaccucaaaaacgaggaaaugguuacuaaucauaugaagggagagcacaaaaagcuggccgaggcaauauuuaaguugaccuaucagaacaaagucgugcgcgugcagcgaccaacgccucggggcaccgucauggauaucauuaguagaagggaccaacgcgguuccgggcagguuggaacauacggccugaauacuuucaccaacauggaagcucagcucaucagacaaauggagggcgaagggaucuucaagagcauucagcaucuuacagccacugaggagauagcugugcagaauuggcuggcccggguaggaagggaacguuuaucucgaauggcaaucucaggugaugacugcguggucaaacccauugaugaccgcuuugcgagugcccugaccgcuuugaacgauaugggcaaggugagaaaagacauccagcaaugggagccaucccggggguggaacgauuggacgcagguucccuucugcagccaccacuuucaugaacucgugaugaaggacggaaggguccuggugguaccuugucgcaaucaggaugagcuaauuggcagagcccggaucucucagggugcaggguggucgcuuaaggaaacagcuugccugggaaaaucauaugcccaaauguggacccucauguacuuccacaggcgagaccugcguuuggcagccaacgcgauauguagcgcuguuccaucccauugggugccgacaaguagaacaaccuggucuauccacgccaagcacgaguggaugacuaccgaggauauguuagcagucuggaaucgcguguggauucaggaaaaccccuggauggaggacaaaacaccuguggaaagcugggaggaagucccauaucugggcaagcgggaggaccaguggugcggcucccucaucgggcuuacgucaagggccaccugggcuaaaaauauucagacugccaucaaccaaguuagaagucugauaggaaaugaggaauacacagauuauaugcccucuaugaagcgcuuucggagggaggaagaggaagccggugugcuaugguga

SEQ ID NO: 14748 - RNA, 9876 nt, Artificial Sequence
  derived and/or modified CDS sequence (opt3) from DENV-2__FJ639783__SS-prME
accgccggagugaucgucaugcugauucccacagcuauggcauuccaccucacuacgagaaacggggagccucauaugauaguuggaaggcaggaaaaggguaaaagccuucuguuuaagaccgaggacggagugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucggggucucuaacagggauuuuguggaaggaguaucggguggcucauggguugacauagugcucgagcacgggagcugugucacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuauuugcaagcauucuaugguggauagaggcugggguaacggguguggacuauucggcaagggcgggaucgugaccugcgccauguuuacaugcaaaaagaauauggaaggaaaagucguucagccugagaaccucgaauacaccaucgugauuacuccacacagcggugaggagcaugcuguaggcaaugacacggggaagcacggaaaagaaauaaagaucacaccgcaguccucaauuaccgaggccgaacugacuggcuaugguaccgugacaauggaguguagucccaggaccgggcuugauuucaacgaaaugguccuguugcaaauggaggacaaagcauggcucgugcaccggcagugguuucuggauuuaccucugccauggcuccccggcgcugacacucagggaagcaauuggauccagaaggagacacuuguuacguucaagaacccucaugccaaaaagcaagacguggucgugcugggcucucaggaaggggcgaugcacaccgccuugacuggagcaacagagauacagauguccucagguaaucuacuguuuaccggccaucucaaaugccgucugcgcauggauaaacuucaacugaaagggaugagcuacaguauguguacaggaaaguucaagauuguaaaagaaaucgcugagacucagcacggcaccaucguuauuagagugcaguaugagggugacgggucuccaugcaagauccccuucgaaauuacggauuuggagaaaaggcauguccucggccggcugauaaccgugaacccgaucgucacagaaaaggacuccccugugaacauugaggccgaacccccauuuggagauagcuacaucaucauuggcguugagccugggcaguuaaaacugaauugguucaagaagggaucgucuauaggucaaauguuugagacuaccaugcgaggcgcuaaacgcauggccauccuaggggacacagcaugggauuucggaucccucggcgguguguuuacuucaauugggaaggcccugcaccagguauucggcgcuaucuacggagcggcauuuaguggcgucagcuggaccaugaaaauucuuaucggggugauaaucacguggauuggaaugaacuccagaucuacuagcuugucaguuagucuggugcucgucggcgugguaacccuguaucuuggugccauggugcaggcugacuccggguguguugucagcuggaagaauaaagaacugaagugcggaucuggcaucuucauuacugauaacgugcacacauggaccgagcaguacaaguuucaacccgaaucaccaaguaaauuggccagcgcaauccagaaggcccaugaggaagguauauguggcauuagguccgugacucggcucgagaaucugauguggaaacagaucacccccgaguuaaaccacauucugucugaaaaugaggucaagcuaacaaucaugacgggggacauaaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguugaagacuacggcuuugguguguucaccacgaacaucuggcucaagcugcgugagaaacaggacguguuuugugauucuaaguuaaugagcgcugccauuaaagacaaucgggcaguacacgccgauaugggguauuggaucgaauccgcucugaacgacacauggaagauggagaaggccucauucauagaggucaaaagcugccacuggccuaagucucauacccuuugguccaauggaguguuggaaagugagaugauuauccccaagaauuucgcaggccccguuagccagcacaacuaccgaccugguuaucauacucaaaccgcuggcccauggcaccucgggaagcuggaaauggauuuugacuucugugagggaacaacuguggucgugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuugguuaauagucuggugaccgcgggacauggccagaucgauaacuuuagcuuagguguacucggcauggcccuguuccuugaagagaugcugcgcacucgagucgggacaaaacacgcuauuuugcucguggcagugucguuugucacccugauaacgggaaauauguccuuccgggaccuaggccguguuauggugaugguaggggccacuaugaccgaugacaucggaaugggcgugacauaucuggcucuccuggccgcauuuaaggucagacccaccuucgcggccggucuuuugcugaggaaauuaacuucuaaggagcucaugauggcuacaauugggaucgcccugcuuagccagucaaccauuccugaaacaauccuggagcuaacugaugcacucgcucugggaaugaugguguugaaaauaguucgcaacauggaaaaguaccaacuggccgugaccgucauggcaaucaguugcgugcccaaugccguuauuuuacagaacgcuuggaagguguccuguacgauccucgcggccgucucuguaagcccacugcuucugacauccucacagcagaaagcagacuggauuccuuuggcucucaccaucaagggccugaaucccacugccauauuucuaaccacacugagccggacaaguaaaaagagaucuuggccacuuaacgaggccauuauggcugugggcaugguuuccauccucgcaagcucgcuguugaaaaaugacaucccgaugaccgggccucugguggccggagguuuacucacggucugcuaugugcugacaggcaggucagcggaucuugaacuggagcgagcugccgacguaaagugggaggaucaagcagaaauuucugggaguucccccauauugagcaucaccauuucugaggacggaagcauguccaucaaaaacgaagaggaggaacagacucucacaauucugauccgcaccggccuacuggugauaucaggugucuucccaguuaguauccccauuacugccgcugcaugguaccuuugggaggugaagaagcagcgggccggggugcucugggaugucccuagcccacccccugugggaaaagcggaacuggaggacggcgcuuauagaaucaagcagaggggcauuuugggguacucucaaaucggagccgguguuuauaaagaaggcacauuucacaccauguggcauguaacgcguggggcaguguuaaugcaccgcggaaagcggauagagccguccugggccgaugucaaaaaggaccugauuucauacggcgguggguggaagcucgagggagaauggaaagagggcgaagaggugcagguucuggcucuugaaccaggcaagaaucccagagccgugcagacuaaaccugggaucuucaagaccaacacaggaaccaucggugcagucagucuggauuuuagcccaggcacauccgggucucccauuguggacaggaaaggaaagguagucggcuuguacgguaauggggugguuacucgaucgggagcuuaugugagcgccaucgcgcagaccgagaagucaauagaggauaacccugaaauugaggacgauaucuuccggaaaaagcgccuaacgauuauggaccugcauccgggcgccggcaaaacaaagagauaccuccccgcaaucgucagggaagcuauaaaacgggggcugcgaacucuuauuuuagccccaaccagagugguugcugcagagauggaagaggcccugcgcggacucccuaucagguaucaaacacccgccaucaaggcugagcacaccggucgugaaauuguggacuugaugugucaugcgacuuucaccaugcggcugcucuccccagucagagugccuaacuacaaucugaucauuauggaugaggcacacuuuacagaccccgccaguauagcugccaggggcuauaucucuacgcgcguagaaaugggggaggcagccggaauuuucaugacugcuaccccaccgggcagccgagauccuuuuccccaguccaacgcgccaaucauggacgaggaaagagagauccccgaacggucauggaacucuggucacgagugggugacagauuucaaggggaaaaccguuugguuugucccuagcauuaaggccggaaacgacauagcagcuugccuuaggaaaaauggcaagaaagugauccagcugagucgcaagacuuucgauuccgaauacgugaagacacgugccaacgacugggauuuugucguaaccacggacauuagcgagaugggcgcaaauuucaaagccgagagagugaucgauccacggagguguaugaagcccguuauuuugacugacggggaagaacgcgugauccuagcuggaccuaugccggucacacauucuucagccgcgcaacgaagaggucggauaggcaggaaccccaaaaaugaaaacgaccaguauaucuacaugggggagccccuggaaaaugaugaggacugcgcacacuggaaggaggccaaaaugcucuuagauaacauuaauaccccugaaggaaucauucccuccauguuugagccagaacgcgagaagguggacgcuaucgauggcgaauacagacugaggggugaggcccggaaaaccuucguugaccuuaugcgucgcggggaucugccuguguggcucgcuuauaaggucgcagccgagggcauaaacuacgcugaccgaaagugguguuuugauggaauuaaaaauaaccagaucuuggaagagaacguggaaguagagauuuggacuaaggagggcgaaaggaaaaagcugaaacccagauggcucgacgcccggaucuauagugauccacuggcacuuaaggaguucaaggaguucgcggccgggcgcaaaagccuaacacugaauuugauaaccgagaugggaagauuaccuacauuuaugacucagaaggcuaggaacgcccuggacaaucucgcagugcugcauacggcugaagccgguggccgggcauacaaccacgcccuuucggagcugccggagacccucgaaacauugcugcuacugacucuccuugcuaccguuacagggggaaucuuccuguuuuuaaugucuggcaaagguauugggaagaugaccuugggcaugugcugcaucauuacugcguccguccugcucugguaugcccaaauccagccccacuggauagcagcuagcauuauccuggaguucuuucuuaucgugcugcucauuccagaaccugagaaacagcgaacgccccaggauaaucaauugaccuacguggucaucgccauacugacaguuguggccgcaacuauggcuaacgaaaugggauucuuagagaagaccaagaaagaccuaggccuggggucaauuacaacccaggagagugaaucuaauauccucgacauugaucuuagaccagccuccgcguggacucuguaugcuguagccacaacguuugugaccccuauguugcgccauagcaucgagaacucaagugucaaugugagccugacugcaauagccaaccaggcuacaguucucaugggacuggguaagggcuggccccuuuccaaaauggacaucggggugccgcuccuggcaauuggauguuacucucaggucaauccaaucaccuugaccgccgcgcuguuacuacugguagcucacuacgccauuaucggcccuggucuccaagcaaaggccacaagggaagcucagaaacgggccgcagcugggauuaugaagaaccccacuguggauggcaucacgguuauagaccuugagccaauucccuaugauccuaaguucgaaaaacagcugggacaggugauguugcugauccucugcgucacccaagugcugaugaugcguacaacuugggcccuuugugaggcguuaacccuggccacaggcccgaucagcacccucugggaggggaaucccggaagauuuuggaacacuacgauugcagucuccauggcuaauauauucaggggcucauacuuggccggugcagggcugcuauuuucuaucaugaagaacacaaccaauacucgccggggaaccggcaacauuggugaaacacugggcgagaaauggaagagucgacucaacgcucuugggaaaucggaguuccagaucuauaagaaaagcggcauucaggagguggacagaacucuggccaaggagggcaucaagagaggggaaaccgaucaucacgccguuucccgcggaucugcgaaauugcggugguuuguggagagaaauaugguaacaccagaaggcaagguggucgaccuggguugcgggcguggaggcuggucauacuauugugguggccucaaaaacguuagggaggugaaggggcugacgaaaggaggcccugggcaugaagaaccaauaccuaugagcaccuacggauggaauuuaguccggcuucaauccggcguggauguauucuucacuccacccgagaagugcgacacacugcucugugauaucggugaaaguucuccuaacccaaccauugaggcugggcgcacucuacgagugcugaauuugguugaaaacuggcugaauaacaauacacaguuuugcaucaaggugcucaaccccuauaugccgagcgucauugagaaaauggaaacccuucagagaaaguacggaggcgcacuggugaggaauccuuugucacggaacuccacgcacgagauguacugggucaguaaugccaccggcaacaucgugagcucuguuaauaugauaucccgcaugcugauuaacagauucacaaugaaacacaagaaagcuacuuaugagccagacguagaucucgggucaggaaccaggaacaucgguaucgaaagcgagauucccaauuuagacauaaucggcaagcgaauugaaaagaucaaacaggagcaugaaacaucguggcacuacgaccaagaucauccuuauaagacuugggccuaccacgggucuuaugagaccaaacagacaggaagugcauccagcauggugaacggcgucgugcggcugcuuaccaagccaugggacguugugcccauggucacucagauggccaugacggauacaaccccguuuggucagcaacguguguucaaagagaagguagacacuagaacccaggaaccuaaggaggggacgaaaaagcugaugaaaauuacagcugaauggcuauggaaggagcucggcaaaaagaaaaccccacgcauguguacuagggaggaauuuacacggaaggugagaucaaaugcggcccugggcgcaaucuucaccgaugagaacaaguggaaauccgcucgcgaagccguugaggacggcagguuuugggaauuggucgaucgagagcggaaucugcaccucgaggggaagugcgaaacuuguguguacaacaugaugggaaaaagagagaagaaacuuggugaguucggcaaggcaaaggggucuagggccauaugguauauguggcugggagcucgcuuuuuagaguucgaagcccugggcuuuuugaaugaggaccauugguucagccgugguaacagucucuccgggguggagggagaaggccugcaccggcuaggcuacauccuuagagaugucgggaaaaaggagggaggugcgauguacgcagacgauacagccggcugggacaccaggauuacacuggaagaccucaaaaaugaggaaaugguuacuaaccauaugaagggggagcacaaaaagcuggcugaggccaucuuuaaguugaccuaucagaauaaagugguacgcgugcagcgaccaacgccucggggaaccgucauggauauuaucagcagaagggaccaacgcggcucuggucagguggggacauacggacugaacacuuucaccaauauggaagcacagcucauuagacaaauggagggcgaaggcauauucaagucaauccagcaucuuacagcuacugaggagauugccguucagaacuggcuggcucggguggggagggaacguuuaagucgaauggccaucuccggagaugacugcgucgugaaacccaucgaugaccgcuuugcaagcgcgcugaccgccuugaaugauauggguaagguaagaaaagacauucagcaaugggagccaucucggggcuggaacgauuggacgcagguucccuucugcucgcaccacuuucaugaacucgugaugaaggacgggaggguccugguggugccuugucgcaaccaggaugagcuaauaggaagggcucggaucucacagggcgccgguuggagccuuaaggaaacagcaugccuggggaaauccuaugcucaaauguggacccucauguacuuccacaggcgagaccugcguuuggccgcaaaugccauuuguagugcggucccaucucauuggguuccgacuagcagaacaaccugguccauccacgcuaagcacgaguggaugacuaccgaggauauguuagccguguggaaccgcguauggauucaggaaaaucccuggauggaggacaaaacaccuguggaaucaugggaggaagucccauaucugggaaagcgggaggaccaguggugcggcagucucaucggccuuacgucuagggcaaccugggccaaaaacauacagacugcuaucaaucaagugagaagccugauugggaacgaggaauacacagauuauaugcccuccaugaagcgcuuucggagggaggaagaggaagccggaguucuaugguga

SEQ ID NO: 14749 - RNA, 9876 nt, Artificial Sequence
  derived and/or modified CDS sequence (opt3) from DENV-2__FJ639788__SS-prME
accgccggagugaucgucaugcugauuccaacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacggcgggcgagcaccgccgagaaaagcguucaguggcucuggucccccauguggguauggggcuugagacuagaaccgaaacauggaugaguagcgagggagccuggaaacacguucagaggauugagacuuggauccugcggcauccuggcuucaccauaauggcagccaucuuggcuuacacaauuggcaccacgcacuuucagcgcgcacucaucuucauucugcugacugccguggcuccauccaugacaaugagaugcaucggggucucuaacagggauuuuguggaaggaguaucggguggcucauggguugacauagugcucgagcacgggagcugugucaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuauuugcaagcauucuaugguggauagaggcugggguaacggguguggacuauucggcaagggcgggaucgugacuugcgcuauguuuaccugcaaaaagaauauggaaggaaaagucguucagccugagaaccucgaauacacaaucgugauuaccccacacagcggugaggagcaugccguaggcaaugacacugggaagcacggaaaagaaauaaagaucacgccgcaguccucaauuacagaggcagaacugaccggcuaugguacugugaccauggaguguagucccaggacagggcuugauuucaacgaaaugguccuguugcaaauggaggacaaggcuuggcucgugcaccggcagugguuucuggauuuaccucugccauggcuccccggcgccgacacccagggaagcaauuggauccagaaggagacucuuguuacauucaagaacccucaugcgaaaaagcaagacguggucgugcugggcucucaggaaggggccaugcacacggcauugaccggagcuacugagauacagauguccucagguaaucuacuguuuacaggccaucucaaaugccgucugcgcauggauaaacuucaacugaaagggaugagcuacaguauguguaccggaaaguucaagauuguaaaagaaaucgccgagacacagcacggcacuaucguuauuagagugcaguaugagggugacgggucuccaugcaagauccccuucgaaauuaccgauuuggagaaaaggcauguccucggccggcugauaacggugaacccgaucgucaccgaaaaggacuccccugugaacauugaggcugaacccccauuuggagauagcuacaucaucauuggcguugagccugggcaguuaaaacugaauugguucaagaagggaucgucuauaggucaaauguuugagacaacuaugcgaggcgccaaacgcauggcaauccuaggggacaccgccugggauuucggaucccucggcgguguguuuacaucaauugggaaggcucugcaccagguauucggcgcgaucuacggagcagccuuuaguggcgucagcuggacuaugaaaauucuuaucggggugauaaucaccuggauuggaaugaacuccagaucuacgagcuugucaguuagucuggugcucgucggcgugguaacacuguaucuuggugcuauggugcaggccgacuccggguguguugucagcuggaagaauaaagaacugaagugcggaucuggcaucuucauuaccgauaacgugcacacuuggacagagcaguacaaguuucaacccgaaucaccaaguaaauuggcaagcgccauccagaaggcucaugaggaagguauauguggcauuagguccgugacccggcucgagaaucugauguggaaacagaucacucccgaguuaaaccacauucugucugaaaaugaggucaagcuaaccaucaugacaggggacauaaaaggaaucaugcaggccggcaagcgcucgcucagaccucaaccaacggaacugaaauauagcuggaagaccugggggaaggcaaaaaugcuuuccacugagucacauaaccagacauucuugauugauggaccggaaaccgcggagugccccaauacaaacagggcuuggaauagucuggagguugaagacuacggcuuugguguguucacuaccaacaucuggcucaagcugcgugagaaacaggacguguuuugugauucuaaguuaaugagcgccgcaauuaaagacaaucgggccguacacgcugauaugggguauuggaucgaauccgcccugaacgacacguggaagauggagaaggcaucauucauagaggucaaaagcugccacuggccuaagucucauacacuuugguccaauggaguguuggaaagugagaugauuauccccaaaaauuucgcuggccccguuagccagcacaacuaccgaccugguuaucauacccaaacugccggcccauggcaccucgggaagcuggaaauggauuuugacuucugugagggaaccacaguggucgugacugaagauugcggcaauagagggcccucucuaaggaccacaacggcguccggaaaacugaucaccgaguggugcugucgcucaugcacucucccgccucugcgguacagaggcgaggacgguuguugguacgggauggaaauuaggccacuuaaggagaaggaagagaacuugguuaauagucuggugacagccggacauggccagaucgauaacuuuagcuuagguguacucggcauggcucuguuccuugaagagaugcugcgcacccgagucgggacuaaacacgcaauuuugcucguggccgugucguuugucacacugauaaccggaaauauguccuuccgggaccuaggccguguuauggugaugguaggggcuacgaugacugaugacaucggaaugggcgugaccuaucuggcccuccuggcagcguuuaaggucagacccacauucgccgcuggucuuuugcugaggaaauuaaccucuaaggagcucaugauggccacuauugggaucgcacugcuuagccagucaacaauuccugaaaccauccuggagcuaacagaugcucucgcccugggaaugaugguguugaaaauaguucgcaacauggaaaaguaccaacuggcagugacugucauggccaucaguugcgugcccaaugcuguuauuuuacagaacgcguggaagguguccuguaccauccucgccgcagucucuguaagcccacugcuucugacguccucacagcagaaagcugacuggauuccuuuggcccucacaaucaagggccugaaucccaccgccauauuucuaacuacccugagccggacaaguaaaaagagaucuuggccacuuaacgaggcuauuauggcagugggcaugguuuccauccucgccagcucgcuguugaaaaaugacaucccgaugacugggccucugguggcgggagguuuacucaccgucugcuaugugcugacgggcaggucagcugaucuugaacuggagcgagccgcagacguaaagugggaggaucaagccgaaauuucugggaguucccccauauugagcaucacaauuucugaggacggaagcauguccaucaaaaacgaagaggaggaacagacccucacuauucugauccgcacaggccuacuggugauaucaggugucuucccaguuaguauccccauuaccgcugcagccugguaccuuugggaggugaagaagcagcgggcgggggugcucugggaugucccuagcccacccccugugggaaaagcugaacuggaggacggcgccuauagaaucaagcagaggggcauuuugggguacucucaaaucggagccgguguuuauaaagaaggcacuuuucacacaauguggcauguaacccguggggcaguguuaaugcaccgcggaaagcggauagagccguccugggcugaugucaaaaaggaccugauuucauacggcgguggguggaagcucgagggagaauggaaagagggcgaagaggugcagguucuggcccuugaaccaggcaagaaucccagagcagugcagacgaaaccugggaucuucaagacuaacaccggaacaaucggugcugucagucuggauuuuagcccaggcaccuccgggucucccauuguggacaggaaaggaaagguagucggcuuguacgguaauggggugguuacacgaucgggagccuaugugagcgcgaucgcccagacugagaagucaauagaggauaacccugaaauugaggacgauaucuuccggaaaaagcgccuaaccauuauggaccugcauccgggcgcaggcaaaacgaagagauaccuccccgcuaucgucagggaagccauaaaacgggggcugcgaacacuuauuuuagcuccaacuagagugguugcagccgagauggaagaggcccugcgcggacucccuaucagguaucaaacccccgcuaucaaggcggagcacacaggucgugaaauuguggacuugaugugucaugcaaccuucacuaugcggcugcucuccccagucagagugccuaacuacaaucugaucauuauggaugaggcccacuuuaccgaccccgcuaguauagccgcaaggggcuauaucucuacacgcguagaaaugggggaggccgcuggaauuuucaugacggcgacuccaccgggcagccgagauccuuuuccccaguccaacgccccaaucauggacgaggaaagagagauccccgaacggucauggaacucuggucacgagugggugaccgauuucaaggggaaaacaguuugguuugucccuagcauuaaggcaggaaacgacauagcugccugccuuaggaaaaauggcaagaaagugauccagcugagucgcaagaccuucgauuccgaauacgugaagacucgugcaaacgacugggauuuugucguaacaaccgacauuagcgagaugggcgccaauuucaaagcugagagagugaucgauccacggagguguaugaagcccguuauuuugacggacggggaagaacgcgugauccuagccggaccuaugccggucacucauucuucagcggcacaacgaagaggucggauaggcaggaaccccaaaaaugaaaacgaccaguauaucuacaugggggagccccuggaaaaugaugaggacugcgcccacuggaaggaggcuaaaaugcucuuagauaacauuaauacaccugaaggaaucauucccuccauguuugagccagaacgcgagaagguggacgccaucgauggcgaauacagacugaggggugaggcucggaaaaccuucguugaccuuaugcgucgcggggaucugccuguguggcucgcauauaaggucgccgcugagggcauaaacuacgccgaccgaaagugguguuuugauggaauuaaaaauaaccagaucuuggaagagaacguggaaguagagauuuggaccaaggagggcgaaaggaaaaagcugaaacccagguggcucgacgcacggaucuauagugauccacuggcgcuuaaggaguucaaggaguucgccgcugggcgcaaaagccuaacucugaauuugauaacagagaugggaagauuaccuaccuuuaugacacagaaggccaggaacgcacuggacaaucucgcugugcugcauacugccgaagccgguggacgggcauacaaccacgcucuuucggagcugccggagacgcucgaaaccuugcugcuacugacacuccuugcgacuguuaccgggggaaucuuccuguuuuuaaugucuggcaaagguauugggaagaugacauugggcaugugcugcaucauuaccgccuccguccugcucugguaugcacaaauccagccccacuggauagcugccagcauuauccuggaguucuuucuuaucgugcugcucauuccagaaccugagaaacagcgaacuccccaggauaaucaauugacguacguggucaucgccauacugaccguuguggcagcuacaauggccaacgaaaugggauucuuagagaagacuaagaaagaccuaggccuggggucaauuaccacacaggagagugaaucuaauauccucgacauugaucuuagaccagcguccgcuuggacccuguaugccguagcaacuacauuugugacgccuauguugcgccauagcaucgagaacucaagugucaaugugagccugaccgccauagcuaaccaggcaacuguucucaugggacuggguaagggcuggccccuuuccaaaauggacaucggggugccgcuccuggccauuggauguuacucucaggucaauccaaucacauugaccgcggcucuguuacuacugguagcccacuacgcaauuaucggcccuggucuccaagccaaggcuaccagggaagcccagaaacgggcagcugccgggauuaugaagaaccccacaguggauggcaucacuguuauagaccuugagccaauucccuaugauccuaaguucgaaaaacagcugggacaggugauguugcugauccucugcgucacgcaagugcugaugaugcguaccacaugggcgcuuugugaggccuuaacucuggcaaccggcccgaucagcacacucugggaggggaaucccggaagauuuuggaacaccacuauugcugucuccauggccaauauauucaggggcucauacuuggccggugcugggcugcuauuuucuaucaugaagaacacgacaaauacccgccggggaacuggcaacauuggugaaacccugggcgagaaauggaagagucgacucaacgcccuugggaaaucggaguuccagaucuauaagaaaagcggcauucaggagguggacagaacacuggccaaggagggcaucaagagaggggaaacugaucaucacgcgguuucccgcggaucugcuaaauugcggugguuuguggagagaaauaugguaaccccagaaggcaagguggucgaccuggguugcgggcguggaggcuggucauacuauugugguggccucaaaaacguuagggaggugaaggggcugacaaaaggaggcccugggcaugaagaaccaauaccuaugagcacguacggauggaauuuaguccggcuucaauccggcguggauguauucuucaccccacccgagaagugcgacacucugcucugugauaucggugaaaguucuccuaacccaacaauugaggcagggcgcacccuacgagugcugaauuugguugaaaacuggcugaauuauaacacucaguuuugcaucaaggugcucaaucccuacaugccgagcgucauugagaaaauggaaacacuucagagaaaguacggaggcgcccuggugaggaacccuuugucaagaaauuccacccacgagauguauugggucaguaacgcuacgggcaauaucgugagcucuguuaacaugauaucccgcaugcugauuaauagauucaccaugaaacacaagaaagccacauacgagccagacguagaucucgggucaggaacuaggaacaucgguaucgaaagcgagauucccaacuuagacauaaucggcaagcgaauugaaaagaucaaacaggagcaugaaaccucguggcacuaugaccaagaucauccuuacaagacaugggcauaucacgggucuuacgagacuaaacagaccggaagugccuccagcauggugaauggcgucgugcggcugcuuacaaagccaugggacguugugcccauggucacccagauggcuaugacugauacgacaccguuuggucagcaacguguguucaaagagaagguagacaccagaacucaggaaccuaaggaggggaccaaaaagcugaugaaaauuacagcggaauggcuauggaaggagcucggcaaaaagaaaacgccccgcauguguaccagggaggaauuuacucggaaggugagaucaaacgccgcacugggcgcuaucuucacagaugagaauaaguggaaauccgcccgcgaagcaguugaggacggcagguuuugggaauuggucgaucgagagcggaaccugcaccucgaggggaagugcgaaaccuguguguauaauaugaugggaaaaagagagaagaaacuuggugaguucggcaaggccaaggggucuagggcuauaugguacauguggcugggagcccgcuuuuuagaguucgaagcgcugggcuuuuugaacgaggaccauugguucagccgugguaauagucucuccgggguggagggagaaggccugcaccggcuaggcuacauccuuagagaugucgggaaaaaggagggaggugcaauguaugccgacgauacugcuggcugggacacaaggauuacccuggaagaccucaaaaacgaggaaaugguuacaaaucauaugaagggggagcacaaaaagcuggccgaggcaaucuuuaaguugacuuaccagaacaaagugguacgcgugcagcgaccaaccccucggggaacggucauggauauuaucagcagaagggaccaacgcggcucuggucagguggggaccuauggacugaauacauucacuaacauggaagcucagcucauuagacaaauggagggcgaaggcauauucaagucaauccagcaucuuaccgccacagaggagauugcuguucagaauuggcuggcccggguggggagggaacguuuaagucgaauggcaaucuccggagaugacugcgucgugaaacccaucgaugaccgcuuugcgagcgcccugacugcuuugaacgauauggguaagguaagaaaagacauucagcaaugggagccaucucggggcuggaaugauuggacccagguucccuucugcucgcaccacuuucaugaacucgugaugaaggacgggaggguccugguggugccuugucgcaaccaggaugagcuaauaggacgggcacggaucucacagggcgcagguuggagccuuaaggaaacggcuugccuggggaaauccuacgcccaaauguggacacucauguauuuccacaggcgagaccugcguuuggcagccaacgcgauuuguagugcugucccaucucauuggguuccgaccagcagaacuacaugguccauccacgccaagcacgaguggaugaccacugaggauauguuagcaguguggaaucgcguauggauucaggaaaaccccuggauggaggacaaaaccccuguggaaucaugggaggaagucccauaccugggaaagcgggaggaccaguggugcggcagucucaucggccuuacaucuagggccacgugggcuaaaaauauacagaccgccaucaaccaagugagaagccugauugggaaugaggaauauacugauuacaugcccuccaugaagcgcuuucggagggaggaagaggaagcaggaguucuaugguga

SEQ ID NO: 14750 - RNA, 9876 nt, Artificial Sequence
  derived and/or modified CDS sequence (opt3) from DENV-2__FJ639822__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucggggucucuaacagggauuuuguggaaggaguaucggguggcucauggguugacauagugcucgagcacgggagcugugucacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuauuugcaagcauucuaugguggauagaggcugggguaacggguguggacuauucggcaagggcgggaucgugaccugcgccauguuuacaugcaaaaagaauauggaaggaaaagucguucagccugagaaccucgaauacaccaucgugauuacuccacacagcggugaggagcaugcuguaggcaaugacacggggaagcacggaaaagaaauaaagaucacaccgcaguccucaauuaucgaggccgaacugaccggcuaugguacugugaccauggaguguagucccaggacagggcuugauuucaacgaaaugguccuguugcaaauggaggacaaagcauggcucgugcaccggcagugguuucuggauuuaccucugccauggcuccccggcgcugacacccagggaagcaauuggauacagaaggagacucuuguuacauucaagaacccucaugccaaaaagcaagacguggucgugcugggcucucaggaaggggcgaugcacacggccuugaccggagcaacugagauucagauguccucagguaaucuacuguuuacaggccaucucaaaugccgucugcgcauggauaagcuucaacugaaagggaugagcuacaguauguguaccggaaaguucaagaucguaaaagaaaucgcugagacacagcacggcacuauuguuaucagagugcaguaugagggugacgggucuccaugcaagauucccuucgaaauaaccgauuuggagaaaaggcauguccucggccggcugaucacggugaacccgauugucaccggaaaggacuccccugugaacaucgaagccgagcccccauuuggcgauagcuacaucauuauagggguugaaccuggacaguuaaaacugaauugguucaagaaggguucgucuaucggccaaauguuugagacaacuaugcgaggggcuaaacgcauggccauucuaggagacaccgcaugggauuucggcucccucggugggguguuuacaucaaucggcaaggcccugcaccagguauucggagcuauuuacggcgcggcauuuaguggggucagcuggacuaugaaaauccuuauaggagugaucauuaccuggaucggcaugaacuccagaucuacgagcuugucaguuagucuggugcucgucggugugguaacacuguaucuuggggccauggugcaggcugacuccggauguguugucagcuggaagaauaaagagcugaagugcggcucugguauuuucaucaccgauaacgugcacacuuggacagaacaguacaaguuucaacccgagucaccaaguaaauuggccagcgcaauacagaaggcccaugaagagggcauuugugggaucagguccgugacccggcucgaaaaucugauguggaaacagauuacucccgaguuaaaccacauccugucugagaaugaagucaagcuaaccauaaugacaggagacaucaaaggcauuaugcaggcugggaagcgcucgcucagaccucaaccaacggagcugaaauauagcuggaagaccuggggaaaggccaaaaugcuuuccacugaaucacauaaccagacauucuugaucgauggcccggagaccgcagaaugccccaauacaaacagggcguggaauagucuggagguugaggacuacgguuuugggguguucacuaccaacauuuggcucaagcugcgugaaaaacaggacguguuuugugauucuaaguuaaugagcgcugccaucaaagacaaucgggcaguacacgccgauaugggauauuggauagaguccgcucugaacgacacguggaagauggaaaaggccucauucauugaggucaaaagcugccacuggccuaagucucauacacuuugguccaauggcguguuggagagugaaaugaucaucccaaaaaacuucgcaggucccguuagccagcacaacuaccgaccuggcuaucauacccaaacugcugggccauggcaccucggaaagcuggagauggauuuugacuucugugaaggcaccacaguggucgugacugaggauugcgggaauagaggacccucucuaaggaccacaacggccuccggcaaacugauuaccgaauggugcugucgcucaugcacucucccgccucugcgguacagaggugaggacggguguugguacggaauggagaucaggccacuuaaggaaaaggaggaaaacuugguuaauagucuggugacagcgggccauggucagauugauaacuuuagcuuaggcguacucgggauggcccuguuccuugaggaaaugcugcgcacccgagucggaacuaaacacgcuauauugcucguggcagugucguuugucacacugaucaccggcaauauguccuuccgggaccuagggcguguuauggugaugguaggagccacgaugacugaugacauuggcaugggugugaccuaucuggcucuccuggccgcauuuaaggucagacccacauucgcggccgggcuuuugcugaggaaauuaaccucuaaggagcucaugauggcuacuaucggaauugcccugcuuagccagucaacaaucccugagaccauacuggaacuaacagaugcacucgcucugggcaugaugguguugaaaaucguucgcaacauggagaaguaccaacuggccgugacugucauggcaauuaguugcgugcccaaugccguuaucuuacagaacgcuuggaagguguccuguaccauucucgcggccgucucuguaagcccacugcuucugacguccucacagcagaaagcagacuggaucccuuuggcucucacaauaaagggccugaaucccaccgccauuuuucuaacuacccugagccggacaaguaaaaagagaucuuggccacuuaacgaagccaucauggcuguggggaugguuuccauccucgcaagcucgcuguugaaaaaugacauuccgaugacuggaccucugguggccgguggcuuacucaccgucugcuaugugcugacggggaggucagcggaucuugagcuggaacgagcugccgacguaaagugggaggaucaagcagagauaucuggaaguucccccaucuugagcauuacaaucucugaagacggcagcauguccauuaaaaacgaggaagaggagcagacccucacuauccugauacgcacaggucuacuggugaucucaggggucuucccaguuaguauucccaucaccgccgcugcaugguaccuuugggaagugaagaagcagcgggccggagugcucugggaugucccuagcccacccccugugggcaaagcggagcuggaagacggcgcuuauagaauuaagcagagggggaucuugggauacucucaaauaggugccggcguuuauaaagaggggacuuuucacacaauguggcauguaacccguggagcaguguuaaugcaccgcggcaagcggauugaaccguccugggccgaugucaaaaaggaccugaucucauacggugggggauggaagcucgagggcgaguggaaagaaggcgaggaagugcagguucuggcucuugagccagggaagaaucccagagccgugcagacgaaaccuggaaucuucaagacuaacaccgguacaauuggcgcagucagucuggauuuuagcccagggaccuccggaucucccaucguggacaggaaaggcaagguagucgguuuguacgggaauggagugguuacacgaucgggcgcuuaugugagcgccauagcgcagacugaaaagucaauugaggauaacccugagaucgaagacgauauuuuccggaaaaagcgccuaaccaucauggaccugcauccgggcgccgggaaaacgaagagauaccuccccgcaauagucagggaggcuauuaaacggggacugcgaacacuuaucuuagccccaacuagagugguugcugcagaaauggaggaagcccugcgcggucucccuaucagguaucaaacccccgccauuaaggcugagcacacaggccgugagaucguggacuugaugugucaugcgaccuucacuaugcggcugcucuccccagucagagugccuaacuacaaucugauuauaauggaugaagcacacuuuaccgaccccgccaguaucgcugccaggggguauauuucuacacgcguagagaugggagaagcagccggcaucuucaugacggcuacuccaccggguagccgagauccuuuuccccaguccaacgcgccaaucauggacgaggagagagaaauucccgagcggucauggaauucugggcacgaaugggugaccgauuucaagggaaaaacaguuugguuugucccuagcauaaaggccggcaacgacaucgcagcuugccuuaggaaaaauggcaagaaagugauucagcugagucgcaagaccuucgauuccgaguacgugaagacucgugccaacgacugggauuuugucguaacaaccgacaucagcgaaaugggggcaaauuucaaagccgagagagugauugauccacggagguguaugaagcccguuaucuugacggacggagaggaacgcgugauacuagcugguccuaugccggucacucauucuucagccgcgcaacgaagaggccggaucgggaggaacccaaaaaaugagaacgaccaguauauuuacaugggagaaccccuggagaaugaugaagacugcgcacacuggaaggaggccaaaaugcucuuagauaacaucaauacaccugagggcauuauccccuccauguuugaaccagagcgcgaaaagguggacgcuauagauggugaguacagacugaggggggaagcccggaaaaccuucguugaccuuaugcgucgcggcgaucugccuguguggcucgcuuauaaggucgcagccgagggaauuaacuacgcugaccgaaagugguguuuugauggcaucaaaaauaaccagauuuuggaggaaaacguggagguagaaaucuggaccaaggagggggagagaaaaaagcugaaacccagguggcucgacgcccggauauauagugauccacuggcacuuaaggaauucaaggaguucgcggccggacgcaaaagccuagcucugaauuugaucacugaaauggguagauuaccuacauuuaugacccagaaggccaggaacgcacuggacaaucucgcugugcugcauacagccgaggcaggcgggcgggccuacaaccacgcucuuucggaacugccggagacucucgagacguugcugcuacugacccuccuugcgacaguuacuggaggcauuuuccuguuuuuaaugucugguaaagggaucggcaagaugaccuugggaaugugcugcauuaucacagccuccguccugcucugguaugcacaaauacagccccacuggauugcugccagcaucauccuggaauucuuucuuauugugcugcucaucccagagccugaaaaacagcgaaccccccaggauaaucaauugacuuacguggucauagccauucugacgguuguggcagcuaccauggccaacgagaugggcuucuuagaaaagacaaagaaagaccuagggcugggaucaaucacuacccaggagagugagucuaauauucucgacaucgaucuuagaccagcguccgcuuggacacuguaugccguagcaaccacuuuugugacaccuauguugcgccauagcauagaaaacucaagugucaaugugagccugacggccaucgcuaaccaggcaaccguucucaugggucugggcaagggguggccccuuuccaaaauggacauuggagugccgcuccuggccaucggcuguuacucucaggucaauccaauuacuuugacagcggcucuguuacuacugguagcccacuacgcaaucauugguccugggcuccaagccaaggcuaccagggaggcccagaaacgggcagcugccggcaucaugaagaaccccaccguggauggaauaacaguuauugaccuugaaccaauccccuaugauccuaaguucgagaaacagcugggccaggugauguugcugauccucugcgucacucaagugcugaugaugcguacgaccugggcgcuuugugaagccuuaacacuggcaacugggccgauuagcacccucugggagggaaaucccggcagauuuuggaacacaaccauagcugucuccauggccaauaucuucagggguucauacuuggcaggggcuggacugcuauuuucuauuaugaagaacacuacgaauacacgccggggcaccgguaacaucggcgagacucugggggaaaaauggaagagucgacucaacgcccuuggaaaaucggaguuccagauuuauaagaaaagcggcauccaggaaguggacagaacccuggccaaggaggggauaaagaggggagagacagaucaucacgcgguuucccgcggcucugcuaaauugcggugguuuguggaaagaaauaugguaacuccagaggguaagguggucgaccuggggugcggacguggcgguuggucauacuauuguggcgggcucaaaaacguuagggaagugaagggacugaccaaaggcgggccuggacaugaggaacccaucccuaugagcacauacggcuggaauuuaguccggcuucaauccgguguggauguauucuucacgccacccgagaagugcgacacccugcucugugauauuggggagaguucuccuaacccaacuaucgaagcaggacgcacacuacgagugcugaauuugguugagaacuggcugaauaacaauacccaguuuugcauuaaggugcucaaccccuauaugccgagcgucaucgaaaaaauggagacucuucagagaaaguacggcggcgcccuggugaggaauccuuugucacggaacuccacacacgaaauguacugggucaguaaugcuaccgggaacauagugagcucuguuaauaugauuucccgcaugcugaucaacagauucacgaugaaacacaagaaagccaccuaugagccagacguagaucucggaucagguacaaggaacaucggcauugagagcgaaauacccaauuuagacaucauugggaagcgaaucgagaagauuaaacaggaacaugagacuucguggcacuacgaccaagaucauccuuauaagaccugggcauaccacggaucuuaugaaacaaaacagacuggcagugccuccagcauggugaacggugucgugcggcugcuuaccaagccaugggacguugugcccauggucacacagauggcuaugaccgauacuacgccguuugggcagcaacguguguucaaagagaagguagacacaagaacccaggagccuaaggaaggaacuaaaaagcugaugaaaaucaccgcggaguggcuauggaaggaacucggcaaaaagaaaacaccccgcauguguacgagggaggaguuuacccggaaggugagaucaaaugccgcacugggcgcuauauucacugaugaaaacaaguggaaauccgcccgcgaggcaguugaagacgggagguuuugggaguuggucgaucgagaacggaaucugcaccucgagggaaagugcgagacauguguguacaacaugauggguaaaagagaaaagaaacuuggcgaguucgggaaggccaagggaucuagggcuaucugguauauguggcugggcgcccgcuuuuuagaauucgaggcgcuggguuuuuugaaugaagaccauugguucagccgugggaacagucucuccggaguggagggcgagggccugcaccggcuaggguacauucuuagagaugucggaaaaaaggaagguggcgcaauguacgccgacgauaccgcugggugggacacuaggaucacacuggaggaccucaaaaaugaagagaugguuaccaaccauaugaagggagaacacaaaaagcuggccgaggcaauuuuuaaguugacauaucagaauaaagugguacgcgugcagcgaccaacuccucggggcaccgucauggauaucauuagcagaaaggaccaaagggguucugggcaggugggaacguacggccugaacaccuucacaaauauggaggcucagcucauacgccaaauggaaggcgaggggaucuucaaaucaauucagcaucuuacugccaccgaagagaucgcuguucagaacuggcugacaagagugggacgggagagguuaagucguauggccaucuccggugaugacugcgucgugaagcccauugaugaccgauuugcaagcgcgcugacugccuugaaugauaugggcaaaguacgcaaggacauacagcaaugggaaccaucuagaggguggaacgauuggacccagguucccuucugcucgcaccacuuucaugagcucgugaugaaggacggacggguccugguggugccuuguaggaaccaggaugaacuaaucggccgcgcuagaauuucacagggugccggguggagccuuaaagagacggcaugccugggaaaguccuaugcucaaauguggacacucauguacuuccaccggagggaccugcgauuggccgcaaaugccaucuguagugcggucccaucucauuggguuccgaccagccguacuacaugguccauucacgcuaaacacgaauggaugaccacugaggauauguuagccguguggaacagaguauggauccaggagaaucccuggauggaagacaagaccccuguggagucaugggaagaggucccauaucugggcaaacgcgaagaccaguggugcggcagucucauagggcuuacaucucgggcaacgugggccaagaacauccagaccgcuauuaaucaagugaggagccugaucggaaacgaggaguacacugauuauaugcccuccaugaagagauuucgccgggaagaggaagaggccgguguucuaugguga

SEQ ID NO: 14751 - RNA, 9876 nt, Artificial Sequence
  derived and/or modified CDS sequence (opt3) from DENV-2__FJ850112__SS-prME
accgccggagugaucauuaugcugauacccacagcuauggcauuccaccucacuacgcguaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaggaacaggacaaacgauuuaucugcaagcauucuaugguggauagaggcugggguaacggguguggacuauucggcaagggcgggauugucacaugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucaucgaaaaggacuccccugugaacauugaggccgaacccccauuuggagauagcuacauaaucauuggcgucgagccugggcaguuaaaacugaauugguucaagaagggaucgucuaucggucaaauguuugagacaacuaugcgaggcgcuaaacgcauggccauucuaggggacaccgcaugggauuucggaucccucggcggugccuuuacaucaaucgggaaggcucugcaccagguguucggcgcgauauacggagcagccuuuaguggcguuagcuggacuaugaaaauccuuauuggggugguaaucaccuggauuggaaugaacuccagaucuacgagcuugucagucagucuggugcucguuggcguggucacacuguaucuuggugcuauggugcaggccgacuccggguguguagugagcuggaagaauaaagaacugaagugcggaucuggcaucuucauaaccgauaacguucacacuuggacagagcaguacaaguuucaacccgaaucaccaaguaaauuggcaagcgccauucagaaggcucaugaggaagguaucuguggcauuagguccgucacccggcucgagaaucugauguggaaacagaucacucccgaguuaaaccacauacugucugaaaaugaggugaagcuaaccaucaugacaggggacacgaaaggaauuaugcaggccggcaagcgcucgcucagaccucaaccaaccgaacugaaauauagcuggaagacuugggggaaggcaaaaaugcuuuccacagagucacauaaccagaccuucuugaucgauggaccggaaacagcggagugccccaauacuaacagggcuuggaauagucuggagguggaagacuacggcuuuggugucuucaccacgaacauuuggcucaagcugcgugagaaacaggacguauuuugugauucuaaguuaaugagcgccgcaaucaaagacaaucgggccgugcacgcugauaugggguauuggauagaauccgcccugaacgacacauggaagauggagaaggcaucauucauugaggugaaaagcugccacuggccuaagucucauacccuuugguccaauggaguauuggaaagugagaugaucauccccaagaacuucgcuggccccgucagccagcacaacuaccgaccugguuaucauacucaaaccgccggcccauggcaccucgggaagcuggaaauggauuuugacuucugugagggaacaacugugguugugaccgaagauugcggcaauagagggcccucucuaaggacaacgaccgcguccggaaaacugauuacugaguggugcugucgcucaugcacacucccgccucugcgguacagaggcgaggacgguuguugguacgggauggaaaucaggccacuuaaggagaaggaagagaacuuggucaauagucuggugaccgccggacauggccagauugauaacuuuagcuuagguguucucggcauggcucuguuccuugaagagaugcugcgcacucgaguggggacaaaacacgcaauauugcucguagccgucucguuugugacccugaucacgggaaauauguccuuccgggaccuaggccgugugauggucaugguuggggcuacuaugaccgaugacauuggaaugggcgugacauaucuggcccuccuggcagcguuuaagguaagacccaccuucgccgcuggucuuuugcugaggaaauuaacuucuaaggagcucaugauggccacaaucgggauuacccugcuuagccagucaacaaucccugaaacuauacuggagcuaaccgaugcacucgcucugggaaugaugguguugaaaaucguccgcaagauggaaaaguaccaacuggccgugacgauuauggcaaucaguugcguucccaacgccgugauuuuacggaaugcuuggaaagucuccuguacaauccucgcggccgugucuguuagcccacugcuucugaccuccucacagcagaaggcagacuggauaccuuuggcucucacuauuaaaggccugaaccccaccgccaucuuucuaacaacucugagcagaaccaguaagaaaaggucuuggccacuuaaugaggccaucauggcugugggcauggucuccauucucgcaagcucgcuguugaagaacgacauaccgaugacggggccucugguagccggagguuuacucacagugugcuauguucugaccggccgaucagcggaucuugaacuggagcgcgcugccgacgugaaaugggaggaucaggcagaaaucucugggaguucccccauuuugagcaucacuauuucugaggacggaagcauguccaucaagaaugaagaggaggaacaaacacucaccauacugauccggacuggccuacuggucauuucagguguguucccaguaaguauccccauuacagccgcugcaugguaccuuugggaggugaagaaacagagagccgggguccucugggauguuccuagcccacccccugugggaaaggcggaacuggaggacggcgcuuauaggaucaaacagcguggcauauugggguacucucagauuggagccgguguguauaaggaaggcaccuuucacacgauguggcaugucacucgcggggcaguguuaaugcaccggggaaaaagaaucgagccguccugggccgauguuaagaaggaccugaucucauacggcgguggguggaaacucgagggagaauggaaggagggcgaagagguacaagugcuggcucuugaaccaggcaaaaaccccagggccguccagaccaagccugggauuuucaaaacaaauaccggaacaaucggugcagugagucuggauuuuagcccaggcacuuccgggucucccauaguugaccgaaagggaaagguggucggcuuguacgguaacggggugguaacccggucgggagcuuaugucagcgccauugcgcagacggagaaaucaaucgaggauaauccugaaauugaggacgauaucuuccgcaagaaaagacuaacaauaauggaccugcauccgggcgccggcaagacuaaaagguaccuccccgcaauugugcgggaagcuaucaagcgagggcugagaacccuuaucuuagccccaacacgcguuguggcugcagagauggaagaggcccugaggggacucccuauucguuaucagacccccgccaucaaggcugagcacacuggucgggaaauugucgacuugaugugucaugcgaccuucacaaugagacugcucuccccagugaggguuccuaacuacaaccugauaaucauggaugaggcacacuuuacggaccccgccaguauugcugcccgcggcuauaucucuacucgaguggaaaugggggaggcagccggaaucuucaugaccgcuacaccaccgggcagcagagauccuuuuccccaauccaaugcgccaauuauggacgaggaacgggagauacccgaaaggucauggaacucuggucacgagugggucaccgauuucaaagggaagacugugugguuuguaccuagcaucaaagccggaaaugacauugcagcuugccuucgcaagaacggcaaaaaggugauccagcugagucguaagacauucgauuccgaauacguuaaaaccagagccaaugacugggauuuugucgugacgacugacauuagcgagaugggcgcaaacuucaaggccgagcgggugaucgauccaaggcgcuguaugaaacccgucauauugacagacggggaagaacgaguaauccuagcuggaccuaugccggugacccauucuucagccgcgcagagacgggguaggauuggccgcaauccaaagaacgaaaaugaccaauauaucuacaugggggagccccuggaaaacgaugaggacugcgcacacuggaaagaggccaagaugcucuuagauaauauuaacaccccugaaggaaucauacccuccauguuugagccagaaagagagaaaguugacgcuauugauggcgaauacaggcugcggggugaggcccguaagacuuucguggaccuuaugcgccgaggggaucugccugucuggcucgcuuauaagguggcagccgagggcaucaauuacgcugacagaaaaugguguuuugauggaauuaagaacaaucagaucuuggaagagaacguugaaguggagauauggacaaaagagggcgaaaggaagaaacugaagccccgguggcucgacgcccgcaucuauagugauccacuggcacuuaaggaguucaaagaguucgcggccgggagaaagagccuaacccugaacuugauuacagagaugggaagguuaccuacuuuuaugacgcagaaagcucggaaugcccuggacaaccucgcaguccugcauaccgcugaagccgguggccgagcauacaaucacgcccuuucggagcugccggagacacucgaaacuuugcugcuacugacccuccuugcuacagugaccgggggaaucuuccuguuuuuaaugucuggcaaggguauugggaaaaugacuuugggcaugugcugcaucauaacggcguccguacugcucugguaugcccagauucaaccccacuggaucgcagcuagcaucauucuggaguucuuucuuaucgugcugcucauaccagaaccugagaagcagagaaccccacaggauaaccaguugacauacguugucauugccauccugacugugguggccgcaaccauggcuaaugaaaugggauucuuagagaagaccaagaaggaccuaggccuggggucaauuaccacucaagagagugaaucuaacauccucgacauagaucuucgcccagccuccgcguggacacuguaugcugucgccacgaccuuuguuacuccuauguugaggcauagcaucgaaaauucaagugugaacguaagccugacagcaauugccaaucaggcuaccgugcucaugggacuggguaaaggcuggccccuuuccaagauggacaucggggucccgcuccuggcaauuggauguuacucucaggugaacccaaucaccuugacagccgcgcuguuacuacugguugcucacuacgccauuaucggcccuggucuccaggcaaaagccacucgggaagcucaaaagcgugccgcagcugggauaaugaagaaucccacgguggauggcauuaccgucaucgaccuugagccaauccccuaugauccuaaauucgaaaagcagcugggacagguaauguugcugauucucugcgugacacagguucugaugaugagaacuaccugggcccuuugugaggcguuaacacuggccaccggcccgauaagcacucucugggaggggaaccccggaagguuuuggaauacgacaaucgcaguguccauggcuaacauuuuccgcggcucauacuuggccggugcagggcugcuauuuucuaucaugaaaaauaccacuaacacccggcgaggaacaggcaauauuggugaaacucugggcgagaaguggaaaaguagacucaacgcucuugggaagucggaguuccaaaucuauaaaaagagcggaauacaggaggucgacaggacccuggccaaggagggcaucaaacgcggggaaacagaucaucacgccgugucccggggaucugcgaaguugagaugguuugucgagcguaacauggugacgccagaaggcaaaguuguggaccuggguugcgggaggggaggcuggucauacuauugugguggccucaagaauguacgggaggugaaagggcugaccaagggaggcccugggcaugaagaacccauuccuaugagcacuuacggauggaacuuaguccgccuucaguccggcguugauguguucuucacaccacccgagaagugcgacacccugcucugugauaucggugaaaguucuccuaauccaacuauugaggcugggcgaacacuaagaguccugaacuugguggaaaauuggcugaacaauaacacccaauuuugcaucaaaguacucaaucccuauaugccgagcgugauagagaagauggaaacgcuucagaggaaauacggaggcgcacugguucggaacccuuugucacgcaauuccacccacgagauguacugggugaguaacgccacaggcaauauugucagcucugugaacaugaucuccagaaugcugaucaauagguucacuaugaagcacaaaaaggcuaccuaugagccagacgucgaucucgggucaggaacacgaaacauugguauagaaagcgagauccccaacuuagacauuaucggcaagcggauugagaaaaucaagcaggagcaugaaacuucguggcacuacgaccaggaucauccuuauaaaaccugggccuaccacgggucuuaugagacaaagcaaaccggaagugcauccagcauggugaauggcguuguacgucugcuuacuaaaccaugggacgugguccccauggugacgcagauggccaugacagauaccacuccguuuggucagcagagaguuuucaaggagaagguggacacccgcacacaagaaccuaaagaggggacgaagaaacugaugaggauaaccgcugaauggcuauggaaggagcucggcaaaaagaaaacuccccggauguguacaagagaggaauuuacccgcaaggucaggucaaacgcggcccugggcgcaaucuucacugaugagaauaaguggaaauccgcucgagaagccguggaggacggccgguuuugggaauugguagauaaggagagaaaccugcaccucgaggggaaaugcgaaacauguguguacaauaugaugggaaagagggagaagaaacuuggugaguucggcaaagcaaaagggucucgcgccauuugguauauguggcugggagcuagauuuuuagaguucgaagcccugggcuuuuugaacgaggaccauugguucagccgggguaauagucucuccgggguugagggagaaggccugcacagacuaggcuacauccuuagggaugucgggaagaaagagggaggugcgauguacgcagacgauaccgccggcugggacacacgcauuacucuggaagaccucaagaacgaggaaauggugaccaaucauaugaaaggggagcacaagaagcuggcugaggccaucuuuaaauugacguaucagaacaaggugguccgaguucagcggccaaccccuagaggaacagugauggauauuauaagcaggcgcgaccagagaggcucuggucaaguagggacuuacggacugaauaccuucacaaacauggaagcacagcucauccggcagauggagggcgaaggcauuuucaaaucaauccaacaucuuacugcuaccgaggagaucgccgugcagaauuggcuggcuagggucgggcgugaacgauuaagucgcauggccauuuccggagaugacugcgugguuaagcccauagaugacagauuugcaagcgcgcugacggccuugaacgauauggguaaagugcggaaggacauccagcagugggagccaucuaggggcuggaaugauuggacacaaguccccuucugcucgcaccacuuucaugaacucgugaugaaggacgggcgcguacugguugugccuuguagaaaccaggaugagcuaauuggacgggcuaggaucucacagggcgccgguuggagccuuaaagaaaccgcaugccuggggaaguccuaugcucagauguggacucucauguacuuccaccgacgugaccugagauuggccgcaaacgccauuuguagugcggucccaucucauugggugccgacaagccgcaccacuugguccauccacgcuaaacacgaguggaugaccacagaggauauguuagccguguggaaucgggucuggauacaagaaaaccccuggauggaggacaagacgccuguugaaucaugggaggaagugccauaucugggaaaaagggaggaccaguggugcggcagucucaucggccuuaccucuagagcaacuugggccaagaauauucagacagcuaucaaccagguacgcagccugauugggaaugaggaauacaccgauuauaugcccuccaugaagcgguuuaggcgagaggaagaggaagccggagugcuaugguga

SEQ ID NO: 14752 - RNA, 9876 nt, Artificial Sequence
  derived and/or modified CDS sequence (opt3) from DENV-2__FJ850105__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgucaaagaaauugcugagacucagcacggcaccaucgugauuagaauacaguaugagggugacgggucuccaugcaagauccccuucgaaauuacggauuuggagaaaaggcauguacucggccggcugaucaccguuaacccgaucgugauugaaaaggacuccccugucaacauagaggccgaacccccauuuggagauagcuacaucauuaucggcgcugagccugggcaguuaaaacugaauugguucaagaagggaucgucuauuggucaaauguuugagacaacuaugcgaggcgccaaacgcauggcaauccuaggggacaccgccugggauuucggaucccucggcgguguguuuacaucaauagggaaggcucugcaccaggucuucggcgcgaucuacggagcagccuuuaguggcgugagcuggacuaugaaaauucuuaucgggguugugauuaccuggaucggaaugaacuccagaucuacgagcuugucaguaagucugguccucgugggcguugugacacuguaucuuggugcuaugguccaggccgacuccgggugugugguaagcuggaagaauaaagaacugaagugcggaucuggcauauucauuaccgauaacgugcacacuuggacagagcaguacaaguuucaacccgaaucaccaaguaaauuggcaagcgccauccagaaggcucaugaggaagguauuuguggcaucagguccguuacccggcucgagaaucugauguggaaacagauaacucccgaguuaaaccacauccugucugaaaaugaggucaagcuaaccauuaugacaggggacacgaaaggaaucaugcaggccggcaagcgcucgcucagaccucaaccaaccgaacugaaauauagcuggaagacuugggggaaggcaaaaaugcuuuccacagagucacauaaccagaccuucuugauugauggaccggaaacagcggagugccccaauacuaacagggcuuggaauagucuggagguggaagacuacggcuuugguguguucaccacgaacaucuggcucaagcugcgugagaaacaggacgucuuuugugauucuaaguuaaugagcgccgcaauaaaagacaaucgggccguucacgcugauaugggguauuggauugaauccgcccugaacgacacauggaagauggagaaggcaucauucaucgaggugaaaagcugccacuggccuaagucucauacccuuugguccaauggaguguuggaaagugagaugaucauuccaaaaaacuucgcuggccccguaagccagcacaacuaccgaccugguuaucauacucaaaccgccggcccauggcaccucgggaagcuggaaauggauuuugacuucugugagggaacaacugucgugguuaccgaagauugcggcaauagagggcccucucuaaggacaacgaccgcguccggaaaacugaucacugaguggugcugucgcucaugcacacucccgccucugcgguacagaggcgaggacgguuguugguacgggauggaaauuaggccacuuaaggagaaggaagagaacuuggugaauagucuggucaccgccggacauggccagauagauaacuuuagcuuaggugugcucggcauggcucuguuccuugaagagaugcugcgcacucgaguugggacaaaacacgcaaucuugcucguggccguaucguuugucacccugauuacgggaaauauguccuuccgggaccuaggccgugugauggugauggucggggcuacuaugaccgaugacaucggaaugggcguuacauaucuggcccuccuggcagcguuuaaggugagacccaccuucgccgcuggucuuuugcugaggaaauuaacuucuaaggagcucaugauggccacaauugggaucacccugcuuagccagucaacaauaccugaaacuauccuggagcuaaccgaugcacucgcucugggaaugaugguauugaaaauugugcgcaacauggaaaaguaccaacuggccgucacgaucauggcaauuaguugcgugcccaaugccguuaucuuacggaacgcuuggaagguguccuguacaauacucgcggccgucucugugagcccacugcuucugaccuccucacagcagaaagcagacuggauuccuuuggcucucacuaucaagggccugaaucccaccgccaucuuucuaacaacucugagcagaaccaguaaaaagaggucuuggccacuuaacgaggccauuauggcuguuggcaugguguccauacucgcaagcucgcuguugaaaaaugacaucccgaugacggggccucuggucgccggagguuuacucacaguaugcuaugugcugaccggccgaucagcggaucuugaacuggagcgcgcugccgacguuaagugggaggaucaggcagaaauuucugggaguucccccaucuugagcauuacuaucucugaggacggaagcauguccauaaaaaacgaagaggaggaacaaacacucaccauccugauucggacuggccuacuggugaucucaggugucuucccagugaguauucccaucacagccgcugcaugguaccuuugggagguaaagaagcagagagccggggugcucugggaugucccuagcccacccccuguuggaaaagcggaacuggaggacggcgcuuauaggauaaagcagcguggcauuuugggguacucucagaucggagccgguguguauaaagaaggcaccuuucacacgauguggcaugugacucgcggggcagucuuaaugcaccggggaaagagaaucgagccguccugggccgaugugaaaaaggaccugauuucauacggcgguggguggaagcucgagggagaauggaaagagggcgaagagguucaaguacuggcucuugaaccaggcaagaaucccagggccgugcagaccaaaccugggaucuucaagacaaacaccggaacaauaggugcagucagucuggauuuuagcccaggcacuuccgggucucccauuguggaccgaaaaggaaagguugugggcuuguacgguaauggggucgugacccggucgggagcuuauguaagcgccaucgcgcagacggagaagucaauugaggauaacccugaaaucgaggacgauauauuccgcaaaaagagacuaacaauuauggaccugcauccgggcgccggcaaaacuaagagguaccuccccgcaaucguccgggaagcuaucaaacgagggcugagaacccuuauuuuagccccaacacgcgugguugcugcagagauggaagaggcccugaggggacucccuauccguuaucagacccccgccauuaaggcugagcacacuggucgggaaauaguggacuugaugugucaugcgaccuucacaaugagacugcucuccccagucagggugccuaacuacaaucugaucauuauggaugaggcacacuuuacggaccccgccaguaucgcugcccgcggcuauaucucuacucgaguugaaaugggggaggcagccggaauuuucaugaccgcuacaccaccgggcagcagagauccuuuuccccaauccaacgcgccaauaauggacgaggaacgggagauccccgaaaggucauggaauucuggucacgagugggugaccgauuucaaggggaaaacugucugguuugugccuagcauuaaggccggaaacgacaucgcagcuugccuucgcaaaaauggcaagaaaguaauucagcugagucguaagacauucgauuccgaauacgugaagaccagagccaacgacugggauuuuguugucacgacugacaucagcgagaugggcgcaaauuucaaagccgagcgggugauagauccaaggcgcuguaugaagcccgugaucuugacagacggggaagagcgagucauucuagcuggaccuaugccgguaacccauucuucagccgcgcagagacgggguaggaucggccgcaacccaaaaaaugaaaacgaccaauauauuuacaugggggagccccuggaaaaugaugaggacugcgcacacuggaaggaggccaaaaugcucuuagauaacaucaauaccccugaaggaauaauucccuccauguuugagccagaaagagagaagguggacgcuaucgauggcgaauacaggcugcggggugaggcccguaaaacuuucguugaccuuaugcgccgaggggaucugccuguguggcucgcuuauaaggucgcagccgagggcauuaacuacgcugacagaaagugguguuuugauggaaucaaaaauaaccagauauuggaagagaacguggaaguugagaucuggacaaaggagggcgaaaggaaaaagcugaaaccccgguggcucgacgcccgcauuuauagugauccacuggcacuuaaggaguucaaggaauucgcggccgggagaaaaagccuaacccugaauuugaucacagagaugggaagguuaccuacuuuuaugacgcagaaggcucggaacgcccuggacaaucucgcagugcugcauaccgcugaagccgguggccgagcauacaaccacgcccuuucggagcugccggagacacucgaaacuuugcugcuacugacccuccuugcuacagucaccgggggaauuuuccuguuuuuaaugucuggcaaagguaucgggaagaugacuuugggcaugugcugcauaauuacggcguccgugcugcucugguaugcccagauccaaccccacuggaucgcagcuagcauuauccuggaguucuuucuuauaguacugcucauuccagaaccugagaaacagagaaccccccaggauaaucaguugacauacgugguuaucgccauucugacugucguggccgcaaccauggcuaacgaaaugggauucuuagagaagacaaagaaagaccuaggccuggggucaaucaccacucaagagagugaaucuaauauacucgacaucgaucuucgcccagccuccgcguggacacuguaugcuguggccacgaccuuugucacuccuauguugaggcauagcauugagaacucaaguguuaaugugagccugacagcaaucgccaaccaggcuaccguacucaugggacuggguaagggcuggccccuuuccaaaauggacauuggggugccgcuccuggcaaucggauguuacucucaggucaauccaauuaccuugacagccgcgcuguuacuacugguggcucacuacgccaucauaggcccuggucuccaggcaaaggccacucgggaagcucaaaaacgugccgcagcugggauuaugaagaaccccacgguugauggcaucaccgugaucgaccuugagccaauucccuaugauccuaaguucgaaaaacagcugggacaggucauguugcugauacucugcguaacacaggugcugaugaugagaacuaccugggcccuuugugaggcguuaacacuggccaccggcccgaucagcacucucugggaggggaaucccggaagguuuuggaacacgacaauugcaguuuccauggcuaauaucuuccgcggcucauacuuggccggugcagggcugcuauuuucuauuaugaagaacaccacuaauacccggcgaggaacaggcaacaucggugaaacucugggcgagaaauggaagaguagacucaacgcucuugggaaaucggaauuccaaauauauaagaaaagcggaauccaggagguggacaggacccuggccaaggagggcauuaagcgcggggaaacagaucaucacgccgucucccggggaucugcgaaauugagaugguuuguggagcguaauauggucacgccagaaggcaaggugguugaccuggguugcgggaggggaggcuggucauacuauugugguggccucaaaaacgugcgggagguaaaggggcugaccaaaggaggcccugggcaugaagagcccaucccuaugagcacuuacggauggaauuuagugcgccuucaguccggcgucgauguuuucuucacaccacccgagaagugcgacacccugcucugugauauuggugaaaguucuccuaacccaacuaucgaggcugggcgaacacuaagagugcugaauuuggucgaaaacuggcugaauaacaauacccaauuuugcauaaaggugcucaaccccuauaugccgagcguaauugagaaaauggaaacgcuucagaggaaguacggaggcgcacuggugcggaauccuuugucacgcaacuccacccacgagauguacuggguuaguaaugccacaggcaacaucgugagcucugucaauaugaucuccagaaugcugauuaacagguucacuaugaaacacaagaaagcuaccuaugagccagacguggaucucgggucaggaacacgaaacauagguaucgaaagcgagauucccaauuuagacaucauuggcaagcggaucgaaaagauaaaacaggagcaugaaacuucguggcacuacgaccaggaucauccuuauaagaccugggccuaccacgggucuuaugagacaaaacaaaccggaagugcauccagcauggucaacggcgugguucgucugcuuacuaagccaugggacguagugcccauggucacgcagauggccaugacagauaccacuccguuuggucagcagagaguguucaaagagaagguugacacccgcacacaagaaccuaaggaggggacgaaaaagcugaugaggaucaccgcugaauggcuauggaaagagcucggaaagaaaaagacuccccggauguguacaagagaggaauuuacccgcaaagugaggucaaaugcggcccugggcgcaauuuucacugaugagaacaaguggaaguccgcucgagaagccgucgaggacggccgguuuugggaauugguggauaaagagagaaaucugcaccucgaggggaagugcgaaacauguguauacaacaugaugggaaaaagggagaagaaacuuggugaauucggcaaggcaaaggggucucgcgccaucugguauauguggcugggagcucguuuuuuagaguucgaagcccugggcuuuuugaaugaggaccauugguucagccgggguaacagucucuccgggguggagggagaaggccugcacagacuaggcuacauucuuagggauguugggaaaaaggagggaggugcgauguacgcagacgauaccgccggcugggacacacgcaucacucuggaagaccucaaaaaugaggaaauggucaccaaccauaugaagggggagcacaaaaagcuggcugaggccauuuuuaaguugacguaucagaauaaaguggugcgaguccagcggccaaccccuagaggaacaguuauggauauaaucagcaggcgcgaccagagaggcucuggucaaguggggacuuacggacugaacaccuucacaaauauggaagcacagcucauucggcagauggagggcgaaggcaucuucaagucaauccaacaucuuacugcuaccgaggagauugccguacagaacuggcuggcuaggguggggcgugaacgauuaagucgcauggccauauccggagaugacugcgucgugaaacccaucgaugacagauuugcaagcgcgcugacggccuugaaugauauggguaagguucggaaagacauucagcagugggagccaucuaggggcuggaacgauuggacacaagugcccuucugcucgcaccacuuucaugaacucgucaugaaggacgggcgcgugcugguaguuccuuguagaaaccaggaugagcuaaucggacgggcuaggauuucacagggcgccgguuggagccuuaaggaaaccgcaugccuggggaaauccuaugcucagauguggacucucauguacuuccaccgacgugaccugagauuggccgcaaaugccaucuguagugcggugccaucucauugggucccgacaagccgcaccacuugguccauacacgcuaagcacgaguggaugaccacagaggauauguuagccguguggaaccggguguggauccaagaaaaucccuggauggaggacaaaacgccugucgaaucaugggaggaaguuccauaucugggaaagagggaggaccaguggugcggcagucucauuggccuuaccucuagagcaacuugggccaaaaacauccagacagcuauuaaucaggugcgcagccugaucgggaacgaggaauacaccgauuauaugcccuccaugaagcgguuuaggcgagaggaagaggaagccggaguacuaugguga

SEQ ID NO: 14753 - RNA, 9876 nt, Artificial Sequence
  derived and/or modified CDS sequence (opt3) from DENV-2__FJ850106__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaagcuucaacugaaagggaugagcuacaguauguguacaggaaaguucaagaucgucaaagaaauugcugagacucagcacggcaccaucgugauuagaauacaguaugagggugacgggucuccaugcaagauccccuucgaaauuacggauuuggagaaaaggcauguacucggccggcugaucaccguuaacccgaucgugauugaaaaggacuccccugucaacauagaggccgaacccccauuuggagauagcuacaucauuaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaauagggaaggcccugcaccagguguucggcgcuaucuacggagcggcauuuaguggcguuagcuggacuaugaaaauucuuaucggggugguaauuaccuggaucggaaugaacuccagaucuacgagcuugucagucagucuggugcucguuggcguggucacacuguaucuuggugccauggugcaggcugacuccggguguguagugagcuggaagaauaaagaacugaagugcggaucuggcauauucauuaccgauaacguucacacuuggacagagcaguacaaguuucaacccgaaucaccaaguaaauuggccagcgcaauccagaaggcccaugaggaagguauuuguggcaucagguccgucacccggcucgagaaucugauguggaaacagauaacucccgaguuaaaccacauccugucugaaaaugaggugaagcuaaccauuaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguuuuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauuccaaaaaacuucgcaggccccgucagccagcacaacuaccgaccugguuaucauacucaaaccgcuggcccauggcaccucgggaagcuggaaauggauuuugacuucugugagggaacaacugugguugugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggucaauagucuggugaccgcgggacauggccagauagauaacuuuagcuuagguguucucggcauggcccuguuccuugaagagaugcugcgcacucgaguggggacaaaacacgcuaccuugcucguagcagccucguuugucacgcugaucacuggaaauauguccuuccgggaccuaggccgugugauggugauggucggggcuaccaugacagaugacauuggaaugggcguuaccuaucuggcccuccuggcagcguuuaaggugagacccacuuucgccgcuggucuuuugcugaggaaauuaacaucuaaggagcucaugauggccaccaucgggauuacacugcuuagccagucaacuaucccugaaaccauacuggagcuaacggaugcacucgcucugggaaugaugguauugaaaaucgugcgcaacauggaaaaguaccaacuggccgucacaauuauggcaaucaguugcgugcccaaugccguuauuuuacggaacgcuuggaagguguccuguaccauccucgcggccgucucugugagcccacugcuucugacuuccucacagcagaaagcagacuggauaccuuuggcucucaccauuaagggccugaaucccacagccaucuuucuaacuacccugagcagaacgaguaaaaagaggucuuggccacuuaacgaggccaucauggcuguuggcaugguguccauucucgcaagcucgcuguugaaaaaugacauaccgaugacagggccucuggucgccggagguuuacucaccguaugcuaugugcugacuggccgaucagcggaucuugaacuggagcgcgcugccgacguuaagugggaggaucaggcagaaaucucugggaguucccccauuuugagcaucacaauuucugaggacggaagcauguccaucaaaaacgaagaggaggaacaaacccucacuauacugauccggacaggccuacuggugauuucaggugucuucccagugaguauccccauuaccgccgcugcaugguaccuuugggagguaaagaagcagagagccggggugcucugggaugucccuagcccacccccuguuggaaaagcggaacuggaggacggcgcuuauaggaucaagcagcguggcauauugggguacucucagauuggagccgguguguauaaagaaggcacguuucacacuauguggcaugugacccgcggggcagucuuaaugcaccggggaaagagaaucgagccguccugggccgaugugaaaaaggaccugaucucauacggcgguggguggaagcucgagggagaauggaaagagggcgaagagguucaaguacuggcucuugaaccaggcaagaaucccagggccgugcagacaaaaccugggauuuucaagaccaacacaggaacuaucggugcagucagucuggauuuuagcccaggcaccuccgggucucccauaguggaccgaaaaggaaagguugugggcuuguacgguaauggggucgugacgcggucgggagcuuauguaagcgccauugcgcagacagagaagucaaucgaggauaacccugaaauugaggacgauaucuuccgcaaaaagagacuaacuauaauggaccugcauccgggcgccggcaaaaccaagagguaccuccccgcaauuguccgggaagcuaucaaacgagggcugagaacacuuaucuuagccccaacccgcgugguugcugcagagauggaagaggcccugaggggacucccuauucguuaucagacucccgccaucaaggcugagcacaccggucgggaaauuguggacuugaugugucaugcgacauucacgaugagacugcucuccccagucagggugccuaacuacaaucugauaaucauggaugaggcacacuuuacugaccccgccaguauugcugcccgcggcuauaucucuacccgaguugaaaugggggaggcagccggaaucuucaugacagcuaccccaccgggcagcagagauccuuuuccccaauccaacgcgccaauuauggacgaggaacgggagauacccgaaaggucauggaauucuggucacgagugggugacugauuucaaggggaaaacagucugguuugugccuagcaucaaggccggaaacgacauugcagcuugccuucgcaaaaauggcaagaaaguaauccagcugagucguaagaccuucgauuccgaauacgugaagacgagagccaacgacugggauuuuguugucacuacagacauuagcgagaugggcgcaaauuucaaagccgagcgggugaucgauccaaggcgcuguaugaagcccgugauauugaccgacggggaagagcgagucauccuagcuggaccuaugccgguaacccauucuucagccgcgcagagacgggguaggauuggccgcaacccaaaaaaugaaaacgaccaauauaucuacaugggggagccccuggaaaaugaugaggacugcgcacacuggaaggaggccaaaaugcucuuagauaacauuaauacuccugaaggaaucauacccuccauguuugagccagaaagagagaagguggacgcuauugauggcgaauacaggcugcggggugaggcccguaaaacauucguugaccuuaugcgccgaggggaucugccuguguggcucgcuuauaaggucgcagccgagggcaucaacuacgcugacagaaagugguguuuugauggaauuaaaaauaaccagaucuuggaagagaacguggaaguugagauauggaccaaggagggcgaaaggaaaaagcugaaaccccgguggcucgacgcccgcaucuauagugauccacuggcacuuaaggaguucaaggaauucgcggccgggagaaaaagccuaacacugaauuugauuacugagaugggaagguuaccuacguuuaugacccagaaggcucggaacgcccuggacaaucucgcagugcugcauacagcugaagccgguggccgagcauacaaccacgcccuuucggagcugccggagacucucgaaaccuugcugcuacugacacuccuugcuaccgucacugggggaaucuuccuguuuuuaaugucuggcaaagguauugggaagaugacguugggcaugugcugcaucauaaccgcguccgugcugcucugguaugcccagauucaaccccacuggaucgcagcuagcaucauucuggaguucuuucuuaucguacugcucauaccagaaccugagaaacagagaacaccccaggauaaucaguugacuuacgugguuauugccauccugaccgucguggccgcaacaauggcuaacgaaaugggauucuuagagaagaccaagaaagaccuaggccuggggucaauuacuacacaagagagugaaucuaauauccucgacauagaucuucgcccagccuccgcguggacgcuguaugcuguggccaccacuuuugucacaccuauguugaggcauagcaucgagaacucaaguguuaaugugagccugaccgcaauugccaaccaggcuaccguacucaugggacuggguaagggcuggccccuuuccaaaauggacaucggggugccgcuccuggcaauuggauguuacucucaggucaauccaaucacauugacugccgcgcuguuacuacugguggcucacuacgccauuaucggcccuggucuccaggcaaaggccacgcgggaagcucaaaaacgugccgcagcugggauaaugaagaaccccaccguugauggcauuacagugaucgaccuugagccaauccccuaugauccuaaguucgaaaaacagcugggacaggucauguugcugauucucugcguaacucaggugcugaugaugagaaccacaugggcccuuugugaggcguuaacccuggccacuggcccgauaagcacgcucugggaggggaaucccggaagguuuuggaacacaaccaucgcaguuuccauggcuaauauuuuccgcggcucauacuuggccggugcagggcugcuauuuucuaucaugaagaacacuaccaauacacggcgaggaacuggcaacauuggugaaacccugggcgagaaauggaagaguagacucaacgcucuugggaaaucggaauuccaaaucuauaagaaaagcggaauacaggagguggacaggacacuggccaaggagggcaucaagcgcggggaaacggaucaucacgccgucucccggggaucugcgaaauugagaugguuuguggagcguaauauggucaccccagaaggcaaggugguugaccuggguugcgggaggggaggcuggucauacuauugugguggccucaaaaacgugcgggagguaaaggggcugacuaaaggaggcccugggcaugaagagcccauuccuaugagcacauacggauggaauuuagugcgccuucaguccggcgucgauguuuucuucaccccacccgagaagugcgacacucugcucugugauaucggugaaaguucuccuaacccaacaauugaggcugggcgaacccuaagagugcugaauuuggucgaaaacuggcugaauaacaauacgcaauuuugcaucaaggugcucaaccccuauaugccgagcguaauagagaaaauggaaacccuucagaggaaguacggaggcgcacuggugcggaauccuuugucacgcaacuccacacacgagauguacuggguuaguaaugccacuggcaacauugugagcucugucaauaugaucuccagaaugcugaucaacagguucaccaugaaacacaagaaagcuacauaugagccagacguggaucucgggucaggaacucgaaacauugguauagaaagcgagauccccaauuuagacauuaucggcaagcggauugaaaagaucaaacaggagcaugaaaccucguggcacuacgaccaggaucauccuuauaagacaugggccuaccacgggucuuaugagaccaaacaaacuggaagugcauccagcauggucaacggcgugguucgucugcuuacgaagccaugggacguagugcccauggucacacagauggccaugaccgauacuaccccguuuggucagcagagaguguucaaagagaagguugacacacgcacgcaagaaccuaaggaggggaccaaaaagcugaugaggauaacugcugaauggcuauggaaagagcucggaaagaaaaagacaccccggauguguaccagagaggaauuuacucgcaaagugaggucaaaugcggcccugggcgcaaucuucacagaugagaacaaguggaaguccgcucgagaagccgucgaggacggccgguuuugggaauugguggauaaagagagaaaucugcaccucgaggggaagugcgaaaccuguguauacaacaugaugggaaaaagggagaagaaacuuggugaauucggcaaggcaaaggggucucgcgccauuugguauauguggcugggagcucguuuuuuagaguucgaagcccugggcuuuuugaaugaggaccauugguucagccgggguaacagucucuccgggguggagggagaaggccugcacagacuaggcuacauccuuagggauguugggaaaaaggagggaggugcgauguacgcagacgauacagccggcugggacacucgcauuacccuggaagaccucaaaaaugaggaaauggucacgaaccauaugaagggggagcacaaaaagcuggcugaggccaucuuuaaguugaccuaucagaauaaaguggugcgaguccagcggccaacaccuagaggaacuguuauggauauuauaagcaggcgcgaccagagaggcucuggucaaguggggaccuacggacugaacacauucacuaauauggaagcacagcucauccggcagauggagggcgaaggcauuuucaagucaauccaacaucuuaccgcuacggaggagaucgccguacagaacuggcuggcuaggguggggcgugaacgauuaagucgcauggccauuuccggagaugacugcgucgugaaacccauagaugacagauuugcaagcgcgcugacagccuugaaugauauggguaagguucggaaagacauccagcagugggagccaucuaggggcuggaacgauuggacccaagugcccuucugcucgcaccacuuucaugaacucgucaugaaggacgggcgcgugcugguaguuccuuguagaaaccaggaugagcuaauuggacgggcuaggaucucacagggcgccgguuggagccuuaaggaaacugcaugccuggggaaauccuaugcucagauguggacacucauguacuuccaccgacgugaccugagauuggccgcaaaugccauuuguagugcggugccaucucauugggucccgaccagccgcacuaccugguccauccacgcuaagcacgaguggaugacaacggaggauauguuagccguguggaaccggguguggauacaagaaaaucccuggauggaggacaaaaccccugucgaaucaugggaggaaguuccauaucugggaaagagggaggaccaguggugcggcagucucaucggccuuacuucuagagcaacaugggccaaaaacauucagaccgcuaucaaucaggugcgcagccugauugggaacgaggaauacacugauuauaugcccuccaugaagcgguuuaggcgagaggaagaggaagccggaguacuaugguga

SEQ ID NO: 14754 - RNA, 9876 nt, Artificial Sequence
  derived and/or modified CDS sequence (opt3) from DENV-2__FJ850107__SS-prME
accgcaggcgugauaauuaugcugauacccacagcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauugucacaugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaauacaguaugagggugacgggucuccaugcaagauccccuucgaaauuacggauuuggagaaaaggcauguacucggccggcugaucaccguuaacccgaucgugauugaaaaggacuccccugucaacauagaggccgaacccccauuuggagauagcuacaucauuaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaauagggaaggcccugcaccagguguucggcgcuaucuacggagcggcauuuaguggcguuagcuggacuaugaaaauucuuaucggggugguaauuaccuggaucggaaugaacuccagaucuacgagcuugucagucagucuggugcucguuggcguggucacacuguaucuuggugccauggugcaggcugacuccggguguguagugagcuggaagaauaaagaacugaagugcggaucuggcauauucauuaccgauaacguucacacuuggacagagcaguacaaguuucaacccgaaucaccaaguaaauuggccagcgcaauccagaaggcccaugaggaagguauuuguggcaucagguccgucacccggcucgagaaucugauguggaaacagauaacucccgaguuaaaccacauccugucugaaaaugaggugaagcuaaccauuaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguauuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauucccaagaauuucgcaggccccgucagccagcacaacuaccgaccugguuaucauacucaaaccgcuggcccauggcaccucgggaagcuggaaauggauuuugacuucugugagggaacaacugugguugugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggucaauagucuggugaccgcgggacauggccagauagauaacuuuagcuuagguguucucggcauggcccuguuccuugaagagaugcugcgcacucgaguggggacaaaacacgcuaucuugcucguagcagucucguuugugacccugauuacgggaaauauguccuuccgggaccuaggccgugugauggucaugguuggggccacuaugaccgaugacaucggaaugggcgugacauaucuggcucuccuggccgcauuuaagguaagacccaccuucgcggccggucuuuugcugaggaaauuaacuucuaaggagcucaugauggcuacaauugggaucacccugcuuagccagucaacaauaccugaaacuauccuggagcuaaccgaugcccucgcacugggaaugaugguguugaaaauuguccgcaacauggaaaaguaccaacuggcugugacgaucauggccauuaguugcguucccaaugcagugaucuuacggaacgccuggaaggucuccuguacaauacucgcugcggugucuguuuuuccacugcuucugaccagcucccagcagaaagccgacuggauuccuuuggcacucacuaucaagggccugaaucccaccgcuaucuuccuaacaacucugucaagaaccagcaaaaagaggaguuggccacuuaacgaggccauuauggccgugggcauggucucuauacucgcuuccagccuguugaaaaaugacaucccgaugacggggccucugguagcaggagguuuacucacagugugcuauguucugaccggccgaucggccgaucuugaacuggagcgcgcggcugacgugaagugggaggaucaggccgaaauuucagggucuagucccaucuuguccauuacuaucagcgaggacggaucuaugagcaucaaaaacgaagaggaggaacaaacacucaccauccugauucggacuggccuacuggucaucuccgguguguuuccaguaucaauucccaucacagcagccgcuugguaccuuugggaggugaagaagcagagagcagggguccucugggauguuccuaguccacccccugugggaaaagccgaacuggaggacggcgcguauaggauaaagcagcguggcauuuugggguacagccagaucggagcugguguguauaaagaaggcaccuuccacacgauguggcaugucacucgcggggccguguuaaugcaccggggaaagagaaucgagccgucuugggcagauguuaaaaaggaccugauuuccuacggcgguggguggaagcucgagggagaauggaaagagggcgaagagguacaagugcuggcccuugaaccaggcaagaaucccagggcuguccagaccaaaccugggaucuuuaagacaaacaccggaacaauaggugccgugucacuggauuucaguccaggcacuagcgggucccccauuguugaccgaaaaggaaagguggucggcuuguacgguaauggggugguaacccggucuggagcauaugucucggcuaucgcccagacggaaaagagcauugaggauaacccugaaaucgaggacgauauauuccgcaaaaagagacuaacaauuauggaccugcauccgggcgcgggcaaaacuaagagguaccuccccgccaucgugcgggaagcaaucaaacgagggcugagaacccuuauuuuagcuccaacacgcguuguggccgcugagauggaagaggcacugaggggacucccuauccguuaucagacccccgccauuaaggccgagcacacuggucgggaaauagucgacuugaugugucaugcuaccuuuacaaugagacugcucucaccagugaggguuccuaacuacaaucugaucauuauggaugaggcgcacuucacggaccccgcauccaucgccgcucgcggcuauaucaguacucgaguggaaaugggggaggccgcaggaauuuuuaugaccgccacaccaccgggcucuagagauccuuucccccaaagcaacgcuccaauaauggacgaggaacgggagauccccgaaagguccuggaacucaggucacgagugggucaccgauuuuaaggggaaaacugugugguucguaccuucuauuaaggcgggaaacgacaucgccgcaugccuucgcaaaaauggcaagaaagugauucagcugagccguaagacauuugauagugaauacguuaagaccagagcuaacgacugggauuucgucgugacgacugacaucuccgagaugggcgccaauuuuaaagcagagcgggugauagauccaaggcgcuguaugaagcccgucaucuugacagacggggaggaacgaguaauucuagccggaccuaugccggugacccauagcucugcugcccagagacgggguaggaucggccgcaaccccaaaaaugaaaacgaccaauauauuuacaugggggagccccuggaaaaugaugaggacugcgcgcacuggaaggaggcaaaaaugcucuuagauaacaucaauaccccugaaggaauaauucccucaauguucgagccagaaagagagaagguugacgccaucgauggcgaauacaggcugcggggugaggcucguaaaacuuuuguggaccuuaugcgccgaggggaucugccugucuggcucgccuauaagguggcugcagagggcauuaacuacgccgacagaaagugguguuucgauggaaucaaaaauaaccagauauuggaagagaacguugaaguggagaucuggacaaaggagggcgaaaggaaaaagcugaaaccccgguggcucgacgcucgcauuuauuccgauccacuggcccuuaaggaguucaaggaauuugcagcggggagaaaaagucuaacccugaauuugaucacagagaugggaaaguuaccuacuuucaugacgcagaaagccaggaacgcucuggacaaucucgccguccugcauaccgcagaagcugguggccgggccuacaaccacgcacuuagcgagcugccggagacacucgaaacuuugcugcuacugacccuccuugccacagugaccgggggaauuuuucuguucuuaaugucgggcaaggguaucgggaaaaugacuuugggcaugugcugcauaauuacggcuucuguacugcucugguaugcgcagauccaaccccacuggaucgccgcauccauuauccuggaguuuuuccuuauagugcugcucauuccagaaccugagaagcagcgaaccccacaggauaaucaguugacauacguugucaucgcuauucugacugugguggccgccaccauggcaaacgaaaugggauuuuuagagaagaccaaaaaggaccuaggccuggggagcaucaccacucaagagucagaaaguaauauacucgacaucgaucuuagaccagcuucugccuggacacuguaugcggucgcuacgaccuucguuacuccuauguugcgccauuccauugagaacagcucagugaauguaagucugacagccaucgcaaaccaggccaccgugcucaugggacuggguaaaggcuggccccuuagcaagauggacauuggggucccgcuccuggcuaucggauguuacucccaggugaauccaauuaccuugacagcagcccuguuacuacugguugcgcacuacgcuaucauaggcccuggucuccaggccaaagcaacuagggaagcccaaaagcgggcugccgcagggauuaugaagaaccccacgguggauggcaucaccgucaucgaccuugagccaauucccuaugauccuaaauuugaaaagcagcugggacagguaauguugcugauacucugcgugacacagguucugaugaugcguacuaccugggcucuuugugaggccuuaacacuggcgaccggcccgaucucuacucucugggaggggaaucccggaagauucuggaacacgacaauugccgugagcauggcaaauaucuuuaggggcuccuacuuggcuggugccgggcugcuauucucaauuaugaaaaacaccacuaauacccgccggggaacaggcaacaucggugaaacucugggcgagaaguggaaaucucgacucaacgcacuugggaagagugaauuucaaauauauaaaaagucgggaauccaggaggucgacagaacccuggcuaaggagggcauuaaaagaggggaaacagaucaucacgccgugagccgcggauccgccaaguugcggugguucgucgagagaaauauggugacgccagaaggcaaaguuguggaccuggguugcgggcguggaggcuggucuuacuauugugguggccucaagaacguaagggaggugaaagggcugaccaagggaggcccugggcaugaggaaccaaucccuaugucaacuuacggauggaauuuaguccggcuucagagcggcguugauguguucuuuacaccacccgagaagugcgacacccugcucugugauauuggugaauccaguccuaacccaacuaucgaggcggggcgcacacuacgaguccugaauuugguggaaaacuggcugaauaacaauacccaauucugcauaaaaguacucaaccccuauaugccgucugugauugagaagauggaaacgcuucagagaaaauacggaggcgcucugguuaggaauccuuugagccggaacucaacccacgagauguacuggguguccaaugcaacaggcaacaucgucaguagcgugaauaugaucucucgcaugcugauuaacagauuuacuaugaagcacaaaaaggccaccuaugagccagacgucgaucucggguccggaacaaggaacauagguaucgaaucagagauucccaauuuagacaucauuggcaagcgaaucgagaaaauacggcaggagcaugaaacuagcuggcacuacgaccaggaucauccuuauaagaccugggcuuaccacgggucguaugagacaaaacaaaccggaucugccaguuccauggugaacggcguuguacgucugcuuacuaagccaugggacgugguccccauggugacgcagauggcaaugacagauaccacuccguucggucagcagagaguuuuuaaagagaagguggacacccgcacacaagaaccuaaggaggggacgaaaaagcugaugaggaucaccgccgaauggcuauggaaagagcucggaaagaaaaagacuccccggauguguacaagagaggaguucacccgcaaagucaggagcaaugcugcgcugggcgccauuuuuacugaugagaacaaguggaagucagcacgagaagcuguggaggacggccgguucugggaauugguagauaaagagagaaaucugcaccucgaggggaagugcgaaacauguguguacaacaugaugggaaaaagggagaagaaacuuggugaauuuggcaaggccaaggggucccgcgcaaucugguauauguggcugggagcccguuucuuagaguuugaagcucugggcuucuugaaugaggaccauugguuuucucgggguaacagccucagugggguugagggagaaggccugcacagacuaggcuacauucuuagggaugucgggaaaaaggagggaggugccauguacgcggacgauaccgcaggcugggacacacgcaucacucuggaagaccucaaaaaugaggaaauggugaccaaccauaugaagggggagcacaaaaagcuggccgaggcuauuuucaaguugacguaucagaauaaagugguccgaguucagcggccaaccccuagaggaacagugauggauauaaucuccaggcgcgaccagagaggcagcggucaaguagggacuuacggacugaacaccuucacaaauauggaagcccagcucauucggcagauggagggcgaaggcaucuuuaagucuauccaacaucuuacugcaaccgaggagauugcugugcagaacuggcuggccagggucgggcgugaacgauuaucacgcauggcuauaaguggagaugacugcgugguuaaacccaucgaugacagauucgccuccgcacugacggcguugaaugauauggguaaggugcggaaagacauucagcagugggagccaagcaggggcuggaacgauuggacacaaguccccuuuugcucucaccacuuccaugaacucgugaugaaggacgggcgcguacugguugugccuuguagaaaccaggaugagcuaaucggacgggccaggauuucgcagggcgcugguuggucacuuaaggaaaccgccugccuggggaaaagcuaugcacagauguggacucucauguacuuucaccgacgugaccugagauuggcugccaaugcaaucuguuccgccgucccaagucauugggugccgacaucucgcaccacuuggagcauacacgcgaagcacgaguggaugaccacagaggauauguuagcuguguggaaccgggucuggauccaagaaaaucccuggauggaggacaaaacgccuguugaauccugggaggaagugccauaucugggaaagagggaggaccaguggugcggcucacucauuggccuuaccaguagagccacuugggccaaaaacauccagacagccauuaaucagguacgcucucugaucgggaacgaggaauacaccgauuauaugcccagcaugaagcgguucaggcgagaggaagaggaagcuggagugcuaugguga

SEQ ID NO: 14755 - RNA, 9876 nt, Artificial Sequence
  derived and/or modified CDS sequence (opt3) from DENV-2__FJ850108__SS-prME
accgcaggcgugaucgucaugcugauuccaacugcuauggcauuccaccucacuacgagaaacggggagccucauaugauaguugggaggcaggaaaaggguaaaagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccacauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugaucgaaaaggacuccccugucaacaucgaggccgaacccccauuuggagauagcuacauuauaaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcgguguuuuuacaucaauugggaaggcccugcaccagguguucggcgcuaucuacggagcggcauuuaguggcguaagcuggacuaugaaaauacuuaucggggucgugauuaccuggaucggaaugaacuccagaucuacgagcuugucaguuagucuggugcucgucggcgugguaacacuguaucuuggugccauggugcaggcugacuccggguguguugucagcuggaagaauaaagaacugaagugcggaucuggcauuuucaucaccgauaacgugcacacuuggacagagcaguacaaguuucaacccgaaucaccaaguaaauuggccagcgcaauacagaaggcccaugaggaagguauuuguggcaucagguccgugacccggcucgagaaucugauguggaaacagauuacucccgaguuaaaccacauccugucugaaaaugaggucaagcuaaccauaaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguugaagacuacggcuuugguguguucaccacgaacaucuggcucaagcugcgugagaaacaggacguguuuugugauucuaaguuaaugagcgcugccauuaaagacaaucgggcaguacacgccgauaugggguauuggaucgaauccgcucugaacgacacauggaagauggagaaggccucauucauagaggucaaaagcugccacuggccuaagucucauacccuuugguccaauggaguguuggaaagugagaugauuauccccaagaauuucgcaggccccguuagccagcacaacuaccgaccugguuaucauacucaaaucgcuggcccauggcaccucgggaagcuggaaauggauuuugacuucugugagggaaccacaguggucgugacugaagauugcggcaauagagggcccucucuaaggaccacaacggccuccggaaaacugauuaccgaguggugcugucgcucaugcacucucccgccucugcgguacagaggcgaggacgguuguugguacgggauggaaaucaggccacuuaaggagaaggaagagaacuugguuaauagucuggugacagcgggacauggccagauugauaacuuuagcuuagguguacucggcauggcccuguuccuugaagagaugcugcgcacccgagucgggacuaaacacgcuauauugcucguggcagugucguuugucacacugaucaccggaaauauguccuuccgggaccuaggccguaugaugguuauggugggggccacgaugacugaugacauuggaaugggcguaaccuaucuggcucuccuggccgcauuuaaggugagacccacauucgucgcgggucuuuugcugaggaaauuaaccucuaaggagcucaugauggccacuaucgggauuacacugcuuagccagucaaccaucccugaaacaauacuggagcuaacugaugcucucgcccugggaaugaugguguugaaaaucguucgcaacauggaaaaguaccaacuggcagugaccauuauggcuaucaguugcguccccaaugccgugauuuuacggaacgcauggaagguuuccuguacgauccucgccgcugugucugucagcccacugcuucugacauccucacagcagaaagcggacuggauaccuuuggcccucaccauuaagggccugaaucccacugcaaucuuucuaaccacacugagcagaacaaguaaaaagaggucuuggccacuuaacgaggcuaucauggccguaggcaugguguccauucucgccagcucgcuguugaaaaaugacauaccgaugaccgggccucugguugcuggagguuuacucacggugugcuauguccugacaggccgaucagcagaucuugaacuggagcgcgccgcggacgugaagugggaggaucaggcugaaaucucugggaguucccccauuuugagcaucaccauuucugaggacggaagcauguccaucaaaaacgaagaggaggaacaaacucucacaauacugauccggaccggccuacugguaauuucagguguguucccagucaguauccccauuacugccgcagccugguaccuuugggagguuaagaagcagagagcuggggugcucugggaugugccuagcccacccccugucggaaaagcagaacuggaggacggcgccuauaggaucaagcagcguggcauauugggguacucucagauuggagcggguguguauaaagaaggcacauuucacaccauguggcauguuacgcgcggggcuguauuaaugcaccggggaaagagaaucgagccguccugggccgaugugaaaaaggaccugaucucauacggcgguggguggaagcucgagggagaauggaaagagggcgaagagguccaagugcuggcacuugaaccaggcaagaaucccagggccguucagacuaaaccugggauuuucaagaccaacacaggaaccaucggugcugugagucuggauuuuagcccaggcacauccgggucucccauagucgaccgaaaaggaaaggugguaggcuuguacgguaauggggucgugacucggucgggagccuauguuagcgcaauugcucagaccgagaagucaaucgaggauaacccugaaauugaggacgauaucuuccgcaaaaagagacuaacgauaauggaccugcauccgggcgccggcaaaacaaagagguaccuccccgcgauugugcgggaagccaucaaacgagggcugagaacucuuaucuuagcaccaacccgcgucguggcugccgagauggaagaggcucugaggggacucccuauucguuaucagacacccgcaaucaaggccgagcacaccggucgggaaauuguugacuugaugugucaugccacuuucaccaugagacugcucuccccagugagggucccuaacuacaaucugauaaucauggaugaggcucacuuuacagaccccgcgaguauugcagcccgcggcuauaucucuacgcgaguggaaaugggggaggcugccggaaucuucaugacugcaaccccaccgggcagcagagauccuuuuccccaauccaacgccccaauuauggacgaggaacgggagauacccgaaaggucauggaacucuggucacgaguggguaacagauuucaaggggaaaaccgugugguuuguuccuagcaucaaggcuggaaacgacauugcggccugccuucgcaaaaauggcaagaaagucauccagcugagucguaagacuuucgauuccgaauacgugaagacaagagcaaacgacugggauuuuguggucaccacggacauuagcgagaugggcgcuaauuucaaagccgagcggguaaucgauccaaggcgcuguaugaagcccgugauauugacugacggggaagaacgaguuauccuagcaggaccuaugccggugacacauucuucagccgcucagagacgggguaggauuggccgcaaccccaagaaugaaaacgaccaauauaucuacaugggggagccccuggaaaaugaugaggacugcgcccacuggaaggaggcgaaaaugcucuuagauaacauuaauaccccugaaggaaucauacccuccauguuugagccagaaagagagaaggucgacgcaauugauggcgaauacaggcugcggggugaggcccguaaaaccuucguggaccuuaugcgccgaggggaucugccuguuuggcucgcuuauaagguggccgcugagggcaucaacuacgcagacagaaagugguguuuugauggaauuaaaaauaaccagaucuuggaagagaacgucgaaguggagauauggacuaaggagggcgaaaggaaaaagcugaaaccccgguggcucgacgcccgcaucuauagugauccacuggcucuuaaggaguucaaggaguucgccgcagggagaaaaagccuaacacugaauuugauuaccgagaugggaagguuaccuacauuuaugacucagaaggcgcggaacgcccuggacaaucucgcuguacugcauacggccgaagccgguggccgagcuuacaaccacgcccuuucggagcugccggagacccucgaaacauugcugcuacugacucuccuugcaaccgugacagggggaaucuuccuguuuuuaaugucuggcaaagguauugggaagaugaccuugggcaugugcugcaucauaacugccuccguucugcucugguaugcucagauucaaccccacuggaucgcggccagcaucauucuggaguucuuucuuaucguccugcucauaccagaaccugagaaacagagaacgccccaggauaaucaguugaccuacguggugauugcaauccugacagucguugcugccacuauggccaacgaaaugggauucuuagagaagaccaagaaagaccuaggccuggggucaauuacaacccaagagccagaaaguaauauccucgacauagaucuucgcccugcaucugcuuggacucuguaugccguggcgacaacguuuguaacccccauguugaggcauuccaucgagaacagcucagugaaugucagucugacugcuauugccaaccaggcaacagugcucaugggacuggguaagggcuggccgcuuagcaaaauggacaucgggguuccacuccuggccauuggauguuacucccaggugaauccuaucaccuugaccgcugcacuguuacuacuggucgcccacuacgcgauuaucggccccggucuccaggcuaaggccacacgggaagcacaaaaacgugccgcugccgggauaaugaagaacccaacuguagauggcauuacggugaucgaccuugagcccaucccuuaugauccgaaguucgaaaaacagcugggacagguuauguugcugauucucugcgugacccagguccugaugaugagaacaacuugggcacuuugugaggcuuuaacccuggccacaggccccauaucuacccucugggaggggaauccaggaagguuuuggaacacuacgaucgcggugagcauggccaauauuuuccgcggcuccuacuuggccggugcugggcugcuauuuucaaucaugaagaacacaaccaauacucggcgaggaaccggcaacauuggugaaacacugggcgagaaauggaagucuagacucaacgcccuugggaaaagugaguuccaaaucuauaagaaaucgggaauacaggaggucgacaggacucuggcaaaggagggcaucaagcgcggggaaaccgaucaucacgcugugagccggggauccgccaaauugagaugguuuguugagcguaauauggugacaccugaaggcaagguaguggaccuggguugcgggaggggaggcuggucuuacuauugugguggccucaaaaacguccgggagguuaaggggcugacgaaaggaggccccgggcaugaagaaccuauuccaaugucaaccuacggauggaauuuagugcgccuucagagcggcgucgauguguucuucacucccccugagaagugcgacacacugcucugugauaucggugaauccaguccaaaccccaccauugaggccgggcgaacucuaagaguacugaauuugguggaaaacuggcugaauaacaauacacaauuuugcaucaagguucucaacccguauaugccuucugugauagagaaaauggaaacccuucagaggaaguacggaggcgcgcugguccggaauccauugagccgcaacucaacgcacgagauguacuggguguccaaugcuaccggcaacauugucaguagcgugaauaugaucucuagaaugcugaucaacagguucacaaugaaacacaagaaagcaacuuaugagcccgacguugaucucggguccggaacccgaaacauugguauagaaucagagaucccuaauuuagacauuaucggcaagcggauugaaaagaucaaacaggagcaugaaacaagcuggcacuacgaccaggaucauccauauaagacuugggccuaccacgggucguaugagaccaaacaaacaggaucugcuaguuccaugguaaacggcgugguccgucugcuuaccaagcccugggacgugguuccgauggugacucagauggccaugacggauacaaccccuuuuggucagcagagagucuucaaagagaagguggacacucgcacccaagaacccaaggaggggacgaaaaagcugaugaggauaacagcagaauggcuauggaaagagcucggaaagaaaaagaccccacggauguguacuagagaggaauuuacacgcaaaguaaggagcaaugccgcucugggcgcgaucuucaccgaugagaacaaguggaagucagcccgagaagcaguggaggacggccgguuuugggaauugguugauagagagaggaaucugcaccucgaggggaaaugcgaaacuugugucuacaacaugaugggaaagcgcgagaagaaacuuggugaguucggcaaagcuaaagggucccgugccauuugguauauguggcugggagcacgguuuuuagaguucgaagcccugggcuuuuugaaugaggaccauugguucucuagagguaacagccucagugggguggagggagaaggccugcacaggcuaggcuacauccuucgcgauguggggaagaaagagggaggugcuauguacgccgacgauacagcgggcugggacacccgaauuacacuggaagaccucaagaaugaggaaauggucacuaaccauaugaaaggggagcacaagaaacuggcagaggccaucuuuaaguugaccuaucagaauaagguugugcggguacagagaccuacgcccaggggaaccgugauggauauuauaucccgcagagaccagcggggcagcggucaagucgggacauacggacugaacacuuucaccaauauggaagcucagcucaucaggcagauggagggcgaaggcauuuucaaaucuauccaacaucuuacagugacugaggagaucgccguucagaacuggcuggcacguguggggcgagaacgcuuaucaagaauggcuauuaguggagaugacugcgucgugaagccaauagaugaccgguuugccuccgcucugaccgccuugaaugauauggguaaaguaaggaaggacauccagcagugggagcccagccgcggcuggaacgauuggacgcaaguuccuuucugcucucaccacuuucaugaacucgugaugaaagacgggagaguccugguggugccaugucggaaccaggaugagcuaauuggaagggcacgaaucucgcagggcgcggguuggucacuuaaggaaacagccugccugggaaagagcuaugcucagauguggacccucauguacuuccaccguagagaccugcgcuuggccgcaaaugcuauuuguuccgccgucccgagucauuggguucccacuucucggacaaccuggagcauccacgcaaaacacgaguggaugacuaccgaggauauguuagccguguggaacaggguauggauacaagaaaauccuuggauggaggacaagacaccaguggaauccugggaggaaguccccuaucugggaaaaagagaggaccaguggugcggcucacucaucggccuuacgagucgcgcgaccugggcuaagaacauucagacugccaucaaucaggugcggucucugauugggaacgaggaauacacagauuauaugccuagcaugaaaagguuucgaagagaggaagaggaagcaggaguucuaugguga

SEQ ID NO: 14756 - RNA, 9876 nt, Artificial Sequence
  derived and/or modified CDS sequence (opt3) from DENV-2__JN819407__SS-prME
accgccggcgugaucgucaugcugauuccaacugcuauggcauuccaccucacuacgagaaauggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccacauguggguauggggcuugagaccagaacagaaacuuggaugaguagcgagggagcuuggaaacacguucagaggauugagaccuggauccugcggcauccuggcuucacaauuauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagaugucccuagguaaucugcucuuuaccggccaucugaaaugccgucuucgcauggauaagcugcaauugaaagggaugucauacagcauguguacaggaaaguucaagaucgugaaagaaaucgcugagacucagcacggcaccauuguaaucagaguucaguaugagggugacgggaguccaugcaagauucccuucgaaauaacggaucucgagaaaaggcaugugcugggccgguuaaucaccgucaacccgauugugaucgaaaaggacucuccugucaacaucgaggccgaacccccauuuggagauuccuacauuauaaucggcguggagccugggcagcugaaacuaaauugguucaagaagggaagcucgauuggucaaauguuugagacaacuaugcgaggcgcuaaacgcauggccauccucggggacaccgcaugggauuucggaucucugggcgguguuuuuacauccauugggaaggcccuucaccagguguucggcgcuaucuacggagcggcauuuucaggcguaaguuggacuaugaaaauauugaucggggucgugauuaccuggaucggaaugaacagcagauccacgucucugagcguuucacucgugcuggucggcgugguaacacuuuaucugggugccauggugcaggcugacaguggguguguugucuccuggaagaauaaagaauugaagugcggaagcggcauuuucaucaccgauaacgugcacacuuggacagagcaguacaaguuucaacccgaaucuccaucaaaacucgccagugcaauacagaaggcccaugaggaagguauuuguggcaucaggagcgugacccggcuggagaauuuaauguggaaacagauuacucccgagcugaaccacauccuauccgaaaaugaggucaagcucaccauaaugacaggggacacgaaaggaaucaugcaggcuggcaagcgcucucugagaccucaaccaaccgaacuuaaauauucguggaagacuugggggaaggccaaaauguuguucacagagagccauaaccagaccuuucugauugauggaccggaaacagcagagugccccaauacuaacagggcguggaacucccucgagguugaagacuacggcuucgguguguuuucaaccaacaucuggcugaaguuacgugagaaacaggacguguucugugauaguaagcugaugucugcugccauuaaagacaaucgggcaguacacgccgauaugggguauuggaucgaaagcgcucuuaacgacacguggaagauggagaaggccuccuucauagaggucaaaucaugccacuggccuaagagccauacauuguggucuaauggagugcucgaauccgagaugauuauccccaagaauuuugcaggccccguuagucagcacaacuaccgaccugguuaucauacccaaacugcuggcccauggcaccuggggaagcuagaaauggauuucgacuuuugugagggaaccacaguggucgugacugaagauugcggcaauagagggcccagccugaggaccacaacggccucuggaaaacucaucaccgaguggugcugucgcuccugcacucugccgccucuucgguacagaggcgaggacgguuguugguacgggauggaaauuaggccauugaaggagaaggaagagaaccugguuaauucauuagugacagcgggacauggccagaucgauaacuucagucucgguguacugggcauggcccuuuuucuggaagagauguugcgcacccgagucgggacuaaacacgcuauucuccugguggcagugagcuucgucacacuaauaaccggaaauaugucguuucgggaccugggccguguuauggugaugguaggggccacgaugacugaugacaucggaaugggcgugaccuaucucgcucugcuugccgcauucaaggucagacccacauuugcggccgguuugcuguuaaggaaacucaccuccaaggagcugaugauggcuacuauugggaucacacuucugucucagagcaccauuccugaaacaauccuagagcucacugaugcccuggcauugggaaugauggugcugaaaauaguucgcaacauggaaaaguaccaauuagcugugaccaucauggccauuucaugcguccccaaugcagugauccuccggaacgccuggaagguuaguuguacgauucuggcugcgguguccgucucuccacuucuguugacaagcucccagcagaaagccgacuggaucccucucgcacugaccauaaagggccuaaaucccacugcuauuuuccugaccacacuuucaagaacuagcaaaaagaggaguuggccacucaacgaggccaucauggccguaggcauggugucuauccuggcuuccagcuugcugaaaaaugacauuccgaugaccgggccuuuaguugcaggaggucuccugacggugugcuauguccuuacaggccgaucggccgaucuggaauuggagcgcgcggcugacgugaagugggaggaucaggccgaaauaucagggucuagucccauccucuccauuaccaucagcgaggacggaucuaugagcauuaaaaacgaagaggaggaacaaacucugacaauccuaauacggaccggccugcuuguaaucuccgguguguuuccagucucaauucccaucacugcagccgcuugguaccucugggagguuaagaagcagagagcaggggugcugugggaugugccuaguccacccccugucggaaaagccgaauuggaggacggcgcguauaggauuaagcagcguggcaucuuaggguacagccagauaggagcugguguguauaaagaaggcacauuccacaccauguggcauguuacgcgcggggccguacugaugcaccggggaaagagaauugagccgucuugggcagaugugaaaaaggaccucaucuccuacggcgguggguggaagcuggagggagaauggaaagagggcgaagagguccaagugcuugcccuggaaccaggcaagaaucccagggcuguucagacuaaaccugggaucuuuaagaccaacacaggaaccauuggugccgugucauuggauuucaguccaggcacaagcgggucccccaucgucgaccgaaaaggaaaggugguaggccuauacgguaauggggucgugacucggucuggagcauauguuucggcuauagcccagaccgaaaagagcauugaggauaacccugaaaucgaggacgauauuuuccgcaaaaagagacugacgaucauggaccuccauccgggcgcgggcaaaacaaagagguaccugcccgccauagugcgggaagcaauuaaacgagggcuuagaacuuuaauccuggcuccaacccgcgucguggccgcugagauggaagaggcacucaggggauugccuauccguuaucagacacccgccauuaaggccgagcacaccggucgggaaaucguugaccugaugugucaugcuacuuuuaccaugagacuccugucaccagugagggucccuaacuacaaucuuauuauaauggaugaggcgcacuucacagaccccgcauccaucgccgcucgcggcuauauuaguacgcgaguggaaaugggggaggccgcaggaaucuuuaugacugccaccccaccgggcucuagagauccuuucccccaaagcaacgcuccaaucauggacgaggaacgggagauucccgaaagguccuggaacucaggucacgaguggguaacagauuuuaaggggaaaaccgugugguucguuccuucuauaaaggcgggaaacgacaucgccgcaugccugcgcaaaaauggcaagaaagucauucaguugagccguaagacuuuugauagugaauacgugaagacaagagcuaacgacugggauuucguggucaccacggacaucuccgagaugggcgccaauuuuaaagcagagcggguaauugauccaaggcgcuguaugaagcccgugauccuaacugacggggaggaacgaguuauacuggccggaccuaugccggugacacauagcucugcugcccagagacgggguaggaucggccgcaaccccaaaaaugaaaacgaccaauauauuuacaugggggagccccucgaaaaugaugaggacugcgcgcacuggaaggaggcaaaaauguuacuggauaacaucaauaccccugaaggaauuauccccucaauguucgagccagaaagagagaaggucgacgccauagauggcgaauacaggcuucggggugaggcucguaaaaccuuuguggaccugaugcgccgaggggaucucccuguuugguuggccuauaagguggcugcagagggcauuaacuacgccgacagaaagugguguuucgauggaaucaaaaauaaccagauucuggaagagaacgucgaaguggagaucuggacuaaggagggcgaaaggaaaaagcucaaaccccgguggcuggacgcucgcauauauuccgauccacuugcccuaaaggaguucaaggaauuugcagcggggagaaaaagucugacauugaauuuaaucaccgagaugggaaggcugccuacauucaugacucagaaggcccggaacgcucucgacaaucuggccguacuucauacggcagaagcugguggccgagccuacaaccacgcacugagcgagcucccggagaccuuggaaacacugcuacugcucacucuucuggccaccgugacagggggaauauuuuuauucuugaugucgggcaaagguaucgggaagaugacccugggcaugugcugcauuaucacugcuucuguucuccugugguaugcgcagauacaaccccacuggauugccgcauccaucauccuugaguuuuuccugauuguccucuugaucccagaaccugagaaacagagaacgccccaggauaaucagcugaccuacguggugauagcuauuuuaacagucguugccgccacuauggcaaacgaaaugggauuucuagagaagaccaagaaagaccugggccucgggagcaucacaacccaagagccagaaucaaauauucuugacaucgaucugcgcccugcuagugccuggacuuuguaugcgguggcuacaacguucguaacccccaugcugaggcauucuauagagaacuccagcgugaaugucucacucacugccaucgcaaaccaggccacagugcugaugggacuugguaagggcuggccgcucaguaaaauggacauugggguuccacuguuggcuaucggauguuacagccaggugaauccuauuacccugaccgcagccuuacuacugcucgucgcgcacuacgcuaucauuggccccggucuucaggccaaggcaacacgggaagcccaaaaacgugcugccgcagggaucaugaagaacccaacuguagauggcauaacggugauugaccuggagcccaucccuuaugauccgaaguuugaaaaacaguugggacagguuaugcugcucauccugugcgugacccagguccuuaugaugagaacaacuugggcuuuaugugaggcccugacccucgcgacaggccccauuuccaccuugugggaggggaauccaggaagguucuggaacacuacgauagccgugucuauggcaaauaucuuucgcggcagcuaccuggcuggugccgggcuacuguucuccauuaugaagaacacaaccaauacucggcgaggaaccggcaacaucggugaaacacucggcgagaaauggaagucaagacuuaacgcacuggggaaaucugaauuucaaauuuauaagaaaaguggaauccaggaggucgacaggacuuuggcuaaggagggcauaaagcgcggggaaaccgaucaucacgccgugucgcggggaagcgccaaacugagaugguucguugagcguaauauggugacaccugaaggcaagguaguggaccucgguugcgggaggggaggcugguccuacuauugugguggccugaaaaacguccgggagguuaagggguuaacgaaaggaggccccgggcaugaggaaccuaucccaaugucuaccuacggauggaaucuugugcgccugcagucaggcgucgauguguucuuuacucccccugagaagugcgacacacuccuaugugauauuggugaaagcuccccaaaccccaccaucgaggcggggcgaacucugagaguauugaaucugguggaaaacuggcucaauaacaauacacaauucugcauuaagguucuuaacccguauaugccuagugugaucgagaaaauggaaacccugcagaggaaguacggaggcgcuuugguccggaauccacugucucgcaacagcacgcacgagauguacugggugucaaaugcaaccggcaacauagucuccagugugaauaugauuagcagaaugcucaucaacagguuuacaaugaaacacaagaaagccacuuaugagcccgacguugauuuagggucuggaacccgaaacaucgguauugaauccgagauaccuaaucuggacaucauuggcaagcggaucgaaaagauuaaacaggagcaugaaacaucauggcacuacgaccaggaucauccauauaagacuugggcuuaccacgggagcuaugagaccaaacaaacaggaucggccucuaguaugguaaacggcgugguccgucuucugaccaagcccugggacgugguuccgauggugacucagauggcaaugacggauacaaccccuuucggucagcagagagucuuuaaagagaagguggacacucgcacccaagaacccaaggaggggacgaaaaagcuaaugaggaucacagccgaauggcucuggaaagagcugggaaagaaaaagaccccacggauguguacuagagaggaguucacacgcaaaguaagguccaaugcugcguugggcgccauauuuaccgaugagaacaaguggaaaagcgcacgagaagcuguggaggacggccgguucugggaacugguugauagagagaggaaucuccaccuugaggggaaaugcgaaacuugugucuacaacaugaugggaaagcgcgagaaaaagcugggugaauuuggcaaagccaaggggucacgugcaaucugguauaugugguuaggagcccgguuccuggaguuugaggcuuugggcuuccucaaugaggaccauugguuuuccagagguaacucucugagcgggguggagggagaaggccuacacaggcuuggcuacauucugcgcgauguggggaagaaagagggaggugccauguacgcggacgauacagcaggcugggacacccgaaucacacucgaagaccugaagaaugaggaaauggucacuaaccauaugaaaggggagcacaagaaauuggccgaggcuauuuucaagcugaccuaucagaauaagguugugcggguacagagaccuacgcccaggggaaccgugauggauaucauuagucgcagagaccagcggggcuccggucaagucgggacauacggacucaacacuuucaccaauauggaagcccagcuuauaaggcagauggagggcgaaggcaucuuuaaaagcauucaacaucugacagugacugaggagaucgcaguucagaacugguuagcucguguggggcgagaacgccugucuagaauggccaucucaggagaugacugcgucgugaagccaauugaugaccgguucgcuagugccuugaccgcacucaaugauauggguaaaguaaggaaggacauacagcagugggagcccucccgcggcuggaacgauuggacgcaaguuccuuuuugcagccaccacuuccaugaacuggugaugaaagacgggagaguccuaguggugccaugucggaaccaggaugagcuuaucggaagggcgcgaauuucucagggcgccgguuggucgcugaaggaaacagcuugccucgggaagucauaugcccagauguggacccugauguacuuucaccguagagacuugcgcuuagcagcuaaugccaucuguagcgcagucccgucccauuggguucccacaagucggacaaccuggucuauucacgccaaacacgaguggaugacuaccgaggauaugcuggcgguguggaacaggguauggauccaagaaaauccuuggauggaggacaagacaccaguggaaagcugggaggaaguccccuaucucggaaaaagagaggaccaguggugcggcucccuuauaggccugacgucacgcgcuaccugggccaagaacauccagacugcaauuaaucaggugcggagucuaaucgggaacgaggaauacacagauuauaugccuucuaugaaaagguuccgaagagaggaagaggaagccggaguucugugguga

SEQ ID NO: 14757 - RNA, 9876 nt, Artificial Sequence
  derived and/or modified CDS sequence (opt3) from DENV-2__FJ898465__SS-prME
accgcaggcgugaucauuaugcugauacccaccgcuauggcauuccaccucacuacgcgaaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccaggacagaaacuuggaugaguagcgagggagcuuggaaacacgugcagaggaucgagaccuggauacugcggcauccuggcuucgccaucauggcagccauuuuggcuuacacaaucggcaccacgcacuuucagaaggcacucauuuucauccugcugacugccguugcuccauccaugacaaugcgcugcauagggauuucuaaccgagauuuuguggaaggagucucggguggcucauggguggacaucguacucgagcacgggagcuguguuaccacuauggccaagaauaaacccacauuagauuucgaacugauuaagaccgaggcgaaacagccugcaacgcuuaggaaguauugcaucgaagccaaauugaccaacacaacuaccgagagucgguguccaacacaaggagagcccucccugaaugaagaacaggacaagcgcuuuaucugcaagcauucuaugguggaucgaggcugggguaacggguguggacuauucggcaaaggcgggauugucacuugcgcuauguuuaccugcaagaaaaauauggaaggaaagguggugcucccugagaaccuggaauacacaauagucaucaccccacacagcggugaggagcaugccguuggcaaugacacugggaaacacggaaaggaaauuaaaaucacgccgcaguccucaauaacagaggcagaacuuaccggcuaugguacugugaccauggaguguagucccagaacagggcuggauuucaacgaaaugguauugcuccagauggaggagaaggcuuggcuggugcacaggcaaugguuuuuagaccugccucucccauggcuucccggcgccgauacccagggaagcaauuggauucagaaggaaacucuggucacauucaaaaacccucaugcgaagaaacaggacgugguuguguugggcucucaagagggggccaugcacacggcacuaaccggagcuacugaaauccagauguccucagguaaucugcucuuuacaggccaucugaagugccggcuucguauggacaaacugcaguugaaggggaugagcuacaguauguguaccggaaaguucaaaaucgucaaggagauugccgagacacaacacggcacuaucgugauucgcguacaguaugaaggugaugggucuccaugcaaaauacccuucgagaucauggaccucgaaaagagacauguucugggcagguuaauuaccgugaacccgaucgucacggagaaagauuccccugugaacaucgaagcugagcccccauuuggagacagcuacauuauaaucggcgucgagccugggcagcugaagcuaaauugguucaagaaaggaucgucuauuggucagauguuugaaaccacaaugcggggcgccaagcgaauggcaauccucggggauacugccugggacuucggaucccugggcgguguguuuaccucaauugggaaagcacuucaccaaguuuucggcgcgaucuacggagcagccuuuaguggcgugagcuggacaaugaagauauugaucgggguaauuaucacuuggauuggaaugaacucccgcucuaccagccugucagucagucucgugcugguuggcguggucacgcuuuaucugggugcuauggugcaggccgauuccggguguguagugagcuggaaaaauaaggaguugaagugcggaucuggcaucuucauaacagacaacguucacaccuggacugaacaguacaaauuucagcccgagucaccaaguaagcucgcaagcgccauucaaaaagcucaugaagaggguaucuguggcauuagauccgucacaaggcuggagaauuuaauguggaagcagaucacccccgaacugaaccacauacuaucugagaaugaagugaaacucacuaucaugaccggggauauuaagggaaucaugcaggccggcaaacggucgcugcgcccucagccaacagagcuuaaguauagcuggaagacgugggggaaagcaaagauguuguccaccgaaucacauaaccaaacuuuccugauugacggaccggagacagcggagugccccaauaccaacagagcuuggaauagucucgaaguggaggauuacggcuuuggugucuucucuacaaacaucuggcugaaauuaagggaaaagcaggacguauuuugugacagcaaacugauguccgccgcaauaaaggauaaucgugccgugcacgcugacaugggguauuggauugagucagcccuuaacgauacuuggaagauggagaaagcaucauucaucgaagugaagucuugccacuggccuaaaucccauaccuuguggaguaauggaguacucgagagcgaaaugaucauuccaaagaacuucgcuggccccgucucucagcacaacuaccggccugguuaucauacgcagacagccggcccauggcaccuggggaaacuagagauggacuuugauuucugugaaggaaccacugugguugugaccgaggacugcggcaaucgagggcccucccugagaacaacuaccgcgucaggaaagcucaucacagaguggugcuguaggaguugcacgcugccgccucuucgcuaccggggcgaagaugguuguugguacgggauggagauuagaccauugaaggaaaaagaggaaaaccuggucaauagcuuagugaccgccggacauggccaaauagacaacuuuucgcucgguguucugggcauggcucuuuuccuggaggagauguugaggacucgcguggggacaaagcacgcaaugcuccugguagccgucuccuuugugacccuaaucacuggaaauaugucuuuccgagaucugggccgggugauggucaugguuggggcuacaaugaccgacgauauuggaaugggcgugacguaucucgcccugcuugcagcguuuaaaguacgucccacuuucgccgcugguuugcuguuaagaaagcucaccagcaaagaacugaugauggccacaaucgggauugcacuucugucacagaguaccaucccugagacuauacuagaacucacagacgcucuggccuugggaaugauggugcugaagaucgucaggaacauggagaauuaccaguuagcagugaccauuauggccaucuccugcguucccaacgcugugauucuccugaaugcguggaaggucucuuguacaauccuugccgcagugagcguuuccccacuguugcucacuucaagccaacagaaagcugauuggauaccucuggcccuaaccauuaagggccugaaccccacggccaucuuucuuacaacccucagucgcacuucuaaaaagcgguccuggccacugaaugaagcugugauggcagucggcaugguaagcaucuuggccucgucacugcuaaagaacgacauuccgaugaccgggccucucguggcgggaggucugcuuacaguuugcuaugugcugacuggcagaucugcugacuuggagcucgagagggccgcagaugucaagugggaagaccacgccgagauaaguggguccagccccauccugucuauuaccaucagcgaagauggauccaugucaauuaaaaaugaggaggaagaacagacgcuaacaauccugauacgaaccggccuucucgugaucagugguguauucccagugagcauucccaucacugcugcagccugguaccugugggaagucaagaagcagcgcgcggggguuuugugggacgugccuucuccacccccugugggaaaagcugaguuagaagauggcgccuaucggauuaagcaaagaggcauccugggguacucccagauaggagcugguguauauaaagagggcacauuucauaccauguggcacgugacuagaggggcaguucucaugcaucguggaaagcgcauugagccgucaugggcugacgucaagaaggaucugaucaguuacggcgguggguggaaacuugaaggagaguggaaagaaggcgaggaagugcagguccuggccuuggagccaggcaagaacccccgggcagugcagacaaaaccugggcuauucaagaccaauacgggaacuaucggugcuguuagccuggacuuuuccccaggcaccucugggucgcccauuguggauagaaaaggaaaggucgugggccucuacgguaacgggguagucacaaggagcggagccuaugugucagcgaucgcccaaaccgagaaguccauagaagacaacccugagauugaagaugacaucuucagaaagaagcggcugacaauuauggaucuucacccgggcgcaggcaaaacuaagcgcuacuuacccgcuaucguuagagaggccauaaaaagggggcugcggacccucauuuuggcuccaacgcgaguggucgcagccgaaauggaggaggcccugagaggacucccuauccgcuaucagacacccgcuaucagggcggaacauacuggucgugagauuguggaccugaugugucacgcaaccuucacaaugcggcuucugaguccaguuagagugccuaauuacaacuugaucauuauggacgaagcccacuuuaccgaucccgcuucuauagccgcaaggggcuauaucagcacucgcgucgagaugggggaggccgcuggaauuuucaugaccgcgacaccaccgggcucccgagacccuuuuccccagucaaaugccccaaucauggaugaagagagagaaauccccgagcggucuuggaacagcggucaugaaugggugacggacuucaaggggaagacuguaugguuugugccuaguauuaaagcaggaaaugauauagcugccugccuaaggaagaacggcaaaaagguuauccagcugucccgcaaaaccuucgacagcgaguacgucaagacacgugcaaaugauugggacuuuguggugaccacugauauuucugagaugggcgccaacuucagagcugaacgggucaucgacccaaggcgcuguaugaagcccguaauucucacagauggggaggaacgagugaucuuagccggaccuaugccgguuacccacucauccgcggcacaaagacgggguaggauaggccgcaaucccaaaaacgagaaugaccaguauaucuacaugggggaaccacuggagaacgacgaggauugcgcccauuggaaggaagcuaaaaugcuucuggacaauauuaacacgccugagggaaucauucccaguauguuugaaccagagagagaaaagguggaugccaucgacggcgaguacaggcuccggggugaggcucguaaaacuuucgucgauuugaugcgccgaggggaccugccuguguggcucgcauauagaguugccgcugaaggcauaaauuacgccgauaggcggugguguuuugacggaauuaagaacaaccagauccuggaggaaaauguggaggucgagauuuggacaaaagaaggcgagcgcaagaaacuuaaacccagauggcuagaugcaaggaucuauagcgacccacuggcguugaaggaguucaaagaguucgccgcugggcggaagucguuaacccugaaccucauaaccgaaaugggacgacugccuacuuuuaugacacaaaaagccagagaugcacuugacaaucuggcugugcuccacaccgccgaggccgguggccgcgccuacaaccacgcuuugucugagcugccggaaacacuagagacucugcuccuucugacguuauuggcgaccguaacagggggaaucuuccuguuucucauguccggcaaggguauugggaagaugacucugggcaugugcugcaucauuaccgccagcauccuucugugguaugcacagauacagccccauuggauugcugccucaaucauccucgaguucuuuuugauugugcuguuaaucccagagccugaaaaacagaggacaccccaagauaaucagcuaaccuacguugucauagccauucugacugugguggcagcuacgauggccaacgagaugggauuccucgagaagaccaaaaaggaccuuggccuggggaguaucacaacucaggaaucugaguccaauauuuuggacaucgaucugcggccagcgagcgcuuggacccucuaugccgucgcaacaaccuuuguuacuccuaugcugcgucacucaauagaaaacaguagcgugaauguaucccuuacagccaucgcuaaccaggcaacggugcucaugggacuggguaaaggcuggcccuugucuaagauggacauuggggucccgcuguuagccaucggauguuacagccaagugaauccaauuacccuaacugcggcucugcuccuucugguugcccauuacgcaaucauuggcccugguuugcaggccaaggcuacaagagaggcccagaaaagggcagcugccgggaucaugaagaaccccaccguggauggcauaaccgucauugaccuggaaccaauccccuaugauccuaaauucgagaagcagcucggacaaguaaugcugcuuaucuuaugcgugacacagguucugaugaugcgcacuacgugggcgcucugugaggccuugacccuggcaacaggcccgauuuccacucuaugggaagggaaucccggacgguuuuggaacaccacaauagcugugucaauggccaauaucuuccgaggcucuuaccuggccggugcugggcuccuuuuuaguauuaugaaaaacaccacuaauacgagaaggggaacaggcaacaucggugagacccugggcgaaaaguggaagucgcgcuugaacgcccuggggaaaagcgaguuccagauuuauaagaaauccggaauccaggaggucgaccggacucucgccaaggaaggcauaaaaagaggggagaccgaucaccaugcggugucucguggaucagcuaagcugaggugguuugucgaacggaauauggugacaccagagggcaaaguuguggacuuagguugcgggcgcggaggcuggagcuacuauugugguggccuuaagaacguacgagaagugaaggggcugacuaaaggaggcccugggcacgaggagcccaucccuauguccaccuacggauggaaucucgucagacuacaaaguggcguugauguguucuucacaccacccgaaaagugcgacacgcuguugugugauauuggugagucuagcccuaacccaaccaucgaagcagggaggacucugcggguccucaaucuuguggagaacuggcugaauaacaauacacaguuuugcauuaaaguauugaaccccuauaugccgucagugaucgaaaagauggagacccugcagcgcaaauacggaggcgcccucguuagaaauccuuuauccaggaacaguacucacgagauguacugggugagcaaugcuacaggcaacauagucucuuccgugaauaugauuucacgaaugcugaucaaccgguucaccaugaagcauaagaaagccacguaugaaccagacgucgaucuugggagcggaacccguaacaucgguauugagucggaaauacccaaucuggacaucauuggcaagagaaucgagaaaauuaagcaagaacacgagacaucuuggcauuacgaccaggaucacccuuauaaaacuugggcauaccacgggaguuaugagaccaagcagacaggauccgccagcucaauggugaacggcguuguacgccuacucacuaagccaugggacgugguccccauggugacccagauggcuaugacagauaccacuccguuuggucaacagaggguuuucaaagaaaagguggacacgcggacacaggagccuaaagaagggaccaagaaacugaugagaaucacugcggagugguuguggaaggagcugggaaagaaaaagacaccccgcauguguacaagggaagaguuuacgcgaaaaguccgguccaaugccgcacucggcgcuauauucaccgaugaaaacaaguggaaaucugccagagaggcaguggaagacagcagguuuugggagcuuguagaucgcgagcguaaucugcauuuagaaggcaagugcgagacuuguguguacaacaugauggggaaacgggaaaagaagcugggagaguucgguaaagccaagggcaguagagcuaucugguauaugugguugggggccagguuucucgaguucgaggcgcugggauuucuaaaugaggaccacugguucucccgcggcaacagccuuucugguguugaaggggagggacugcaucgacucggcuacauucugcgggaugucagcaaaaaggaaggcggggcaauguacgccgacgauacagcuggaugggacaccagaaucacuuuggaggaccugaaaaaugaagagauggugacaaaccacaugaagggugagcauaagaaacucgccgaagcaauuuuuaaacuuaccuaucagaauaaaguggucaggguucaacgcccaacaccuagaggcacugugauggauaucauuagucggagggaccagcguggguccggacagguaggcaccuacggucugaacacguucaccaauauggaggcucaguuaauacgacaaauggaaggggagggaaucuucaagagcauucagcaccugacagugacugaggaaaucgccguccagaacugguuggcucgcgugggcagagagcggcucucuaggauggccaucucgggcgaugacugcguugugaaaccccuggaugaccgcuuugcaucagcgcuaaccgcccuuaaugauauggggaaggucagaaaggacauucaacagugggaaccaagccggggauggaacgauuggacacaggugcccuucugcucccaccauuuucacgagcugguaaugaaagacgguaggguucucguggucccuugucgaaaccaggaugaacugauaggccgugcuagaaucagucaaggggccggauggucuuugaaggagacugcaugcuuaggcaaaagcuaugcucagauguggacccugauguacuuccaucgccgggaccucaggcuugccgcaaaugccauuuguuccgcggugccaucacacugggugccgacgaguagaacaaccuggucuauccacgcuaagcaugaguggaugacuacagaagauaugcuggccgucuggaaccgcguuuggauucaggagaaucccuggauggaagacaaaaccccuguggagagcugggaagagguaccauaucuagguaagcgggaggaccaguggugcgggucccugaucggacucacuucaagggcaaccugggccaagaacauacaaacagcuaucaaucaggugcggagcuugauuggcaacgaagaguacacggauuauaugcccucuaugaaaagauuuagaagggaagaggaagaggccggcguccugugguga

SEQ ID NO: 14758 - RNA, 9876 nt, Artificial Sequence
  derived and/or modified CDS sequence (opt3) from DENV-2__FJ898466__SS-prME
acagcaggcgugaucguaaugcugauucccacagcuauggcauuccaccucacuacgcggaauggggaaccucauaugauuguuggaaggcaggaaaaggguaaaagccuucuguuuaagaccgaagacggcgugaauaugugcacauugauggccaucgauuuaggggaacugugugaggacacuauuaccuacaaaugcccacuacuccggcaaaacgaaccggaggauaucgacuguuggugcaauuccacaucuaccugggugacuuauggaacauguaccacgacuggcgagcaccgccgagaaaagcguucaguggcgcuggucccccauguggguauggggcuugagaccaggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaagugguccagccugagaaccucgaauacaccauuguuauaacuccacacagcggugaggagcaugcugugggcaaugacacggggaagcacggaaaagaaaucaagauuacaccgcaguccucaaucaccgaggccgaacugacuggcuaugguaccguaacaauggaguguagucccaggaccgggcuugauuucaacgaaauggugcuguugcaaauggaggacaaagcauggcucguccaccggcagugguuucuggauuuaccucugccauggcuccccggcgcugacacucagggaagcaauuggauacagaaggagacacuugugacguucaagaacccucaugccaaaaagcaagacguugugguccugggcucucaggaaggggcgaugcacaccgccuugacuggagcaacagagauucagauguccucagguaaucuacuguuuaccggccaucucaaaugccgucugcgcauggauaaacuucaacugaaagggaugagcuacaguauguguacaggaaaguucaagaucgugaaagaaaucgcugagacucagcacggcaccauuguaaucagaguucaguaugagggugacgggucuccaugcaagauucccuucgaaauaacggauuuggagaaaaggcaugugcucggccggcugaucaccgucaacccgauugugacagaaaaggacuccccugucaacaucgaggccgaacccccauuuggagauagcuacaucauuauaggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuaccagcuugucagugagucugguucucgugggcgucgugacccuguaucuuggugccaugguacaggcugacuccgggugugugguuagcuggaagaauaaagaacugaagugcggaucuggcauuuucaucacugauaacguccacacauggaccgagcaguacaaguuucaacccgaaucaccaaguaaauuggccagcgcaauacagagggcccaugaggaagguauuuguggcauccgguccgugacucgccucgagaaucugauguggaagcagauuacccccgaguuaaaccacauccugucugaaaaugaggugaaacuaacaauaaugacgggggacaccaagggaaucaugcaggcuggcaaaagaucgcucaggccucaaccaacugaacugaaguauagcuggaaaacaugggggaaggccaagaugcuuuccaccgagucacauaaccagacauucuugauugauggaccggaaacugcagagugccccaauaccaaccgugcguggaauagucuggaggucgaagacuacggcuuugguguuuucacgacaaacaucuggcucaaacugcgggagaagcaggacauauuuugugauucuaaauuaaugagcgcugccaucaaggacaaucgagcagugcacgccgauaugggguauuggauagaauccgcucugaacgacaccuggaaaauggagaaggccucauucauugagguaaagagcugccacuggccuaaaucucauacucuuugguccaauggaguauuggaaagugagaugaucaucccaaagaacuucgcaggccccgucagccagcacaacuacagaccugguuaucauacccaaacagcuggcccauggcaccucgggaaacuggaaauggauuuugacuucugugagggaacuaccgugguugugacagaagauugcggcaauagggggcccucucuacgcacgaccacugccuccggaaagcugauuacagaguggugcugucggucaugcacccucccgccucugagauacaggggcgaggacgguuguugguacgggauggaaauccgcccacuuaaagagaaggaagagaacuuggucaauagucuggugacugcgggacauggccagauugauaacuuuagcuuagguguucucggcauggcccuguuccuugaagagaugcugcgaacacggguggggaccaagcacgcuauauugcucguagcagucucguuugugacgcugaucacuggaaauauguccuuccgugaccuaggcagagugauggucaugguuggggccaccaugacagaugacauuggaaugggcgugaccuaucuggcucuccuggccgcauuuaaaguaaggcccacuuucgcggccggucuuuugcugcgcaaguuaacaucuaaagagcucaugauggcuaccaucgggauugcccugcuuagccagucaacaaucccugaaacuauacuggagcuaaccgaugcacucgcucugggaaugauggccuugaagaucgugcggaacauggaaaaauaccaacuggcagucacgauuauggccaucaguugcgugcccaaugcuguuauuuuacagaacgcguggaagguguccuguacaauccucgccgcagucucugugagcccacugcuucugaccuccucacagcagaaggcugacuggauaccuuuggcccucacuauuaaaggccugaaucccaccgccaucuuucuaacaacucugagcagaaccaguaagaaaaggucuuggccacuuaacgaggcuaucauggcaguuggcaugguguccauucucgccagcucgcuguugaagaaugacauaccgaugacggggccucuggucgcgggagguuuacucacaguaugcuaugugcugaccggccgaucagcugaucuugaacuggagcgcgccgcagacguuaaaugggaggaucaagccgaaaucucugggaguucccccauuuugagcaucacuauuucugaggacggaagcauguccaucaagaacgaagaggaggaacagacacucaccauacugauccggacuggccuacuggugauuucaggugucuucccagugaguauccccauuacagcugcagccugguaccuuugggaggucaagaagcagagagcgggggugcucugggaugucccuagcccacccccuguuggaaaggcugaacuggaggacggcgccuauaggaucaaacagcguggcauauugggguacucucaaauuggagcaggaguguauaaggaaggcaccuuucacacgauguggcaugugacucgcggggccgucuuaaugcaccggggaaaaagaaucgagccguccugggcugaugugaagaaagaccugaucucauacggcgguggguggaagcucgagggagaauggaaggagggcgaagagguucagguacuggcccuugaaccaggcaaaaaucccagggcagugcagaccaagccugggauuuuccgaacaaacaccggaacaaucggugcugucagucuggauuuuagcccaggcacuuccgggucucccauaguggaccggaaaggaaagguugugggcuuguacgguaauggggucgugacccgcucgggagccuauguaagcgcgauugcccagacggagaaaucaaucgaggauaacccugaaauugaggacgauaucuucagaaagaagaggcuaacaauaauggaccugcauccgggcgcaggcaaaacuaagcgguaccuccccgcuauuguccgagaagccaucaaaagagggcugcgcacccuuaucuuagcuccaacaagggugguugcagccgagauggaagaggcccugcguggacucccuauucgguaucaaacccccgcuaucaaggcggagcacacugguagagaaauuguggacuugaugugucaugcaaccuucacaaugaggcugcucuccccaguccgcgugccuaacuacaaucugauaaucauggaugaggcccacuuuacggaccccgcuaguauugccgcacgaggcuauaucucuacuagaguugaaaugggggaggccgcuggaaucuucaugaccgcgacaccaccgggcagccgggauccuuuuccccaguccaacgccccaauuauggacgaggaaagggagauacccgaacgcucauggaacucuggucacgagugggugaccgauuucaaagggaagacugucugguuugugccuagcaucaaggcaggaaacgacauugcugccugccuucguaaaaauggcaagaaaguaauccagcugaguagaaagacauucgauuccgaauacgugaaaacccgggcaaacgacugggauuuuguugucacgacugacauuagcgagaugggcgccaauuucaaggcugagagggugaucgauccacgccgauguaugaagcccgugauauugacagacggggaagagagagucauccuagccggaccuaugccgguaacccauucuucagcggcacaacggaggggucgcauuggcagaaaccccaaaaaugaaaacgaccaguauaucuacaugggggagccccuggaaaaugaugaggacugcgcccacuggaaggaggcuaaaaugcucuuagauaacauuaauaccccugaaggaaucauacccuccauguuugagccagaaagggagaagguggacgccauugauggcgaauaccggcugcguggugaggcucgcaaaacuuucguugaccuuaugcgaagaggggaucugccuguguggcucgcauauaaggucgccgcugagggcaucaacuacgccgacaggaaaugguguuuugauggaauuaagaauaaccagaucuuggaagagaacguggaaguugagauauggacaaaggagggcgaacggaaaaagcugaaaccccgcuggcucgacgcaagaaucuauagugauccacuggcgcuuaaggaguucaaagaguucgccgcugggagaaagagccuaacccugaauuugauuacagagaugggacgguuaccuacuuuuaugacgcagaaggcccgaaacgcacuggacaaucucgcugugcugcauaccgccgaagccggugguagagcauacaaccacgcucuuucggagcugccggagacacucgaaacuuugcugcuacugacccuccuugcgacagucaccgggggaaucuuccuguuuuuaaugucuggcaaagguauugggaagaugacuuugggcaugugcugcaucauaacggccuccauucugcucugguaugcacaaauccagccccacuggaucgcugccagcauuauccuggaguucuuucuuauagugcugcucauuccagaaccugagaaacagcgcacaccacaggauaaucaauugacauacguagugaucgccauucugacuguugucgcagcuaccauggccaacgaaaugggauucuuagagaagaccaaaaaggaccuaggccuggggucaaucaccacucaggagagugaaucuaauauacucgacaucgaucuuaggccagcguccgcuuggacacuguaugccguggcaacgaccuuuauuacuccuauguugcggcauagcaucgagaacucaagugugaaugucagccugacagccauugcuaaccaggcaaccguucucaugggacuggguaagggcuggccccuuuccaaaauggacaucggggugccgcuccuggccauuggauguuacucucagguaaauccaaucaccuugacagcggcucuguuacuacugguggcccacuacgcaauaauuggcccuggucuccaagccaaggcuacucgugaagcccagaaaagagcagcugccgggaucaugaagaaccccacggucgauggcaucaccgugauugaccuugagccaauacccuaugauccuaaauucgaaaagcagcugggacagguuauguugcugauccucugcgugacacaaguccugaugaugaggacuaccugggcgcuuugugaggccuuaacacuggcaaccggcccgauuagcacucucugggaggggaaucccggacgcuuuuggaacacgacaaucgcuguauccauggccaauauuuuccggggcucauacuuggccggugcugggcugcuauuuucuaucaugaagaacaccacuaauacccgaagaggaacaggcaacauaggugaaacucugggcgagaaauggaagaguaggcucaacgcccuugggaaaucggaguuccagaucuauaagaaaagcggcauucaggagguggaccgcacccuggccaaggagggcaucaaaagaggggaaacagaucaucacgcgguuuccagaggaucugcuaaguugcguugguuuguggagaggaauauggucacgccagaaggcaagguggucgaccuggguugcgggcggggaggcuggucauacuauugugguggccucaaaaacgugcgcgagguuaaggggcugaccaaaggaggcccugggcaugaagaacccauuccuaugagcacuuacggauggaauuuagugcgacuucaauccggcguagauguguucuucacaccacccgagaagugcgacacccugcucugugauaucggugaaaguucuccuaacccaacuauagaggcagggagaacacuaaggguccugaauuugguugaaaacuggcugaauaacaauacccaguuuugcauuaaagugcucaaccccuauaugccgagcgucaucgagaagauggaaacgcuucagcggaaguacggaggcgcccuggugcgcaauccuuugucaagaaacuccacccacgagauguacuggguaaguaaugcuacaggcaacaucgugagcucuguuaauaugauuuccaggaugcugauaaaccgauucacuaugaaacacaagaaagccaccuaugagccagacguggaucucgggucaggaacacggaacaucgguauugaaagcgagauccccaauuuagacauuaucggcaagcguauagagaaaaucaagcaggagcaugaaacuucguggcacuacgaccaagaucauccuuauaagaccugggcauaccacgggucuuaugagacaaaacagaccggaagugccuccagcauggucaacggcguggucagacugcuuacuaagccaugggacgugguucccaugguaacgcagauggcuaugacagauaccacuccguuuggucagcaacgcguguucaaagagaaggucgacaccaggacacaggaaccuaaagaggggacgaagaagcugaugaaaauuaccgcggaauggcuauggaaggagcucggaaaacggaagacucccagaauguguacacgcgaggaauuuaccaaaaaggugaggucaaaugccgcacugggcgcuaucuucacugaugagaacaaauggaaguccgcccgagaagcaguugaggacggccgguuuugggaauugguggauagagagaggaaucugcaccucgaggggaagugcgaaacaugugucuacaacaugaugggaaaacgcgagaagaaacuuggugaguucggcaaggccaaagggucucgugcuauuugguauauguggcugggagcccgguuuuuagaguucgaagcgcugggcuuuuugaaugaggaccauugguucagcagagguaacagucucuccgggguggagggagaaggccugcacaggcuaggcuacauccuucgcgauguagggaagaaggagggaggugcaauguacgccgacgauaccgcuggcugggacacacgaauuacucuggaagaccucaaaaaugaggaaauggugaccaaccauaugaagggggagcacaaaaagcuggccgaggcaauauuuaaauugacguaucagaauaagguuguccgggugcagagaccaaccccuaggggaacagugauggauaucauuagccgcagagaccaacggggcucuggucaggucgggacuuacggacugaacaccuucacaaauauggaagcucagcucaucaggcaaauggagggcgaaggcaucuucaagucaauucagcaucuuacugccaccgaggagauagcuguucagaacuggcuggcccguguggggcgagaacgcuuaaguagaauggcaaucuccggagaugacugcguagugaaacccauugaugaccgguuugcgagcgcccugacggcuuugaaugauauggguaaggucaggaaagacauccagcaaugggagccaucucgcggcuggaacgauuggacacaggugcccuucugcucgcaccacuuucaugaacucguuaugaaggacgggagagugcuggucgugccuugucggucacaggaugagcuaauuggaagggcccgaaucagccagggcgcagguuggucccuuaaagaaaccgcuugccuggggaagaguuaugcccaaauguggacucucauguacuuccaccguagagaccugcgcuuggcagccaacgcgauauguucugcuguaccaagccauuggguuccgacaucccggaccacuuggucaauccacgccaagcacgaguggaugaccacagaggauauguuagcaguguggaauagggucuggauucaggaaaaccccuggauggaggacaaaacgccuguggaaaguugggaggaagugccauaucugggaaagagagaggaccaguggugcggcucucucaucggccuuaccagccgcgccacuugggcuaaaaauauucagacagccaucaaccaaguccggucccugauagggaaugaggaauacaccgauuauaugcccucaaugaagagguuucgaagagaggaagaggaagcaggaguucuaugguga

SEQ ID NO: 14759 - RNA, 9876 nt, Artificial Sequence
  derived and/or modified CDS sequence (opt3) from DENV-2__FJ898467__SS-prME
accgccggagugauaauuaugcugauacccacagcuauggcauuccaccucacuacgagaaacggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagaacaggacaaacgauuuaucugcaagcauucuaugguggauagaggcugggguaacggguguggacuauucggcaagggcgggauugucacaugcgccauguuuacaugcaaaaagaauauggaaggaaaaguggugcagccugagaaccucgaauacaccauagucaucacuccacacagcggugaggagcaugcuguuggcaaugacacggggaagcacggaaaagaaauuaagaucacaccgcaguccucaauaaccgaggccgaacugacuggcuaugguaccgugacaauggaguguagucccaggaccgggcuugauuucaacgaaaugguacuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaauacaguaugagggugacgggucuccaugcaagauccccuucgaaauuacggauuuggagaaaaggcauguacucggccggcugaucaccguuaacccgaucgugauugaaaaggacuccccugucaacauagaggccgaacccccauuuggagauagcuacaucauuaucggcguggagccugggcaguuaaaacugaauugguucaagaagggaucgucuauuggucaaauguuugagacaacuaugcgaggcgcuaaacgcauggccauccuaggggacaccgcaugggauuucggaucccucggcggugucuuuacaucaauagggaaggcccugcaccagguguucggcgcuaucuacggagcggcauuuaguggcguuagcuggacuaugaaaauucuuaucggggugguaauuaccuggaucggaaugaacuccagaucuacgagcuugucagucagucuggugcucguuggcguggucacacuguaucuuggugccauggugcaggcugacuccggguguguagugagcuggaagaauaaagaacugaagugcggaucuggcauauucauuaccgauaacguucacacuuggacagagcaguacaaguuucaacccgaaucaccaaguaaauuggccagcgcaauccagaaggcccaugaggaagguauuuguggcaucagguccgucacccggcucgagaaucugauguggaaacagauaacucccgaguuaaaccacauccugucugaaaaugaggugaagcuaaccauuaugacaggggacacgaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguauuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauucccaagaauuucgcaggccccgucagccagcacaacuaccgaccugguuaucauacucaaaccgcuggcccauggcaccucgggaagcuggaaauggauuuugacuucugugagggaacaacugugguugugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggucaauagucuggugaccgcgggacauggccagauagauaacuuuagcuuagguguucucggcauggcccuguuccuugaagagaugcugcgcacucgaguggggacaaaacacgcuaucuugcucguagcagucucguuugugacccugauuacgggaaauauguccuuccgggaccuaggccgugugauggucaugguuggggccacuaugaccgaugacaucggaaugggcgugacauaucuggcucuccuggccgcauuuaagguaagacccaccuucgcggccggucuuuugcugaggaaauuaacuucuaaggagcucaugauggcuacaauugggaucacccugcuuagccagucaacaauaccugaaacuauccuggagcuaaccgaugcccucgcacugggaaugaugguguugaaaauuguccgcaacauggaaaaguaccaacuggcugugacgaucauggccauuaguugcguucccaaugcagugaucuuacggaacgccuggaaggucuccuguacaauacucgcugcggugucuguuagcccacugcuucugaccuccucacagcagaaagccgacuggauuccuuuggcacucacuaucaagggccugaaucccaccgcuaucuuucuaacaacucugagcagaaccaguaaaaagaggucuuggccacuuaacgaggccauuauggccgugggcauggucuccauacucgcuagcucgcuguugaaaaaugacaucccgaugacggggccucugguagcaggagguuuacucacagugugcuauguucugaccggccgaucagccgaucuugaacuggagcgcgcggcugacgugaagugggaggaucaggccgaaauuucugggaguucccccaucuugagcauuacuaucucugaggacggaagcauguccaucaagaacgaagaggaggaacaaacacucaccauccugauucggacuggccuacuggucaucucagguguguucccaguaaguauucccaucacagcagccgcuugguaccuuugggaggugaagaagcagagagcagggguccucugggauguuccuagcccacccccugugggaaaagccgaacuggaggacggcgcguauaggauaaagcagcguggcauuuugggguacucucagaucggagcugguguguauaaagaaggcaccuuucacacgauguggcaugucacucgcggggccguguuaaugcaccggggaaagagaaucgagccguccugggcagauguuaaaaaggaccugauuucauacggcgguggguggaagcucgagggagaauggaaagagggcgaagagguacaagugcuggcccuugaaccaggcaagaaucccagggcuguccagaccaaaccugggaucuucaagacaaacaccggaacaauaggugccgugagucuggauuuuagcccaggcacuuccgggucucccauuguugaccgaaaaggaaagguggucggcuuguacgguaauggggugguaacccggucgggagcauaugucagcgcuaucgcccagacggagaagucaauugaggauaacccugaaaucgaggacgauauauuccgcaaaaagagacuaacaauuauggaccugcauccgggcgcgggcaaaacuaagagguaccuccccgccaucgugcgggaagcaaucaaacgagggcugagaacccuuauuuuagcuccaacacgcguuguggccgcugagauggaagaggcacugaggggacucccuauccguuaucagacccccgccauuaaggccgagcacacuggucgggaaauagucgacuugaugugucaugcuaccuucacaaugagacugcucuccccagugaggguuccuaacuacaaucugaucauuauggaugaggcgcacuuuacggaccccgcaaguaucgccgcucgcggcuauaucucuacucgaguggaaaugggggaggccgcaggaauuuucaugaccgccacaccaccgggcagcagagauccuuuuccccaauccaacgcuccaauaauggacgaggaacgggagauccccgaaaggucauggaacucuggucacgagugggucaccgauuucaaggggaaaacugugugguuuguaccuagcauuaaggcgggaaacgacaucgccgcaugccuucgcaaaaauggcaagaaagugauucagcugagucguaagacauucgauuccgaauacguuaagaccagagcuaacgacugggauuuugucgugacgacugacaucagcgagaugggcgccaauuucaaagcagagcgggugauagauccaaggcgcuguaugaagcccgucaucuugacagacggggaagaacgaguaauucuagccggaccuaugccggugacccauucuucagcugcccagagacgggguaggaucggccgcaaccccaaaaaugaaaacgaccaauauauuuacaugggggagccccuggaaaaugaugaggacugcgcgcacuggaaggaggcaaaaaugcucuuagauaacaucaauaccccugaaggaauaauucccuccauguuugagccagaaagagagaagguugacgccaucgauggcgaauacaggcugcggggugaggcucguaaaacuuucguggaccuuaugcgccgaggggaucugccugucuggcucgccuauaagguggcugcagagggcauuaacuacgccgacagaaagugguguuuugauggaaucaaaaauaaccagauauuggaagagaacguugaaguggagaucuggacaaaggagggcgaaaggaaaaagcugaaaccccgguggcucgacgcucgcauuuauagugauccacuggcccuuaaggaguucaaggaguucgcagcggggagaaaaagccuaacccugaauuugaucacagagaugggaagguuaccuacuuuuaugacgcagaaggcccggaacgcucuggacaaucucgccguccugcauaccgcagaagcugguggcaaagccuacaaccacgcacuuucggagcugccggagacacucgaaacuuugcugcuacugacccuccuugccacagugaccgggggaauuuuccuguuuuuaaugucuggcaaggguaucgggaaaaugacuuugggcaugugcugcauaauuacggcuuccguacugcucugguaugcgcagauccaaccccacuggaucgccgcaagcauuauccuggaguucuuucuuauagugcugcucauuccagaaccugagaagcagcgaaccccacaggauaaucaguugacauacguugucaucgcuauucugacugugguggccgccaccauggcaaacgaaaugggauucuuagagaagaccaaaaaggaccuaggccuggggucaaucaccacucaagagagugaaucuaauauacucgacaucgaucuuagaccagcuuccgccuggacacuguaugcggucgcuacgaccuuuguuacuccuauguugcgccauagcauugagaacucaagugugaauguaagccugacagccaucgcaaaccaggccaccgugcucaugggacuggguaaaggcuggccccuuuccaagauggacauuggggucccgcuccuggcuaucggauguuacucucaggugaauccaauuaccuugacagcagcccuguuacuacugguugcgcacuacgcuaucauaggcccuggucuccaggccaaagcaacuagggaagcccaaaagcgggcugccgcagggauuaugaagaaccccacgguggauggcaucaccgucaucgaccuugagccaauucccuaugauccuaaauucgaaaagcagcugggacagguaauguugcugauacucugcgugacacagguucugaugaugcguacuaccugggcucuuugugaggccuuaacacuggcgaccggcccgaucagcacucucugggaggggaaucccggaagauuuuggaacacgacaauugccguguccauggcaaauaucuucaggggcucauacuuggcuggugccgggcugcuauuuucuauuaugaaaaacaccacuaauacccgccggggaacaggcaacaucggugaaacucugggcgagaaguggaaaagucgacucaacgcacuugggaagucggaguuccaaauauauaaaaagagcggaauccaggaggucgacagaacccuggcuaaggagggcauuaaaagaggggaaacagaucaucacgccgugucccgcggaucugccaaguugcggugguuugucgagagaaauauggugacgccagaaggcaaaguuguggaccuggguugcgggcguggaggcuggucauacuauugugguggccucaagaacguaagggaggugaaagggcugaccaagggaggcccugggcaugaagaaccaaucccuaugagcacuuacggauggaauuuaguccggcuucaguccggcguugauguguucuucacaccacccgagaagugcgacacccugcucugugauauuggugaaaguucuccuaacccaacuaucgaggcggggcgcacacuacgaguccugaauuugguggaaaacuggcugaauaacaauacccaauuuugcauaaaaguacucaaccccuauaugccgagcgugauugagaagauggaaacgcuucagagaaaauacggaggcgcucugguuaggaauccuuugucacggaacuccacccacgagauguacugggugaguaaugcaacaggcaacaucgucagcucugugaauaugaucucccgcaugcugauuaacagauucacuaugaagcacaaaaaggccaccuaugagccagacgucgaucucgggucaggaacaaggaacauagguaucgaaagcgagauucccaauuuagacaucauuggcaagcgaaucgagaaaauaaagcaggagcaugaaacuucguggcacuacgaccaggaucauccuuauaaaaccugggcuuaccacgggucuuaugagacaaagcaaaccggaagugccuccagcauggugaacggcguuguacggcugcuuacuaaaccaugggacgugguccccauggugacgcagauggcaaugacagauaccacuccguuuggucagcagcguguuuucaaggagaagguggacaccagaacacaagaaccuaaagaggggacgaagaaacugaugcgcaucaccgccgaauggcuauggaaggagcucggcaaaaagaaaacucccaggauguguacacgggaggaauuuaccagaaagguccgcucaaaugcugcgcugggcgccauuuucacugaugagaacaaguggaaauccgcaagggaagcuguggaggacggccgauuuugggaauugguagauaaggagcggaaucugcaccucgaggggaaaugcgaaacauguguguacaacaugaugggaaagagagagaagaaacuuggugaguucggcaaagccaaagggucuagggcaaucugguauauguggcugggagcccgcuuuuuagaguucgaagcucugggcuuuuugaaugaggaccauugguucagccgugguaacagucucuccgggguugagggagaaggccugcaccggcuaggcuacauucuuagagaugucgggaagaaagagggaggugccauguacgcggacgauaccgcaggcugggacacaaggaucacucuggaagaccucaagaaugaggaaauggugaccaaccauaugaaaggggagcacaagaagcuggccgaggcuauuuuuaaauugacguaucagaauaaggugguccgcguucagcgaccaaccccucggggaacagugauggauauaaucagcagaagggaccagcgcggcucuggucaaguagggacuuacggacugaacaccuucacaaauauggaagcccagcucauuagacagauggagggcgaaggcaucuucaaaucaauccaacaucuuacugcaaccgaggagauugcugugcagaacuggcuggcccgggucgggagggaacguuuaagucgaauggcuauauccggagaugacugcgugguuaagcccaucgaugaccgcuuugccagcgcacugacggcguugaaugauauggguaaagugagaaaggacauucagcagugggagccaucucggggcuggaacgauuggacacaaguccccuucugcucgcaccacuuucaugaacucgugaugaaggacgggaggguacugguugugccuugucgcaaccaggaugagcuaaucggaagggcccggauuucacagggcgcugguuggagccuuaaagaaaccgccugccuggggaaguccuaugcacagauguggacucucauguacuuccacaggcgagaccugcguuuggcugccaaugcaaucuguagugccgucccaucucauugggugccgacaagcagaaccacuugguccauacacgcgaaacacgaguggaugaccacagaggauauguuagcuguguggaaccgcgucuggauccaagaaaaucccuggauggaggacaagacgccuguugaaucaugggaggaagugccauaucugggaaaacgggaggaccaguggugcggcagucucauuggccuuaccucuagggccacuugggcaaagaacauccagacagccauuaaucagguaagaagccugaucgggaacgaggaauacaccgauuauaugcccuccaugaagcgcuuucggagggaggaagaggaagcuggagugcuaugguga

SEQ ID NO: 14760 - RNA, 9876 nt, Artificial Sequence
  derived and/or modified CDS sequence (opt3) from DENV-2__GQ868595__SS-prME
accgccggagugaucauuaugcugauacccacagcuauggcuuuccaccucacuacgagaaacggggaaccucauaugaucguaagcaggcaggaaaagggaaaaucccuucuguuuaagaccgaggacgguguuaauaugugcacauugauggccauugauuuaggcgaacugugugaggacacuaucaccuacaaaugcccauuacuccggcaaaacgaaccggaggauauugacuguuggugcaauucuacaucaaccugggugacuuaugggacauguaccacgacuggagagcaccgccgagaaaagcguaguguugcgcuggugccccaugucggcaugggucuugagaccagaacagaaacuuggaugagcuccgagggggcuuggaaacacgugcagaggaucgagaccuggauacugcggcauccuggauucgccaucauggcagccauuuuggcuuacacaaucggcaccacgcacuuucagcgcgcacucauuuucauccugcugacugccguugcuccaucuaugacaaugagaugcauaggcauuucgaacagggauuuuguggaaggggucucaggagguagcuggguggacaucguacucgagcacggcaguuguguuaccacuauggccaagaauaagcccacauuagauuucgaacugauuaaaaccgaggcgaagcagccugcaacgcuucggaaauauugcaucgaagccaaguugaccaacacaacuaccgagucccgcuguccaacacaaggggagcccucucugaaugaagaacaggacaaacgauuuaucugcaagcauagcaugguggauagaggauggggcaacgguugugggcuauucggaaagggcggcauugucacuugcgcuauguuuaccugcaaaaagaauauggaagggaaaguggugcucccugagaaccuggaauacacaauagucaucaccccacacuccggagaggagcaugccguugguaaugacacuggcaagcacgggaaagaaauuaagaucacgccgcagucaaguauaacagaggcagaacuuaccggauauggcacugugaccauggaguguagccccaggacaggucuggauuucaacgaaaugguauugcuccagauggaggagaaggcuuggcuggugcaccggcaaugguuuuuagaccugccucucccauggcuucccggggccgauacccagggcucuaauuggauucagaaggaaacucuggucacauucaagaacccucaugcgaaaaagcaggacgugguuguguugggaucccaagagggcgccaugcacacggcacuaaccggggcuacugaaauccagaugucaagcggaaaucugcucuuuacaggucaucugaaaugccgucuucgcauggacaagcugcaguugaaaggcaugaguuacucuauguguaccgggaaguucaagaucgucaaagagauugccgagacacaacacggaacuaucgugauuagaguacaguaugaaggcgaugguuccccaugcaagauacccuucgagaucauggaccucgagaagaggcauguucuggggcgguuaauuaccgugaacccgaucgucacggagaaggauagcccugugaacaucgaagcugagcccccauuuggcgacucguacauuauaaucggagucgagccuggccagcugaaacuaaauugguucaagaaggggucuuccauuggacagauguuugaaaccacaaugcgaggugccaaacgcauggcaauccucggcgauacugccugggacuucgggucacugggaggcguguuuaccaguauugguaaggcacuucaccaaguuuucggggcgaucuacggcgcagccuuuagcggaguguccuggacaaugaaaauauugaucggcguaauuaucacuuggauugggaugaacucuagaagcaccucacugagugucucccucgugcugguuggaguggucacgcuuuaucugggcgcuauggugcaggccgauagcgguuguguagugucuuggaagaauaaagaguugaagugcgggucaggaaucuucauaacagacaacguucacaccuggacugaacaguacaaguuucagcccgagaguccaagcaaacucgcauccgccauucaaaaggcucaugaagagggcaucugugguauuaggucugucacacggcuggagaauuuaauguggaaacagaucacccccgaacugaaccacauacuaucggagaaugaagugaagcucacuaucaugaccggcgauauuaaagggaucaugcaggccggaaagcgcagccugagaccucagccaacagagcuuaaauauuccuggaagacguggggcaaggcaaaaauguugucaaccgaaagucauaaccaaacuuuccugauugacgggccggagacagcggagugccccaauaccaacagggcuuggaacucucucgaaguggaggauuacggauuuggcgucuucacaacuaacaucuggcugaaguuacgugaaaaacaggacguauuuugugacagcaagcugauguccgccgcaauaaaagauaaucgggccgugcacgcugacauggguuauuggauugagucagcccuuaacgauaccuggaagauggagaaggcgucauucaucgaagugaaaucuugccacuggccuaagucccauacguuguggaguaaugggguacucgagagcgaaaugaucauucccaagaauuucgcuggacccgucucucagcacaacuaccgaccuggcuaucauacacagaccgccgguccauggcaccugggcaagcuagagauggacuuugauuucugugaagggacuaccgugguugugacagaggacugcggaaauagaggccccucccugaggacuaccacagcgucagggaaacucaucacggaguggugcugucgcaguugcacccugccgccucuucgguacagaggagaagauggcuguugguacgguauggagauuaggccauugaaggaaaaggaggaaaaccuggucaauagcuuagugacugccgggcauggacaaauagacaacuuuucgcucggcguucuggguauggcucuuuuccuggaggagauguugcgcacacgagugggcaccaaacacgcaauccuccugguagccgucuccuuugugacucuaauuacagggaauaugucuuuccgggaucugggacgugugauggucaugguuggcgcuaccaugacggacgauaucgggaugggagugacuuaucucgcccugcuugcagcguuuaagguaagacccaccuucgccgcuggcuugcuguuaaggaaacucacaagcaaggaacugaugauggccaccauugguaucgcacuucugucacagaguacuauaccugagacaauccuagaacucaccgacgcucuggccuuggggaugauggugcugaaaauuguccgcaacauggagaaguaccaguuagcagugacaaucauggccauuuccugcguucccaaugcugugauccuccugaacgcguggaaggucucuuguacuauacuugccgcagugagcguuuccccacuguugcucaccucaagccaacagaaagcugauuggauuccucuggcccuaacgaucaagggacugaaucccacagccaucuuucuuaccacucucagucggaccucuaaaaagagauccuggccacugaacgaagcugugauggcagucggcaugguaagcauuuuggccucgucacugcucaaaaaugacauaccgaugacaggcccucuaguggcagggggacugcuuacuguuugcuaugugcugaccgguaggucugcugacuuggagcucgagcgagccgcagaugucaagugggaagaccaggccgagaucaguggcuccagccccauucugucuaucacgauuagcgaagauggguccaugucaaucaaaaacgaggaggaagaacagacacuaaccauacugauccgcacuggacuucucgugauuaguggcguauucccagugagcauccccauuacagcugcagccugguaccugugggaagucaagaagcaacgggcggguguuuugugggacgugccuucuccacccccuguggggaaagcugaguuagaagauggagccuauagaaucaagcagaggggcauacugggcuacucccagauuggggcaggagucuauaaagaggguaccuuucacacuauguggcaugugacacguggcgccguucucaugcaccgcgggaagcggaucgagccgucaugggcugacgucaagaaagaucugaucaguuacggaggcgguuggaaacuugaaggggaguggaaagaaggagaggaagugcagguccuggccuuggagccaggcaaaaaucccagagcagugcaaaccaaaccuggccuauucaagacgaacacugggaccauuggagcuguuagccuggacuuuuccccagguacaucuggcucgcccaucguggauaggaaagggaaggucgugggacucuacggcaaugguguagucacccgaagcggggccuaugugucagcgauagcccagacagagaaguccauugaagacaacccugagaucgaagaugacauuuuccggaaaaagcgccugacuaucauggaucuucauccgggagcaggcaaaaccaagagauacuuacccgcuauaguuagggaggccauuaaacggggccugcgaacgcucaucuuggcuccaacaagaguggucgcagccgaaauggaggaggcccugcgcgggcucccuaucagguaucagacucccgcuauucgugcggaacacaccggacgggagaucguggaccugaugugucaugcaacauucaccaugagacuucugaguccaguuagggugccuaacuacaauuugauuauaauggacgaagcccacuuuacugaucccgcuucuaucgccgcacgcgguuauauuagcacccgagucgagaugggcgaggccgcugggaucuucaugacagcgacgccaccgggauccagagacccuuuuccccagucaaacgccccaaucauggaugaagaacgggaaauucccgagaggucuuggaauagcggccacgaaugggugacugacuucaaggguaagaccguaugguuugugccuaguauaaaagcagggaacgauaucgcugccugccuacgcaagaauggcaaaaagguuauucaacugucccguaaaacauucgacagcgaguacgucaagaccagagcaaacgauugggacuuuguggugacuacagauaucucugagaugggcgccaauuuccgggcugaaagggucauugacccacgccgauguaugaagcccguaauccucaccgauggcgaggaaagagugauauuagccgggccuaugccgguuacgcauucauccgcggcacagcggaggggacgcaucgguagaaaccccaaaaaugagaacgaccaguauauuuacaugggcgaaccacuggagaaugacgaggauugcgcccacuggaaggaagcuaaaaugcuucuggacaacaucaauacuccugaggggauuauccccaguauguuugaaccagagagggaaaagguggaugccauagacggagaguaccggcuccguggcgaggcucgcaaaacauucgucgauuugaugcgaagaggugaccugccuguguggcucgcauauaggguugccgcugaagggauuaacuacgccgaucggcgcugguguuuugacggcaucaagaauaaccaaauucuggaggaaaacguggaggucgagaucuggaccaaagaaggagagagaaagaaacuuaaacccagguggcuagaugcacggauauauagcgacccacuggcguugaaggaguucaaagaguucgccgcuggccgaaagucguuaacccugaaucucaucacugaaauggggagacugccuacauuuaugacccagaaagcccgcgaugcacuugacaaccuggcugugcuccauacagccgaggcaggagguagggccuacaaucacgcuuugucugagcugccggaaacucuagagacgcugcuccuucugaccuuauuggcgacaguaacuggcgggauuuuccuguuucucauguccggaaagggcaucgguaagaugacccuggggaugugcugcauuaucacagccagcauacuucugugguaugcacagauucagccccacuggaucgcugccucaaucauucucgaguucuuuuugaucgugcuguuaauaccagagccugaaaaacaacggacaccacaggauaaccagcuaacuuacguugucauugccauccugacggugguggcagcuaccauggccaaugagaugggcuuccucgagaagaccaaaaaggaccuuggacugggcaguauuacuacccaggaaucugaguccaacaucuuggacauagaucugcguccagcgagcgcuuggacacucuaugccgucgcaaccacuuuuguuacaccuaugcugagacauucaaucgaaaauaguagcgugaacguaucccuuacggccauugcuaaucaagcaaccgugcucauggggcugggaaaagguuggcccuugucuaagauggacaucggcgucccgcuguuagccauuggguguuacagccaggugaacccaaucacucuaacagcggcucugcuccuucugguugcccacuacgcaauuaucggaccuggcuugcaggccaaggcuaccagggaggcccagaaacgcgcagcugccgguauaaugaagaaucccaccguggaugggauuacagucaucgaccuggaaccaauccccuaugauccuaaauucgagaagcaacucggccagguaaugcugcuuauuuuaugcgugacucagguucugaugaugcggacgaccugggcgcucugugaggccuugacacuggcaacuggaccgauauccacccuaugggaaggcaaccccgggcgauuuuggaauacaaccaucgcugugucaauggccaacauuuucagaggaucuuaccuggcaggcgcuggucuccuuuuuaguaucaugaaaaauacuacgaacacaaggcgcgggaccggaaauauuggcgagacucugggugaaaaguggaagucgcgguugaacgcccugggcaaaagcgaguuccagaucuauaagaaauccgggauacaagaggucgacagaacccucgccaaggaaggaaucaaacguggcgagacagaucaucacgcggugucuagggggucagcuaagcugcggugguuugucgaacgcaacauggugacuccagagggaaaaguuguggacuuaggcugcggucgagggggauggagcuacuauuguggcggucuuaagaauguaagagaagugaagggccugaccaaagggggaccuggccaugaggagcccauuccuauguccacauacggguggaaccucgucaggcuacagaguggaguugauguguucuucacgccacccgaaaagugcgacacccuguugugugauaucggcgagucuagcccuaauccaacuauugaagcaggucggacacugcgcguccucaaccuuguggagaauuggcugaacaauaacacccaguuuugcaucaaaguauugaaucccuauaugccgucagugauagaaaagauggagacucugcaaagaaaauacgggggagcccucguuaggaacccuuuaucccgaaauaguacacacgagauguacugggugagcaacgcuaccggcaauauugucucuuccgugaacaugaucucacggaugcugaucaaucguuucacgaugaagcacaagaaagccaccuaugaaccagacgucgaucuuggcagcgggacaagaaacauuggaauagagucggaaauccccaaccuggacauuaucgguaagcgcauugagaaaaucaagcaggaacaugagacuucuuggcacuacgaccaggaucauccuuauaaaaccugggcauaccacggcaguuaugagacaaagcagacuggguccgccagcucaauggugaauggaguuguaaggcuacucaccaagccaugggacgugguccccauggugacacaaauggcuaugaccgauacuacgccguuuggccagcagcggguuuucaaagaaaagguggacacaagaacccaggagccuaaagaagguacuaagaaacugaugcgcauaaccgcggagugguuguggaaggagcuggggaagaaaaagacacccaggauguguacgcgagaagaguuuacccggaaagucagauccaacgccgcacucggagcuaucuucacugaugaaaauaaguggaaaucugccagggaggcaguggaagacagccgcuuuugggagcuuguagaucgugagcggaaccugcacuuagaaggcaagugcgagacauguguguacaauaugaugggcaaaagagaaaagaagcugggggaguucggaaaagccaaggguaguagggcuauuugguauaugugguugggcgcccgcuuucucgaguucgaggcgcugggguuucuaaacgaggaccauugguucucccgaggaaauagccuuucuggcguugaaggugaggggcugcaccggcucggauacauccugagagaugucagcaaaaaggaaggcggcgcaauguacgccgacgauaccgcugggugggacacuaggauuacauuggaggaccugaaaaacgaagagauggugaccaaucauaugcgcggagagcacaagaagcucgccgaagcaaucuuuaaacuuacauaucaaaacaagguggucagaguucagcggccaacuccuagggguaccgugauggauauuauaagucgucgagaccagcgcggcuccgggcagguaggaacguacggccugaauaccuucacaaacauggaggcucaauuaaucagacagauggaaggugaggggauuuucaaaagcaucaagcaucugacugugaccgaggaaaucgccguccagaauugguuggcucgggugggaagggagcgccucucuagaauggccauuucgggcgaugacugcguugugaaaccccuggaugaccgguuugcaucagcgcuaacagcccuuaacgauaugggcaaggucaggaaggacauacaacagugggaaccaagccgaggguggaaugauuggacucaggugcccuucugcucccaccacuuucaugagcugguaaugaaagacggacguguucucguggucccuuguagaaaccaggaugaacugaucggucgcgcucggauuagucaaggcgccggguggucuuugaaggagaccgcaugcuuaggaaaaagcuaugcucagauguggacgcugauguacuuccacaggagagaccuccgccuugccgcaaacgccaucuguuccgcggugccaucacauugggugccgacaagucggaccacuuggucuauucacgcuaagcacgaguggaugacaaccgaagauaugcuggccgucuggaauaggguuuggauccaggagaaccccuggauggaagacaaaacuccuguggagagcugggaagagguaccauaucuaggcaagcgagaggaccaguggugcgguucccugauagggcucaccucaagagcaacaugggccaagaauauccaaacggcuauuaaccaggugcggagcuugaucggaaaugaagaguacaccgauuauaugcccucuaugaaaagguuucgccgugaagaggaagaggccggcguccugugguga

SEQ ID NO: 14761 - RNA, 9876 nt, Artificial Sequence
  derived and/or modified CDS sequence (opt3) from DENV-2__GQ868540__SS-prME
accgcaggcgugaucauuaugcugauacccacagcuauggcauuccaccucacuacgagaaacggggaaccucauaugaucgucggaaggcaggaaaaggguaaaagccuucuguuuaagaccgaggacggcguuaauaugugcacauugauggcaauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuaucugcaagcauucuaugguggauagaggcugggguaacggguguggacuuuucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggaaaagaaauuaagaucacgccgcaguccucaauaacagaggcagaacuuaccggcuaugguacugugaccauggaguguagucccaggacagggcuggauuucaacgaaaugguauugcuccagauggaggagaaggcuuggcuggugcaccggcaaugguuuuuagaccugccucucccauggcuucccggcgccgauacccagggaagcaauuggauucagaaggaaacucuggucacauucaagaacccucaugcgaaaaagcaggacgugguuguguugggcucucaagagggggccaugcacacggcacuaaccggagcuacugaaauccagauguccucagguaaucugcucuuuacaggccaucugaaaugccgucuucgcauggacaagcugcaguugaaagggaugagcuacaguauguguaccggaaaguucaagaucgucaaagagauugccgagacacaacacggcacuaucgugauuagaguacaguaugaaggugaugggucuccaugcaagauacccuucgagaucauggaccucgagaagaggcauguucugggccgguuaauuaccgugaacccgaucgucacggagaaggauuccccugugaacaucgaagcugagcccccauuuggagacagcuacauuauaaucggcgucgagccugggcagcugaaacuaaauugguucaagaagggaucgucuauuggucagauguuugaaaccacaaugcgaggcgccaaacgcauggcaauccucggggauacugccugggacuucggaucccugggcgguguguuuaccucaauugggaaggcacuucaccaaguuuucggcgcgaucuacggagcagccuuuaguggcgugagcuggacaaugaaaauauugaucgggguaauuaucacuuggauuggaaugaacuccagaucuaccagccugucagucagucucgugcugguuggcguggucacgcuuuaucugggugcuauggugcaggccgauuccggguguguagugagcuggaagaauaaagaguugaagugcggaucuggcaucuucauaacagacaacguucacaccuggacugaacaguacaaguuucagcccgagucaccaaguaaacucgcaagcgccauucaaaaggcucaugaagaggguaucuguggcauuagguccgucacacggcuggagaauuuaauguggaaacagaucacccccgaacugaaccacauacuaucugagaaugaagugaagcucacuaucaugaccggggauauuaaaggaaucaugcaggccggcaagcgcucgcugagaccucagccaacagagcuuaaauauagcuggaagacgugggggaaggcaaaaauguuguccaccgaaucacauaaccaaacuuuccugguggacggaccggagacagcggagugccccaauaccaacagggcuuggaauagucucgaagucgaggauuacggcuuugguguuuucacaacuaacauuuggcugaaguuacgugaaaaacaggacguguuuugugacucuaagcugaugagcgccgcaaucaaagauaaucgggccgugcacgcugacaugggguauuggauagaguccgcccuuaacgauaccuggaagauggagaaggcaucauucauugaaguaaaaagcugccacuggccuaagucucauacguugugguccaauggaguccucgagagugaaaugaucauccccaagaauuucgcuggccccgugagccagcacaacuaccgaccugguuaucauacacagaccgccggcccauggcaccuggggaagcuagagauggacuuugauuucugugaaggaacuaccguuguggucacagaggacugcggcaauagagggcccucucugaggacuaccacagcguccggaaaacucauuacggaguggugcugucgcucaugcacccugccgccucuucgguacagaggcgaagaugguuguugguacgggauggagaucaggccauugaaggaaaaggaggaaaaccuggugaauaguuuaguuacugccggacauggccaaauugacaacuuuagccucggugugcugggcauggcucuuuuccuggaggagauguugcgcacacgaguagggaccaaacacgcaauacuccuggucgccgugucguuugugacucuaaucacaggaaauauguccuuccgggaucugggccgugucaugguuauggugggggcuaccaugacggacgauauuggaaugggcguaacuuaucucgcccugcuugcagcguuuaaggugagacccaccuucgccgcugguuugcuguuaaggaaacucacaucuaaggaacugaugauggccaccaucgggauugcacuucugagccagucaacuaucccugagacaauacuagaacucaccgacgcucuggccuugggaaugaugguccugaaaaucgugcgcaacauggagaaguaccaguuagcaguuacaauuauggccaucaguugcgugcccaaugcugucauucuccugaacgcguggaagguguccuguacuauccuugccgcaguuucugugagcccacuguugcucaccuccucacaacagaaagcugauuggauaccucuggcccuaacgauuaagggccugaaucccacagccaucuuucuuaccacucucagccggaccaguaaaaagagaucuuggccacugaacgaagcugucauggcaguaggcaugguguccaucuuggccagcucgcugcucaaaaaugacauuccgaugacagggccucuaguugcgggaggucugcuuacugugugcuauguccugaccggcaggucagcugacuuggagcucgagcgagccgcagaugugaagugggaagaccaggccgagauaucugggaguucccccauccugagcauuacgaucucugaagauggaagcauguccauuaaaaacgaggaggaagaacagacacuaaccauccugauacgcacuggccuucucguaaucucagguguguucccagucaguauucccaucacagcugcagccugguaccugugggaaguuaagaagcaacgggcggggguguugugggacgugccuagcccacccccugucggaaaagcugaguuagaagauggcgccuauagaauuaagcagaggggcauccugggguacucucagauaggagcugguguguauaaagagggcaccuuucacacuauguggcauguuacacguggggccguacucaugcaccgcggaaagcggauugagccguccugggcugacgugaaaaaggaucugaucucauacggcgguggguggaaacuugaaggagaguggaaagaaggcgaggaaguccaggugcuggccuuggagccaggcaagaaucccagagcaguucaaaccaaaccugggcuauucaagacgaacacuggaaccaucggugcugugagucuggacuuuagcccaggcacauccgggucucccauugucgauaggaaaggaaaggugguaggccucuacgguaauggggucgugacccgaucgggagccuauguuagcgcgaucgcccagacagagaagucaauagaagacaacccugagauugaagaugacaucuuccggaaaaagcgccugacuauuauggaucuucauccgggcgcaggcaaaaccaagagauacuuacccgcuaucgugagggaggccauaaaacgggggcugcgaacgcucauuuuggcuccaacaagagucguggcagccgaaauggaggaggcccugcgcggacucccuaucagguaucagacucccgcuauccgugcggaacacaccggucgggagauuguugaccugaugugucaugcaacauucaccaugagacuucuguccccagugagggucccuaacuacaauuugaucauuauggacgaagcccacuuuacugaucccgcuaguauagccgcacgcggcuauaucucuacccgaguggagaugggggaggccgcuggaauuuucaugacagcgacgccaccgggcagcagagacccuuuuccccaguccaacgccccaaucauggaugaagaacgggaaauccccgagaggucauggaacucuggucacgaauggguaacugacuucaaggggaagaccgugugguuuguuccuagcauuaaagcaggaaacgauauagcugccugccuacgcaagaauggcaaaaaggucauccaacugagucguaaaacauucgacuccgaguacgugaagaccagagcaaacgauugggacuuuguggucacuacagauauuagcgagaugggcgccaauuuccgggcugaaaggguaaucgacccacgccgauguaugaagcccgugauucucaccgauggggaggaaagaguuaucuuagccggaccuaugccggugacgcauucuucagcggcacagcggaggggucgcauaggcagaaaccccaaaaaugagaacgaccaguauaucuacaugggggaaccacuggagaaugacgaggauugcgcccacuggaaggaagcuaaaaugcuucuggacaacauuaauacuccugagggaaucauucccuccauguuugaaccagagagggaaaaggucgaugccaucgacggcgaguaccggcuccguggugaggcucgcaaaacauucguggauuugaugcgaagaggggaccugccuguuuggcucgcauauaggguggccgcugaaggcauaaacuacgccgaucggcgcugguguuuugacggaauuaagaauaaccaaauccuggaggaaaacauggaggucgagauuuggaccaaagaaggcgagagaaagaaacuuaaacccagguggcuagaugcacggaucuauagugacccacuggcguugaaggaguucaaagaguucgccgcugggcgaaagagcuuaacccugaaucucauaacugaaaugggaagacugccuacauuuaugacccagaaagcccgcgaugcacuugacaaccuggcugugcuccauacagccgaggccgguggcagggccuacaaucacgcuuugucggagcugccggaaacucuagagacgcugcuccuucugaccuuauuggcgacaguaacugggggaaucuuccuguuucucaugucuggcaaggguauugggaagaugacccugggcaugugcugcaucauuacagccuccauccuucugugguaugcacagauacagccccacuggauugcugccagcaucauccucgaguucuuuuugauugugcuguuaaucccagagccugaaaaacaacggacaccacaggauaaccagcuaacuuacguugucauagccauucugacggugguggcagcuaccauggccaaugagaugggauuccucgagaagaccaaaaaggaccuuggccuggggucaaucacuacccaggaaagugagucuaacauuuuggacaucgaucugcguccagcguccgcuuggacacucuaugccgucgcaaccacuuuuguuacaccuaugcugagacauagcauagaaaauucaagugugaacguaagccuuacggccaucgcuaaucaagcaaccgugcucaugggacuggguaaaggcuggcccuuguccaagauggacauuggggucccgcuguuagccaucggauguuacucucaggugaacccaauuacucuaacagcggcucugcuccuucugguugcccacuacgcaaucauuggcccugguuugcaggccaaggcuaccagggaggcccagaaacgcgcagcugccgggaucaugaagaaucccaccguggauggcauaacagucauugaccuggaaccaauccccuaugauccuaaauucgagaagcaacucggacagguaaugcugcuuaucuuaugcgugacucagguucugaugaugcggacgaccugggcgcucugugaggccuugacacuggcaacuggcccgauuagcacccuaugggaagggaaccccggacgauuuuggaauacaaccauagcuguguccauggccaacaucuucagaggcucauaccuggccggugcugggcuccuauuuucuauuaugaaaaauacuacgaacacaaggcgcggaaccggcaauaucggugagacucugggcgaaaaguggaagagucgguugaacgcccuggggaaaucggaguuccagauuuauaagaaaagcggaauccaagaggucgacagaacccucgccaaggaaggcauaaaacguggggagacagaucaucacgcgguguccaggggaucugcuaagcugcggugguuugucgaacgcaacauggugacuccagagggcaaaguuguggacuuagguugcgggcgaggaggcuggucauacuauugugguggccuuaagaauguaagagaagugaaggggcugaccaaaggaggcccugggcaugaggagcccaucccuaugagcacauacggauggaaccucgucaggcuacaguccggcguugauguguucuucacgccacccgaaaagugcgacacccuguugugugauauuggugagaguucuccuaauccaacuaucgaagcagggcggacacugcgcguccucaaccuuguggagaauuggcugaacaauaacacccaguuuugcauuaaaguauugaaucccuauaugccgagcgugaucgaaaagauggagacucugcaaagaaaauacggaggcgcccucguuaggaacccuuuaucacgaaauuccacacacgagauguacugggugaguaacgcuaccggcaauauagucagcucugugaacaugauuucccggaugcugaucaaucguuucacgaugaagcacaagaaagccaccuaugaaccagacgucgaucuugggucaggaacaagaaacaucgguauugagagcgaaauacccaaccuggacaucauuggcaagcgcaucgagaaaauuaagcaggaacaugagacuucguggcacuacgaccaggaucauccuuauaaaaccugggcauaccacgggucuuaugagacaaagcagacuggaagugccuccagcauggugaauggcguuguaaggcuacucaccaagccaugggacgugguccccauggugacacaaauggcuaugaccgauacuacgccguuuggucagcagcggguuuucaaagaaaagguggacacaagaacccaggagccuaaagaagggacuaagaaacugaugcgcaucaccgcggagugguuguggaaggagcugggaaagaaaaagacacccaggauguguacgcgagaagaguuuacccggaaagucagaucaaacgccgcacucggcgcuauauucacugaugaaaauaaguggaaauccgccagggaggcaguggaagacucucgcuuuugggagcuuguagaucgugagcggaaccugcacuuagaaggcaagugcgagacauguguguacaauaugauggggaaaagagaaaagaagcugggagaguucgguaaagccaagggcagcagggcuaucugguauaugugguugggggcccgcuuucucgaguucgaggcgcugggauuucuaaacgaggaccauugguucagucgaggcaauucccuuagcgguguugaaggggagggacugcaccggcucggcuacauucugagagaugucucuaaaaaggaaggcggggcaauguacgccgacgauaccgcuggaugggacacuaggaucacauuggaggaccugaaaaacgaagagauggugaccaaucauaugaagggugagcacaagaaacucgccgaagcaauuuuuaaacuuacauaucaaaacaaagugguccgcguucagagaccaacuccucggggcaccgugauggauaucauuucaaggcgugaccagcgagggaguggacagguaggcacguacggucugaauaccuucacaaacauggaggcucaauuaauacgccagauggaaggggagggaaucuucaaguccauucagcaucugacugugaccgaggaaaucgccguccaaaauugguuggcuagagugggccgggagaggcucagccgcauggccaucucuggcgaugacugcguugugaaaccccuggaugacagauuugcaucggcgcuaacagcccuuaacgauauggggaagguccggaaggacauucagcagugggaaccaucaaggggauggaaugauuggacucaggugcccuucugcagccaccacuuucaugagcugguaaugaaagacggucgaguucucguggucccuugucguaaccaagaugaacugauaggcagagcucgcaucucccagggggccggauggaguuugaaggagaccgcaugcuuaggcaaaucuuaugcucagauguggacgcugauguacuuccaccggagggaccucagacuugccgcaaacgccauuuguagcgcggugccaucccauugggugccgacaucacgcaccacuuggaguauccacgcuaagcacgaguggaugacaaccgaagauaugcuggccgucuggaaucggguuuggauucaggagaaccccuggauggaagacaaaacuccuguggagucuugggaagagaucccauaucuagguaagagggaggaccaauggugcgggagccugauaggacucaccucccgagcaacaugggccaagaauauccagacggcuauuaaccagguaagaucauugaucggcaaugaagaguacaccgauuauaugcccagcaugaaacgguuuaggcgcgaagaggaagaggccggcgugcugugguga

SEQ ID NO: 14762 - RNA, 9876 nt, Artificial Sequence
  derived and/or modified CDS sequence (opt3) from DENV-2__GQ868541__SS-prME
accgcaggcgugaucauuaugcugauacccacagcuauggcauuccaccucacuacgagaaacggggaaccucauaugaucgucggaaggcaggaaaaggguaaaagccuucuguuuaagaccgaggacggcguuaauaugugcacauugauggcaauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguugcgcuggugccccaugucgguauggggcuugagaccagaacagaaacuuggaugaguagcgagggagcuuggaaacacgugcagaggaucgagaccuggauacugcggcauccuggcuucgccaucauggcagccauuuuggcuuacacaaucggcaccacgcacuuucagcgcgcacucauuuucauccugcugacugccguugcuccauccaugacaaugagaugcauagggauuucuaacagggauuuuguggaaggagucucggguggcucauggguggacaucguacucgagcacgggagcuguguuaccacuauggccaagaauaagcccacauuagauuucgaacugauuaaaaccgaggcgaagcagccugcaacgcuucggaaauauugcaucgaagccaaguugaccaacacaacuaccgagagucgcuguccaacacaaggagagcccucccugaaugaagaacaggacaaacgauuuaucugcaagcauucuaugguggauagaggcugggguaacggguguggacuuuucggcaagggcgggauugucacuugcgcuauguuuaccugcaaaaagaauauggaaggaaaaguggugcucccugagaaccuggaauacacaauagucaucaccccacacagcggugaggagcaugccguuggcaaugacacugggaagcacggaaaagaaauuaagaucacgccgcaguccucaauaacagaggcagaacuuaccggcuaugguacugugaccauggaguguagucccaggacagggcuggauuucaacgaaaugguauugcuccagauggaggagaaggcuuggcuggugcaccggcaaugguuuuuagaccugccucucccauggcuucccggcgccgauacccagggaagcaauuggauucagaaggaaacucuggucacauucaagaacccucaugcgaaaaagcaggacgugguuguguugggcucucaagagggggccaugcacacggcacuaaccggagcuacugaaauccagauguccucagguaaucugcucuuuacaggccaucugaaaugccgucuucgcauggacaagcugcaguugaaagggaugagcuacaguauguguaccggaaaguucaagaucgucaaagagauugccgagacacaacacggcacuaucgugauuagaguacaguaugaaggugaugggucuccaugcaagauacccuucgagaucauggaccucgagaagaggcauguucugggccgguuaauuaccgugaacccgaucgucacggagaaggauuccccugugaacaucgaagcugagcccccauuuggagacagcuacauuauaaucggcgucgagccugggcagcugaaacuaaauugguucaagaagggaucgucuauuggucagauguuugaaaccacaaugcgaggcgccaaacgcauggcaauccucggggauacugccugggacuucggaucccugggcgguguguuuaccucaauugggaaggcacuucaccaaguuuucggcgcgaucuacggagcagccuuuaguggcgugagcuggacaaugaaaauauugaucgggguaauuaucacuuggauuggaaugaacuccagaucuaccagccugucagucagucucgugcugguuggcguggucacgcuuuaucugggugcuauggugcaggccgauuccggguguguagugagcuggaagaauaaagaguugaagugcggaucuggcaucuucauaacagacaacguucacaccuggacugaacaguacaaguuucagcccgagucaccaaguaaacucgcaagcgccauucaaaaggcucaugaagaggguaucuguggcauuagguccgucacacggcuggagaauuuaauguggaaacagaucacccccgaacugaaccacauacuaucugagaaugaagugaagcucacuaucaugaccggggauauuaaaggaaucaugcaggccggcaagcgcucgcugagaccucagccaacagagcuuaaauauagcuggaagacgugggggaaggcaaaaauguuguccaccgaaucacauaaccaaacuuuccugauugacggaccggagacagcggagugccccaauaccaacagggcuuggaauagucucgaaguggaggauuacggcuuuggugucuucacaacuaacaucuggcugaaguuacgugaaaaacaggacguauuuugugacucuaagcugaugagcgccgcaauaaaagauaaucgggccgugcacgcugacaugggguauuggauugaguccgcccuuaacgauaccuggaagauggagaaggcaucauucaucgaagugaaaagcugccacuggccuaagucucauacguugugguccaauggaguacucgagagugaaaugaucauucccaagaauuucgcuggccccgucagccagcacaacuaccgaccugguuaucauacacagaccgccggcccauggcaccuggggaagcuagagauggacuuugauuucugugaaggaacuaccgugguugugacagaggacugcggcaauagagggcccucucugaggacuaccacagcguccggaaaacucaucacggaguggugcugucgcucaugcacccugccgccucuucgguacagaggcgaagaugguuguugguacgggauggagauuaggccauugaaggaaaaggaggaaaaccuggucaauaguuuagugacugccggacauggccaaauagacaacuuuagccucgguguucugggcauggcucuuuuccuggaggagauguugcgcacacgaguggggaccaaacacgcaauccuccugguagccgucucguuugugacucuaauuacaggaaauauguccuuccgggaucugggccgugugauggucaugguuggggcuaccaugacggacgauaucggaaugggcgugacuuaucucgcccugcuugcagcguuuaagguaagacccaccuucgccgcugguuugcuguuaaggaaacucacaucuaaggaacugaugauggccaccauugggaucgcacuucugagccagucaacuauaccugagacaauccuagaacucaccgacgcucuggccuugggaaugauggugcugaaaauuguccgcaacauggagaaguaccaguuagcagugacaaucauggccauuaguugcguucccaaugcugugauccuccugaacgcguggaaggucuccuguacuauacuugccgcagugucuguuagcccacuguugcucaccuccucacaacagaaagcugauuggauuccucuggcccuaacgaucaagggccugaaucccacagccaucuuucuuaccacucucagccggaccaguaaaaagagaucuuggccacugaacgaagcugugauggcagucggcaugguauccauuuuggccagcucgcugcuaaagaaugacauaccgaugacagggccucucguggcgggaggucugcuuacuguuugcuaugugcugaccggcaggucagcugacuuggagcucgagcgagccgcagaugucaagugggaagaccacgccgagaucucugggaguucccccauucugagcaucacgauuucugaagauggaagcauguccaucaaaaacgaggaggaagaacagacacuaaccauacugauccgcacuggccuucucgugauuucagguguauucccagugaguauccccauuacagcugcagccugguaccugugggaagucaagaagcagcgggcggggguuuugugggacgugccuagcccacccccugugggaaaagcugaguuagaagauggcgccuauagaaucaagcaaaggggcauacugggguacucucagauuggagcugguguauauaaagagggcaccuuucauacuauguggcacgugacacguggggccguucucaugcaucgcggaaagcggaucgagccguccugggcugacgucaagaaagaucugaucucauacggcgguggguggaaacuugaaggagaguggaaagaaggcgaggaagugcagguccuggccuuggagccaggcaaaaaucccagagcagugcagaccaaaccugggcuauucaagacgaacacuggaaccauuggugcuguuagucuggacuuuagcccaggcacauccgggucucccaucguggauaggaaaggaaaggucgugggccucuacgguaaugggguagucacccgaucgggagccuaugugagcgcgauagcccaaacagagaagucaauugaagacaacccugagaucgaagaugacauuuuccggaaaaagcgccugacuaucauggaucuucacccgggcgcaggcaaaaccaagagauacuuacccgcuauaguuagggaggccauuaaacgggggcugcgaacgcucaucuuggcuccaacaagaguggucgcagccgaaauggaggaggcccugcgcggacucccuaucagguaucagacucccgcuauucgugcggaacauaccggucgggagaucguggaccugaugugucacgcaacauucaccaugagacuucuguccccaguuagggugccuaacuacaauuugauuauaauggacgaagcccacuuuacugaucccgcuaguaucgccgcacgcggcuauauuucuacccgagucgagaugggggaggccgcuggaaucuucaugacagcgacgccaccgggcagcagagacccuuuuccccaguccaacgccccaaucauggaugaagaacgggaaauucccgagaggucauggaacucuggucaugaaugggugacugacuucaaggggaagaccguaugguuugugccuagcauaaaagcaggaaacgauaucgcugccugccuacgcaagaauggcaaaaagguuauucagcugagucguaaaacauucgacuccgaguacgucaagaccagagcaaacgauugggacuuuguggugacuacagauaucagcgagaugggcgccaauuuccgggcugaaagggucauugacccacgccgauguaugaagcccguaauccucaccgauggggaggaaagagugauauuagccggaccuaugccgguuacgcacucuucagcggcacaacggaggggucgcaucggcagaaaccccaaaaaugagaacgaccaguauauuuacaugggggaaccacuggagaaugacgaggauugcgcccauuggaaggaagcuaaaaugcuucuggacaacaucaauacuccugagggaauuauccccuccauguuugaaccagagagggaaaagguggaugccauagacggcgaguaccggcuccguggugaggcucgcaaaacauucgucgauuugaugcgaagaggggaccugccuguguggcucgcauauaggguugccgcugaaggcauuaacuacgccgaucggcgcugguguuuugacggaaucaagaauaaccagauucuggaggaaaacguggaggucgagaucuggaccaaagaaggcgagagaaagaaacuuaaacccagguggcuagaugcacggauauauagugacccacuggcguugaaggaguucaaagaguucgccgcugggcgaaagagcuuaacccugaaucucaucacugaaaugggaagacugccuacauuuaugacccaaaaagcccgcgaugcacuugacaaccuggcugugcuccacacagccgaggccgguggcagggccuacaaucacgcuuugucggagcugccggaaacucuagagacgcugcuccuucugaccuuauuggcgacaguaacugggggaauuuuccuguuucucaugucuggcaaggguaucgggaagaugacccugggcaugugcugcauuaucacagccuccauacuucugugguaugcacagauucagccccauuggaucgcugccagcaucauucucgaguucuuuuugaucgugcuguuaauaccagagccugaaaaacagcggacaccacaagauaaccagcuaacuuacguugucauugccauccugacggugguggcagcuaccauggccaaugagaugggauuccucgagaagaccaaaaaggaccuuggccuggggucaauuacuacccaggaaagugagucuaacaucuuggacauagaucugcguccagcguccgcuuggacacucuaugccgucgcaaccacuuuuguuacaccuaugcugagacacagcaucgaaaauucaagugugaacguaagccuuacggccauugcuaaucaggcaaccgugcucaugggacuggguaaaggcuggcccuuguccaagauggacaucggggucccgcuguuagccauuggauguuacucucaagugaacccaaucacucuaacagcggcucugcuccuucugguugcccauuacgcaauuaucggcccugguuugcaggccaaggcuaccagggaggcccagaaacgcgcagcugccgggauaaugaagaaucccaccguggauggcauuacagucaucgaccuggaaccaauccccuaugauccuaaauucgagaagcagcucggacaaguaaugcugcuuauuuuaugcgugacucagguucugaugaugcggacgaccugggcgcucugugaggccuugacacuggcaacuggcccgauaagcacccuaugggaagggaaccccggacgauuuuggaauacaaccaucgcuguguccauggccaacauuuucagaggcucauaccuggccggugcugggcuccuauuuucuaucaugaaaaauacuacgaacacaaggcgcggaaccggcaauauuggugagacucugggcgaaaaguggaagagucgguugaacgcccuggggaaaucggaguuccagaucuauaagaaaagcggaauacaggaggucgacagaacccucgccaaggaaggcaucaaacguggggagacagaucaccaugcgguguccaggggaucugcuaagcugcggugguuugucgaacgcaacauggugacuccagagggcaaaguuguggacuuagguugcgggcgaggaggcuggucauacuauugugguggccuuaagaauguaagagaagugaaggggcugaccaaaggaggcccugggcacgaggagcccauuccuaugagcacauacggauggaaccucgucaggcuacaauccggcguugauguguucuucacgccacccgaaaagugcgacacccuguugugugauaucggugagaguucuccuaauccaacuauugaagcagggcggacacugcgcguccucaaccuuguggagaauuggcugaacaauaacacccaguuuugcaucaaaguauugaaucccuauaugccgagcgugauagaaaagauggagacucugcagagaaaauacggaggcgcccucguuaggaacccuuuaucacgaaauuccacacacgagauguacugggugaguaacgcuaccggcaauauugucagcucugugaacaugaucucccggaugcugaucaaucguuucacgaugaagcauaagaaagccaccuaugaaccagacgucgaucuugggucaggaacaagaaacauugguauagagagcgaaauccccaaccuggacauuaucggcaagcgcauugagaaaaucaagcaagaacacgagacuucguggcaucacgaccaggaucacccuuacaaaaccugggcauaucaugggucuuacgagacaaagcagacuggaagugccuccagcauggugaauggcguuguaaggcuacucaccaagccaugggacgugguccccauggugacacagauggcuaugaccgauacuacgccguuuggucaacagcggguuuucaaagaaaagguggacacaagaacccaggagccuaaagaagggacuaagaaacugaugcgcauaaccgcggagugguuguggaaggagcugggaaagaaaaagacacccaggauguguacgcgagaagaguuuacccggaaagucagaucaaacgccgcacucggcgcuaucuucacugaugaaaauaaguggaaauccgccagggaggcaguggaagacucucgcuuuugggagcuuguagaucgugagcggaaccugcacuuagaaggcaagugcgagacauguguguauaauaugauggggaaaagagaaaagaagcugggagaguucgguaaagccaagggcagcagggcuauuugguacaugugguugggggcccgcuuucucgaguucgaggcgcugggauuucuaaacgaggaccauugguucagucgaggcaauucccuuagcgguguugaaggggagggacugcaccggcucggcuauauccugagagaugucucuaaaaaggaaggcggggcaauguacgccgacgauaccgcuggaugggacacuaggauuacauuggaggaccugaaaaacgaagagauggugaccaaucauaugaagggugagcacaagaaacucgccgaagcaaucuuuaaacuuacauaccagaacaaagugguccgcguucaaagaccaacuccucggggcaccgugauggauauuauaucaaggcgugaccagcgagggaguggacagguaggcacguauggucugaauaccuucacaaacauggaggcucaguuaauccgccaaauggaaggggagggaauuuucaaguccauccagcaccugacugugaccgaggaaaucgccguccagaauugguuggcuagagugggccgggagaggcucagccgcauggccauuucuggcgaugacugcguugugaaaccccuggaugacagauuugcaucggcgcuaacagcccuuaacgauauggggaagguccggaaggacauacaacagugggaaccaucaaggggauggaaugauuggacucaggugcccuucugcagccaucacuuucaugagcugguaaugaaagacggucgaguucucguggucccuugucguaaccaggaugaacugaucggcagagcucgcauuucccaaggggccggauggaguuugaaggagaccgcaugcuuaggcaaaucuuacgcucagauguggacgcugauguauuuccaccggagggaccucagacuugccgcaaacgccaucuguagcgcggugccaucccacugggugccgacaucacgcaccacuuggaguauucaugcuaagcacgaguggaugacaaccgaagauaugcuggccgucuggaaucggguuuggauccaggagaaccccuggauggaagacaaaacuccuguggagucuugggaagagguaccauaccuagguaagagggaggaccaguggugcgggagccugauaggacucaccucccgagcaacaugggccaagaauauccaaacggcuauuaaccaggugagaucauugaucggcaaugaagaguauaccgauuacaugcccagcaugaaacgguuuaggcgcgaagaggaagaggccggcguccugugguga

SEQ ID NO: 14763 - RNA, 9876 nt, Artificial Sequence
  derived and/or modified CDS sequence (opt3) from DENV-2__GQ868603__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuucuaugcaagcauucuaugguggauagaggcugggguaacggguguggacucuucggcaagggcgggaucgucaccugcgccauguuuacaugcaaaaagaauauggaaggaaaaguggugcugccugagaaccuugaauacaccauugucauaacuccacacagcggugaggagcaugcuguuggcaaugacacggggaagcacggaaaagaaaucaagauuacaccgcaguccucaaucaccgaggccgaacugacuggcuaugguaccgugacaauggaguguagucccaggaccggguuggauuucaacgaaaugguacuccugcagauggaggacaaagcaugguuagugcaccggcaaugguuucuggaucucccucuuccauggcugcccggcgcugacacucagggaagcaauuggauacagaaggagacauuggucacguucaagaacccucaugccaaaaagcaggacgugguugugcuaggcucucaagaaggggcgaugcacaccgcccugacuggagcaacagagauucagauguccucagguaaucuccuguuuaccggccaucuuaaaugccgucugcgcauggauaaguugcagcucaaagggaugagcuacaguauguguacaggaaaguucaagaucgucaaagaaaucgcugagacucaacacggcaccauugugaucagaguacaguaugagggugacgggucuccaugcaagauucccuucgaaauaauggaucuggagaaaaggcauguuuuaggccggcugaucacggugaacccgauugucaccgaaaaggacuccccugugaacaucgaggccgaacccccauuuggagauagcuacaucauuauaggcgucgagccugggcagcuaaaacucaauugguucaagaagggaucgucuaucggucagauguuugagacaacuaugcgaggcgcuaaacgcauggccauucugggggacaccgcaugggauuucggaucccuuggcgguguguuuacaucaaucgggaaggccuugcaccaaguuuucggcgcuauuuacggagcggcauuuaguggcgugagcuggacuaugaaaauccugauagggguaaucauuaccuggaucggaaugaacuccagaucuacgagccucucagucagucuggugcuuguuggcguggucacacuguauuugggugccauggugcaggcugacuccggguguguagugagcuggaagaauaaagaacucaagugcggaucuggcauuuucaucaccgauaacguucacacuuggacagagcaguacaaguuucagcccgaaucaccaaguaaacuggccagcgcaauacaaaaggcccaugaggaagguauuuguggcaucagguccgucacccgguuagagaaucugauguggaaacagauuacucccgagcuaaaccacauccucucugaaaaugaggugaagcugaccauaaugacaggggacaucaaaggaauuaugcaggcuggcaagcgcucgcuuagaccucagccaacggaauugaaauauagcuggaagaccugggggaaggccaaaaugcuguccacugagucacauaaccaaacauuccucaucgauggaccggaaaccgcagagugccccaauacaaacagggcguggaauagucuggagguggaagacuacggcuuuggugucuucacuaccaacauuugguuaaagcugcgugagaaacaggacguucuuugugauucuaaguugaugagcgcugccaucaaagacaaucgggcagugcacgccgauaugggguauuggauagaauccgcucucaacgacacguggaagauggagaaggccucauuuauugaggugaaaagcugccacuggccuaagucucauacacugugguccaauggaguacuagaaagugagaugaucaucccaaaaaacuucgcaggccccgucagccagcacaacuaccgaccugguuaucauacccagacugcuggcccauggcaccuggggaagcucgaaauggauuucgacuuuugugagggaaccacagugguugugacugaagauugcggcaauagagggcccucucugaggaccacaacggccuccggaaaacuuauuaccgaguggugcugucgcucaugcacuuugccgccucugcgguacagaggcgaggacgguuguugguacgggauggaaaucaggccauuaaaggagaaggaagagaaccucgucaauagucuggugacagcgggacauggccaaauugauaacuucagccuugguguucugggcauggccuuguuucucgaagagaugcugcgcacccgaguggggacuaaacacgcuauacuacuggcagccguaucguucgucacacucaucaccggaaauauguccuuucgggaccugggccgugugauggugauggucggggcuacgaugacugaugacauuggaaugggcguuaccuaucuugccuugcuggcagcguucaaggugagacccacauuugccgcugguuuacuccugaggaaacuuaccucuaaggagcugaugauggccacuaucgggauugcacuacucagccagucaacaaucccugaaaccauacuggaguugacagaugcucuggccuuaggaaugaugguacucaaaaucgugcgcaacauggaaaaguaccagcuggucgugacuauuauggcaaucaguugcguucccaaugccgugauucuucaaaacgcuuggaaggucuccuguaccauccuggcggccgugucuguuagcccauugcuccugacguccucacggcagaaagcagacuggauaccucuagcucugacaauuaagggccuuaaucccaccgccaucuuccucacuacccugagcagaacaaguaaaaagaggucuuggccauugaacgaggccaucauggcugugggcauggucuccauucuggcaagcucguuacucaaaaaugacauaccgaugacugggccucugguagccggaggucuucugaccgugugcuauguuuugacgggccgaucagcggaucucgaacuggagcgcgcugccgacgugaagugggaggaucaggcagaaaucucugggaguucccccauucuaagcaucacaauuucugaggacggaagcauguccaucaaaaacgaagaggaggaacagacccugacuauacuuauccggacaggccuccuggucauuucagguguguuuccaguaaguauccccauuaccgccgcugcaugguacuugugggaggugaagaagcaaagagccggggucuuaugggauguuccuagcccacccccugugggaaaagcggaacuggaggacggcgcuuauaggaucaagcagcguggcauacucggguacucucagauuggagccgguguguauaaagaaggcacuuuccacacaauguggcaugucacccgcggggcagugcugaugcaccggggaaagagaaucgagccguccugggccgauguuaaaaaggaccuuaucucauacggcgguggguggaagcuggagggagaauggaaagagggcgaagagguacagguguuggcucuagaaccaggcaagaaucccagggccguccaaacgaaaccugggcuguuuaagacuaacaccggaacaauuggugcagugagucucgauuucagcccaggcaccuccgggucucccaucguugaccgaaaaggaaagguggucggccuguacgguaauggggugguaacacggucgggagcuuaugucagcgccauagcgcagacugagaagucaauugaggauaacccugaaaucgaggacgauauuuuucgcaaaaagagacuuaccaucauggacuuacauccgggcgccggcaaaacgaagagguaccugcccgcaauagugcgggaagcuauuaaacgagggcucagaacauugauccuggccccaacucgcguuguggcugcagagauggaagaggcccucaggggacugccuauccguuaucagacccccgccauucgggcugagcacacagguagagaaaucgucgaccuuaugugucaugcgaccuucacuaugaggcuguuguccccagugcgcguuccuaacuacaaucuaauuauaauggaugaggcacacuucaccgaccccgccaguaucgcugcccgaggcuauauuucuacaagaguggaaaugggggaggcagccggaaucuuuaugacggcuacuccaccgggcagccgggauccuuucccccaguccaacgcgccaaucauggacgaggaaagggagauucccgaacgcucauggaauucuggucacgagugggucaccgauuuuaaggggaagacagugugguucguaccuagcauaaaagccggaaacgacaucgcagcuugccugcguaagaauggcaaaaaggugauucaacucaguagaaaaaccuuugauuccgaauacguuaagacucgggccaacgacugggauuucgucgugacaaccgacaucagcgagaugggcgcaaauuuuaaggccgagagggugauugauccacgccgauguaugaaacccgucaucuuaacggacggggaagagagaguaauacuggcuggaccuaugccggugacucauucuucagccgcgcagcggaggggucgcaucggcagaaacccaaagaaugaaaacgaccaguauauuuacaugggggagccccuugaaaaugaugaggacugcgcacacuggaaagaggccaagaugcugcucgauaacaucaauacaccugaaggaauuauccccuccauguucgagccagaaagggagaaaguugacgcuauagauggcgaauaccgguugcguggugaggcccgcaagaccuuuguggaccugaugcgaagaggggaucucccugucuggcuggcuuauaggguggcagccgagggcauuaacuacgcugaccggcgcugguguuucgauggaaucaaaaauaaccaaauucuugaagagaacguugaaguggagaucuggaccaaggagggcgaaagaaagaaacuaaagcccagguggcuggacgcccggauauauagugauccauuggcauuaaaagaguuuaaggaauucgcggccgggcgaaaaagccugacucucaaucugaucacagagaugggaagacuuccuaccuucaugacacagaaggcucgcgacgcccuggauaaccucgcagucuugcauacugcugaagccgguggcagggcauacaaucacgcccugucggagcuaccggagacgcuggaaacccuccuucuguuaacauugcuggcuacugugaccgggggaauuuuucucuuccugaugucuggcaaggguguagggaaaaugacacuuggcaugugcugcaucauuaccgcguccauccugcucugguaugcccagauacagccccacuggauugcagcuagcaucaucuuggaguuuuuccugauuguguuacuaaucccagaaccugagaagcaacggacuccccaggacaaccagcugacguacguugucauagccauucucaccgugguggccgcaacaauggcuaaugaaaugggauuucuugagaaaacuaagaaagaccugggcuuggggucaaucaccacacaggagagugaaucuaacauucuggauaucgaccuccguccagccuccgcguggacccuguaugcugucgccacuacauucuuuacgccuaugcuuagacauagcauagagaauucaaguguuaacgugagccucaccgcaaucgccaaucaagcuacuguacugaugggauuggguaagggcuggccccuguccaagauggauauuggggugccguuacuagcaaucggauguuacucucaggucaacccaauuacacugaccgccgcgcuccuucuguugguggcucacuacgccaucauuggcccuggucugcaggcaaaagccaccagggaagcucagaagcgcgccgcagcugggaucaugaaaaaucccacaguugacggcauaacugugauugaucucgagccaauccccuaugacccuaaguucgaaaaacaacugggacaggucaugcuuuuaauccugugcguaacgcaggugcucaugaugcggaccacaugggccuugugugaggcgcugacucuagccaccggcccgauuagcacacugugggaggggaaccccggacgauuuuggaauaccacuauagcaguuuccauggcuaacaucuucagaggcucauaccucgccggugcagggcuucuguuuucuauuaugaagaauacgacaaacaccaggcgcggaacuggcaauaucggugaaaccuugggcgagaaguggaaaagucggcugaacgcucucgggaagucggaauuccagauuuauaaaaagagcggaauccaagagguggauagaacacuggccaaagagggcauaaagcguggggaaacugaccaucacgccgucuccaggggaucugcgaaauuacggugguuuguggagcgcaacauggucaccccagaaggcaaggugguugaucuugguugcgggcgaggaggcuggucauacuauugugguggccugaagaaugugagagagguaaaagggcucacaaagggaggcccugggcaugaagagcccaucccuaugagcacguacggauggaaccuagugaggcugcaguccggcgucgacguuuucuucaccccacccgagaaaugcgauacuuugcugugugacauuggugaaaguucuccuaauccaacaaucgaggcugggcggacccuccgcgugcuuaaccuggucgaaaauugguugaacaauaacacucaguuuugcauuaaggugcugaaucccuauaugccgagcguaaucgagaaaauggaaacacuccaaagaaaguacggaggcgcauuagugaggaacccucugucacgaaauuccacccacgagauguacuggguuaguaacgccacgggcaauauagugagcucugucaacaugauuucccggaugcuuaucaaucguuucaccaugaagcacaaaaaggcuacauaugagccagauguggaccuggggucaggaacuagaaacaucgguauugaaagcgagauacccaaccuagacaucauuggcaaacgcaucgaaaagauuaaacaggagcaugaaaccucguggcacuacgaucaggaccauccuuauaagacaugggccuaccacgggucuuaugagacuaagcagaccggaagugcauccagcauggucaauggcgugguuaggcuccugacaaaaccaugggauguagugcccauggucacccaaauggccaugacugacacgacaccguuuggucagcagcggguguucaaggagaaaguugauaccagaacucaggaaccuaaggaggggaccaaaaaguugaugaagaucacagcugaauggcuguggaaagagcucggaaagaaaaagauaccccgcauguguacgagggaggaauuuacccgaaaagugcggucaaacgcggcccuuggcgcaaucuucacugacgagaauaaguggaaauccgcuagagaagccgucgaggauucuagguuuugggaacugguggaccgcgagcguaacuuacaccuggagggcaagugcgaaacauguguauacaauaugauggggaagcgggagaaaaaguugggagaauucgguaaagcaaagggcagcagagccauuugguauauguggcucggggcuagguuucuggaguucgaagcccuaggauuucuuaacgaggaucauugguucagucgcggcaauucccugagcgguguggagggggaaggacuccaccgacugggcuacaucuugcgggacguuucuaaaaaggagggcggggcgauguacgcagaugacaccgccggaugggacacuagaauuacacuggaagaucucaagaacgaggaaauggucaccaaucauaugaaaggugagcacaagaaacuugcugaggccaucuuuaagcugacauaucaaaacaaaguggugaggguccagcgcccaacuccuagaggcaccguuauggacauuauaucacggagggaucagcgugggaguggacaggugggcacguacgguuuaaauaccuucacaaacauggaagcacaacugauccgacagauggagggggaaggaauuuucaaguccauccagcauuugacuguaaccgaggagaucgcugugcaaaauuggcucgcccgcgucggcagagaacggcugagcaggauggcuauuucuggcgacgauugcgugguuaagccccuagacgaucgcuuugccucggcacuuacagcgcugaacgacauggggaaagugagaaaggauauacagcagugggagccaucacggggauggaaugacuggacucagguccccuucugcagccaccacuuucaugaacucgugaugaaagaugguaggguacugguugugccuugucgaaaccaagacgaguugaucggccgugccagaauuucccagggggcuggauggaguuuaaaggaaaccgccugccugggcaaaucuuaugcacagauguggacgcucauguacuuccaccgccgggaucuuaggcuggcugccaacgcaaucuguagcgccgucccaucccauugggugccgacaucaagaaccacuuggaguauucacgcgaagcacgaguggaugacaaccgaggacaugcuagcuguguggaaucgcgucuggauccaggaaaaccccuggauggaggacaagacuccuguugaaucuugggaggaagugccauaucuggguaaacgggaggaucaauggugcgggagccucauaggauugaccuccagggccacaugggcaaagaauauccagacggccauuaaccagguacgaucacugaucggcaaugaggaauacaccgacuauaugcccagcaugaaaagauuucggagggaggaagaggaagcuggcgugcuuugguga

SEQ ID NO: 14764 - RNA, 9876 nt, Artificial Sequence
  derived and/or modified CDS sequence (opt3) from DENV-2__FJ898450__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuuaucugcaagcauucuaugguggauagaggcugggguaacggguguggacuauucggcaagggcgggauugucaccugcgccauguuuacaugcaaaaagaauauggaaggaaaaguggugcucccugagaaccuggaauacaccauagucaucacuccacacagcggugaggagcaugcuguuggcaaugacacggggaagcacggaaaagaaauuaagaucacaccgcaguccucaauaaccgaggccgaacuuacuggcuaugguaccgugacaauggaguguagucccaggaccgggcuggauuucaacgaaaugguauugcuccagauggaggacaaagcauggcuggugcaccggcaaugguuuuuagaucugccucucccauggcuucccggcgcugacacucagggaagcaauuggauucagaaggagacacuggucacguucaagaacccucaugccaaaaagcaggacgugguuguguugggcucucaagaaggggcgaugcacaccgcccuaacuggagcaacagagauccagauguccucagguaaucugcucuuuaccggccaucugaaaugccgucuucgcauggauaagcugcaguugaaagggaugagcuacaguauguguacaggaaaguucaagaucgucaaagaaauugcugagacucaacacggcaccaucgugauuagaguacaguaugagggugacgggucuccaugcaagauacccuucgaaaucauggaucucgagaaaaggcauguucugggccgguuaauuacggugaacccgaucgucaccgaaaaggacuccccugugaacaucgaggccgaacccccauuuggagauagcuacauuauaaucggcgucgagccugggcagcugaaacuaaauugguucaagaagggaucgucuauuggucagauguuugagacaacuaugcgaggcgcuaaacgcauggccauccucggggacaccgcaugggauuucggaucccugggcgguguguuuacaucaauugggaaggcccuucaccaaguuuucggcgcuaucuacggagcggcauuuaguggcgugagcuggacuaugaaaauauugaucgggguaauuaucaccuggauuggaaugaacuccagaucuacgagccugucagucagucucgugcugguuggcguggucacacuuuaucugggugccauggugcaggcugacuccggguguguagugagcuggaagaauaaagaauugaagugcggaucuggcaucuucauaaccgauaacguucacacuuggacagagcaguacaaguuucagcccgaaucaccaaguaaacucgccagcgcaauucaaaaggcccaugaggaagguaucuguggcauuagguccgucacccggcuggagaauuuaauguggaaacagaucacucccgagcugaaccacauacuaucugaaaaugaggugaagcucaccaucaugacaggggacauuaaaggaaucaugcaggcuggcaagcgcucgcugagaccucagccaacggaacuuaaauauagcuggaagaccugggggaaggccaaaauguuguccacugagucacauaaccaaacauuccugauugauggaccggaaaccgcagagugccccaauacaaacagggcguggaauagucucgagguggaagacuacggcuuuggugucuucacuaccaacaucuggcugaaguuacgugagaaacaggacgcuuuuugugauucuaagcugaugagcgccgcaauaaaagacaaucgggccguucacgcugauaugggguauuggauugaauccgcccuuaacgacacguggaagauggagaaggcaucauucaucgaggugaaaagcugccacuggccuaagucucauacauugugguccaauggagugcucgaaagugagaugaucauuccaaaaaacuucgcuggccccguaagccagcacaacuaccgaccugguuaucauacccagacugccggcccauggcaccuggggaagcuagaaauggauuuugacuucugugagggaaccacagucgugguuacugaagauugcggcaauagagggcccucucugaggaccacaacggcguccggaaaacucaucaccgaguggugcugucgcucaugcacucugccgccucuucgguacagaggcgaggacgguuguugguacgggauggaaauuaggccauugaaggagaaggaagagaaccuggugaauaguuuagucacagccggacauggccaaauagauaacuuuagccucggugugcugggcauggcucuuuuccuggaagagauguugcgcacccgaguugggacuaaacacgcaauccuccugguggccguaucguuugucacacuaauuaccggaaauauguccuuccgggaccugggccgugugauggugauggucggggcuacgaugacugaugacaucggaaugggcguuaccuaucucgcccugcuugcagcguuuaaggugagacccacauucgccgcugguuugcuguuaaggaaacucaccucuaaggagcugaugauggccacuauugggaucgcacuucugagccagucaacaauaccugaaaccauccuagagcucacagaugcucuggccuugggaaugaugguacugaaaauugugcgcaacauggaaaaguaccaguuagcagucacuaucauggccauuaguugcgugcccaaugcuguuauccuccaaaacgcguggaagguguccuguaccauacuggccgcagucucugugagcccacuucuguugacguccucacagcagaaagcugacuggauuccucucgcccugacaaucaagggccuaaaucccaccgccaucuuucugacuacccuuagccggacaaguaaaaagagaucuuggccacucaacgaggcuguuauggcagugggcauggucuccauucuggccagcucguugcugaaaaaugacauaccgaugacugggccuuuaguagcgggaggucuccugaccgugugcuauguucuuacgggcaggucagcugaucuggaauuggagcgagccgcagacgugaagugggaggaucaggccgaaaucucugggaguucccccauucucagcaucacaauuucugaggacggaagcauguccaucaaaaacgaagaggaggaacaaacccugacuauacuaauccgcacaggccugcuugucauuucagguguguucccaguaaguauccccauuaccgcugcagccugguaccucugggaggugaagaagcagcgggcggggguccugugggauguuccuagcccacccccugugggaaaagcugaauuggaggacggcgccuauagaaucaagcagaggggcauauuaggguacucucagauuggagcagguguguauaaagaaggcacuuuucacacaauguggcaugucacccguggggccgugcugaugcaccgcggaaagcggaucgagccguccugggcugauguuaaaaaggaccucaucucauacggcgguggguggaagcuggagggagaauggaaagagggcgaagagguacaagugcuugcccuggaaccaggcaagaaucccagagcaguccagacgaaaccuggguuguucaagacuaacaccggaacaauuggugcugugagucuagauuuuagcccaggcaccuccgggucucccaucguugacaggaaaggaaagguggucggccuguacgguaauggggugguaacacgaucgggagccuaugucagcgcgauagcccagacugagaagucaauugaggauaacccugaaaucgaggacgauauuuuccggaaaaagcgccucaccaucauggaccugcauccgggcgcaggcaaaacgaagagauaccuucccgcuauagugagggaagccauuaaacggggguuacgaacacugauccucgcuccaacuagaguuguggcagccgagauggaagaggccuugcgcggacugccuaucagguaucagacccccgcuauucgugcggagcacacaggucgggaaaucgucgaccucaugugucaugcaaccuucacuaugagacugcuuuccccagugaggguuccuaacuacaaucugauuauaauggaugaggcccacuuuaccgaccccgcuaguaucgccgcacgcggcuauauuucuacacgaguggaaaugggggaggccgcuggaaucuucaugacggcgacuccaccgggcagcagagauccuuuuccccaauccaacgccccaaucauggacgaggaacgggagauucccgaaaggucauggaauucuggucacgagugggucaccgauuucaaggggaagacagugugguuuguaccuagcauaaaagcaggaaacgacaucgcugccugcuugcgcaagaauggcaaaaaggugauucagcuaagucguaaaaccuucgauuccgaauacguuaagacuagagcaaacgacugggauuuugucgugacaaccgacaucagcgagaugggcgccaauuuccgggcugagagggugauugauccacgccgauguaugaagcccgucauccugacggacggggaagagagaguaauacucgccggaccuaugccggugacucauucuucagcggcacagcggaggggucgcaucggcagaaacccaaaaaaugaaaacgaccaauauauuuacaugggggagcccuuagaaaaugaugaggacugcgcccacuggaaggaggcuaaaaugcugcuugauaacaucaauacaccugaaggaauuauccccuccauguuugagccagaaagggagaagguugacgccauagauggcgaauaccggcugcguggugaggcucgcaaaaccuucguggaccucaugcgaagaggggauuugccugucuggcuggcauauaggguggccgcugagggcauuaacuacgccgaccggcgcugguguuuugauggaaucaagaauaaccagauucucgaagagaacguugaaguggagaucuggaccaaagagggcgaaagaaagaagcugaaacccagguggcuugacgcacggauauauagugauccacuagcgcugaaggaguucaaagaauucgccgcugggcgaaagagcuugacuuuaaaucugaucacagagaugggaagacucccuaccuuuaugacacagaaagcccgcgacgcacuggauaaccuugcuguccugcauacugccgaagcagguggcagggccuacaaucacgcucucucggaguugccggagacgcuggaaacccuacugcuccuuacacuguuagcgacugugaccgggggaauuuucuuguuucugaugucuggcaaggguaucgggaagaugacacucggcaugugcugcauuaucaccgccuccauacugcuuugguaugcacagauucaaccccacuggaucgcugccagcaucauucuggaguucuuucucaucguauugcugauaccagaaccugagaaacagcggacuccccaggacaaccaguuaacguacgugguuauugccauccuaaccgucguggcagcuacaauggccaaugaaaugggauuccuggagaagacuaaaaaggaccucggccuugggucaauuaccacacaagagagugaaucuaacauccuggauauagacuugcguccagcguccgcuuggacccuguaugccguggcaacuacauuugucacgccuaugcucagacauagcaucgagaauucaaguguuaacgugagccugaccgccauugcuaaucaggcaacuguacuuaugggacucgguaaaggcuggccccuguccaagauggauaucggggugccguugcuggccauuggauguuacucucaggucaacccaaucacauuaaccgcggcucuacugcuccuuguggcccacuacgcaauuaucggcccuggucugcaggccaaggcuaccagggaagcccaaaaacgcgcagcugccgggauaaugaagaaucccacaguugacggcauuacugugaucgauuuggagccaauccccuaugacccuaaauucgaaaagcagcugggacaggucaugcuccugauucuuugcguaacgcagguguuaaugaugcggaccacaugggcgcugugugaggcccucacuuuggcaaccggcccgauaagcacacugugggaggggaaccccggacgauuuuggaauaccacuaucgcuguuuccauggccaacauuuucagaggcucauaccuagcaggugcugggcugcucuuuucuaucaugaaaaauacgacaaacaccaggcgcggaacuggcaauauuggugaaacccuuggcgagaaguggaagagucggcugaacgccuuggggaaaucggaauuccaaaucuauaagaaaagcggaauacaggagguggauagaacacuggccaaggagggcaucaaacguggggaaacugaccaucacgcggucuccaggggaucugcuaagcuccggugguuuguggagcgcaacauggucaccccagaaggcaaagugguugaucuggguugcgggcgaggaggcuggucauacuauugugguggcuuaaagaaugugagagagguaaaggggcuuacaaaaggaggcccugggcaugaagagcccauuccuaugagcacguacggauggaaccuggugaggcuccaguccggcgucgacguuuucuucaccccacccgagaagugcgauacucuacugugugacaucggugaaaguucuccuaauccaacaauugaggcagggcggaccuugcgcgugcugaaccucgucgaaaauuggcuuaacaauaacacucaauuuugcaucaaagugcugaaucccuauaugccgagcguaauagagaagauggaaacauugcagagaaaauacggaggcgcccuggugaggaacccucucucacgaaauuccacccacgagauguacuggguuaguaacgcuacgggcaauauugugagcucugucaacaugaucucccggauguuaaucaaucguuucaccaugaagcacaagaaagccacauaugagccagauguggaccuggggucaggaacuagaaacauugguauagaaagcgagauccccaaccuugacauuaucggcaagcgcauugaaaaaaucaagcaggagcaugaaaccucguggcacuacgaucaggaccauccuuauaggacaugggcauaccacgggucuuaugagacuaaacaaaccggaagugccuccagcauggucaauggcgugguucggcugcuaacaaagccaugggauguagugcccauggucacccagauggcuaugacugacacgacaccguuuggucagcagagaguguucaaggagaaaguugauacccgcacucaagaaccuaaggaggggaccaaaaagcucaugaggauaacagcggaauggcuguggaaagaguugggaaagaagaaaacgccccgaauguguacccgggaggaauuuacuagaaaggugaggucaaacgccgcacugggcgcuaucuucacagacgagaauaaauggaaguccgcccgcgaagcagucgaggauucucguuuuugggaacucguggaccgggagagaaaccuucaccuggagggcaaaugcgaaaccuguguauacaauaugauggggaagagggagaaaaaguuaggagaauucgguaaggccaaaggcagccgcgcuauuugguauauguggcugggggcccgauuuuuggaguucgaagcgcucggauuucugaacgaggaucauugguucagucggggcaauucccuaagcgguguggagggggaaggacuucacagacugggcuacauccucagggacguuucuaagaaagagggcggggcaauguacgccgaugacacugcuggaugggacacacgcauuacccuggaagauuugaagaacgaggaaauggucacaaaucauaugaaaggugagcacaagaagcuggccgaggcaaucuuuaaacucacuuaucagaacaagguggugagaguccagcggccaaccccuaggggcacgguuauggacauuauaucacgucgagaucagcgcgggaguggacaagugggcaccuacggucuuaauacauucacuaacauggaagcucagcugaucagacagauggagggggaaggaauuuucaaauccauccaacauuuaaccguaacagaggagaucgccgugcagaauuggcuggcucgggucggcagggaacgcuugagcagaauggccauuucuggcgacgauugcgugguuaagccccucgacgaucgguuugcaucggcgcugacugcccuaaacgacauggggaaagugaggaaggauauacagcagugggagccaucacgaggauggaaugacuggacccaaguccccuucugcagccaccacuuucaugaacuugugaugaaggauggucguguacugguugugccuuguagaaaccaggacgagcucaucggccgcgcucggauuucccagggggccggauggagucugaaagaaacggcaugcuugggcaagucuuaugcucagauguggacauuaauguacuuccacaggagagaucugcgccucgccgcaaacgccaucuguagcgcggucccaucccauugggugccgaccucacggacuacauggaguauucacgcuaaacacgaguggaugaccacugaggacaugcuugccguguggaauagggucuggauccaagaaaaccccuggauggaggacaagaccccuguugaaucuugggaggaagugccauaucuggguaaacgagaggaucaguggugcgggagccuaauaggacugacauccagagcaacgugggccaagaauauccagaccgcuauuaaccagguacggucacucaucggcaaugaggaauacacugacuauaugcccagcaugaagagguuucgccgugaggaagaggaagccggcguguugugguga

SEQ ID NO: 14765 - RNA, 9876 nt, Artificial Sequence
  derived and/or modified CDS sequence (opt3) from DENV-2__FJ898453__SS-prME
accgccggcgugaucgucaugcugauucccacagcuauggcauuccaccucacuacgagaaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccacuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagagcaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaagcuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucucuacgaacauuuggcucaagcugcgugagcggcaggacguuuuuugugauagcaaauuaauguccgcugccaucaaggacaaucgagcagugcacgccgauaugggguauuggauagaaucagcucugaacgacacauggaaaauggagaaggccagcuucauugaggugaagucuugccacuggccuaaaucccauacccuuuggaguaauggaguauuggaaagcgagaugaucaucccaaagaacuucgcaggccccgucucucagcacaacuacagaccugguuaucauacucaaaccgcuggcccauggcaccucgggaaacuggaaauggauuuugacuucugugagggaacaacugugguugugaccgaagauugcggcaauagggggcccucccuacgcacaacgaccgccucaggaaagcugauuacugaguggugcugucggaguugcacacucccgccucugagauacaggggcgaggacgguuguugguacgggauggaaauccgcccacuuaaagagaaggaagagaacuuggucaauagccuggugaccgcgggacauggccagauugauaacuuuucguuagguguucucggcauggcccuguuccuugaagagaugcugcgaacucggguggggacaaagcacgcuauauugcucguagcacuguccuuugucacccuaaucacgggaaauaugucuuuccgugaccugggcagagugauggugauggucggggccacuaugaccgaugacauuggaaugggcguuacauaucucgcucugcuugccgcauuuaaagugaggcccaccuucgcggccgguuugcuguuacgcaagcucacuagcaaagagcugaugauggcuacaaucgggauugcccuucugucacagaguacccuaccugaaacaauccucgagcugacugaugcauuggcucugggaaugaugguauuaaagauagugcggaacauggaaaaauaccaacucgccgucaccaucauggcaauuuccugcgugcccaaugccguuauccugcagaacgcuuggaaggugucuuguacgauucuugcggccgucagcguguccccacuguugcucacaucaagccagcagaaggcagacuggaucccucuggcucuaaccauaaaaggccugaaucccacugccauuuuucuuaccacacucaguagaacuucuaagaaaagguccuggccacugaacgaggccaucauggcuguuggcauggugagcaucuuggcaucgucacuguuaaagaaugacauuccgaugaccgggccucucgucgccggaggucugcuuacgguaugcuaugugcugacaggccgaucugcggauuuggaacucgagcgcgcugccgacguuaaaugggaggaucaagcagaaauaaguggguccagccccauccugucuauuaccaucagcgaggacggauccaugucaauuaagaacgaagaggaggaacagacucuaacaauccugauacggaccggccuucucgugaucaguggugucuucccagugagcauucccaucacugccgcugcaugguaccugugggagguaaaaaagcagagagccgggguguugugggaugucccuucuccacccccuguuggaaaggcggaauuagaggacggcguguauaggauuaaacagcguggcauccugggguacucccaaauaggagcugguguguauaaggaaggcacauuucacaccauguggcaugucacgcgcggggccgugcucaugcaccggggaaaaagaauugagccgucaugggcagauguuaagaaagaccugaucaguuacggcgguggguggaagcuugagggagaauggaaggagggcgaagagguacaggugcuggccuuggaaccaggcaaaaaucccagggcuguccagacuaagccugggaucuucaaaaccaacacaggaaccauuggugccgugagccuagauuuuuccccaggcacaucugggucgcccaucguugaccgaaagggaaaaguggucggccuguacgguaauggggugguaacucggagcggagcauaugucucagcuauagcccagaccgagaaguccauugaggauaacccugaaaucgaggacgauauuuuccgcaagaaaagacucacgaucauggaccugcauccgggcgcgggcaagacaaaaagguaccuucccgccauagugcgggaagcaauuaagcgaggguuaagaacucugauccucgcuccaacccgcguuguggccgcugagauggaagaggcauugaggggacugccuauccguuaucaaacacccgccauucgggccgagcacaccgguagagaaaucgucgaccucaugugucaugcuacuuucaccaugaggcugcuuaguccagugcgcguuccuaacuacaaucugauuauaauggaugaggcgcacuuuacagaccccgcaucuaucgccgcucgaggcuauauuagcacgagaguggaaaugggggaggccgcaggaaucuucaugacugccaccccaccgggcucccgggauccuuuuccccagucaaacgcuccaaucauggacgaggaaagggagauucccgaacgcucuuggaauagcggucacgagugggucacagauuucaaagggaagaccgugugguuuguaccuaguauaaaggcgggaaacgacaucgccgcaugcuugcguaaaaauggcaagaaagugauucagcuauccagaaagacuuucgauagcgaauacguuaaaacacgggcuaacgacugggauuuugucgugaccacggacaucucugagaugggcgccaauuucaaggcagagagggugauugauccacgccgauguaugaagcccgucauccugacugacggggaagagagaguaauacucgccggaccuaugccggugacacauucauccgcugcccaacggaggggucgcaucggcagaaacccaaaaaaugaaaacgaccaguauauuuacaugggggagcccuuagaaaaugaugaggacugcgcgcacuggaaggaggcaaaaaugcugcuugauaacaucaauaccccugaaggaauuauccccaguauguuugagccagaaagggagaagguugacgccauagauggcgaauaccggcugcguggugaggcucgcaaaaccuucguggaccucaugcgaagaggggauuugccugucuggcuggccuauaagguggcugcagagggcauuaacuacgccgacaggaaaugguguuuugauggaaucaagaauaaccagauucucgaagagaacguugaaguggagaucuggacuaaggagggcgaacggaaaaagcugaaaccccgcuggcuugacgcuagaauauauagcgauccacuagcccugaaggaguucaaagaauucgcagcggggaggaagucguugacauuaaaucugaucaccgagaugggacggcucccuacauuuaugacucagaaggcccgaaacgcucuggacaaucuugccguccugcauacggcagaaguggguggcagagcuuacaaccacgcccucucugaguugccggagacccuggaaacacuacugcuccuuacucuguuagcaaccguaacagggggaauuuucuuguuucugauguccggcaaagguaucgggaagaugacccucggcaugugcugcauuaucacugccagcauacugcuuugguaugcucaaauucagccccacuggaucgcggccucaaucauucuggaguucuuucucaucguguugcugauaccagaaccugagaaacagcgcacgccccaggauaaucaauuaaccuacguugucauugcaauccuaacagugguggcugccacuauggccaacgaaaugggauuccuggagaagaccaaaaaggaccucggcuuugggaguauuacaacccaggagucugaauccaauauccuugacauagaucugaggccagcaagcgcuuggacuuuguaugccgucgcgacaacguucguuaccccuaugcugcggcauucaaucgagaacaguagcgugaauguaucccucacugcuauugccaaccaggcaacagugcugaugggacuugguaagggcuggccccucucuaaaauggacaucggggucccgcuguuggccauuggauguuacagccaggugaauccaaucacccugaccgcugcauuacuacugcucguugcccacuacgcgauuaucggcccuggucuucaagcuaaggccacacgugaagcacagaaaagagccgcugccgggauaaugaagaaccccacuguggauggcauuacggucaucgaccuggagccaauccccuaugauccuaaauuugaaaagcaguugggacagguaaugcugcucauucugugcgugacccaaguucuuaugaugaggacaacuugggcauuaugugaggcucugacccucgccacaggcccgauauccaccuugugggaggggaaucccggacgcuucuggaacacuacgaucgcggugucaauggccaauauuuuucggggcucuuaccuggcaggugcugggcuacuguucaguaucaugaagaacacaaccaauacucgaagaggaaccggcaacgucggugaaacacucggcgagaaauggaagucgaggcuuaacgcccuggggaaaagcgaauuucagauuuauaagaaauccggaauccaggagguggaccgcacuuuggcaaaggagggcauaaaacggggggaaaccgaucaucacgcugucucuagaggaucagccaagcugcguugguucguggagaggaauaugguugccccagaaggcaaggugguagaccucgguugcgggcggggaggcuggagcuacuauugugguggccugaaaaacgugcgcgaggucaagggguuaacaaaaggaggcccugggcaugaagagcccaucccuauguccacguacggauggaaucuuguucgacugcaaaguggcguggaugucuucuuuaccccacccgagaagugcgacacucuccuaugugauauuggugaaucuagcccuaacccaacaaucgaggcggggagaacccugaggguguugaaucugguagaaaacuggcucaauaacaauacucaguucugcauuaaagugcuuaaccccuauaugccgucaguuaucgagaagauggaaacacugcagcggaaguacggaggcgcuuuggugcgcaauccucuguccagaaacaguacccacgagauguacugggucagcaaugcaacgggcaacauagugucuuccgucaauaugauuucaaggaugcucaucaaccgauuuaccaugaaacacaagaaagccacauaugagccagacguggauuuagggagcggaacucggaacaucgguauugaaucggagauacccaaucuggacaucauuggcaagcguaucgaaaaaauuaagcaggagcaugaaaccucuuggcacuacgaccaagaucauccuuauaagacaugggcuuaccacgggaguuaugagacuaaacagaccggauccgccagcucaaugguuaacggcguagugagacuucugacaaagccaugggacgucgugcccaugguuacccagauggcaaugacugauacgacaccguucggucagcaacgcguguuuaaagagaaggucgacaccaggacucaggaaccuaaagaggggaccaagaagcuaaugaaaaucacagccgaauggcucuggaaggagcugggaaaagagaagacgccccggauguguaccagagaagaguucacucgcaaagugagguccaaugcugcguugggcgccauauuuacagaugaaaacaaguggaaaucugcacgagaggcuguagaagacggccgguucugggagcugguggauagagagaggaaucuccaccuugaagggaagugcgagaccuguguuuacaacaugaugggaaagcgcgaaaaaaagcugggugaguuuggcaaagccaaggggagccgugcaaucugguauaugugguuaggagcccgguuccuggaauuugaggcuuugggcuuccucaaugaggaccauugguuuaguagagguaacucccugagcggggucgaaggagagggccuacacaggcuuggcuacauucugcgcgaaguggggaaaaaggagggaggugccauguacgcggaugacacugcaggcugggauacacgaaucacccucgaagaccugaagaaugaggagauggugacaaaccauaugaaaggggaacacaagaaauuggccgaggcuauuuucaagcugacuuaucagaauaaagucguucgggugcagagaccaaccccuaggggaacgguaauggacaucauuucucgcaaggaucaaagaggcucaggucagguggggaccuacggacucaacacauucacuaauauggaagcccagcuuauacggcaaauggagggcgagggcaucuuuaagaguauucagcaucugaccgucacagaagagaucgcagugcagaacugguuagcuaggguugggcgugaacgacugucccgcauggccaucagcggagacgauugcguggucaaacccauugacgauagauucgcuucugccuugacugcacucaaugacauggguaaggugcggaaagauauacagcaaugggagccaucgaggggcuggaacgacuggacccagguacccuuuugcucacaccacuuccaugaacugguuaugaaggaugggcgcgugcuagucgugccuuguagaaaccaggacgagcuuaucggacgggcgaggauuagccagggcgccgguuggucccugaaagagacggcuugccucgggaagaguuaugcccaaauguggacacugauguacuuucaccgacgugauuugagauuagcagcuaaugccaucuguucugcagugccaagccauugggucccgaccucccgcacuacauggucaauucacgccaagcacgaauggaugaccacugaggacaugcuggcgguuuggaaccggguguggauccaggaaaaucccuggauggaggauaaaaccccuguagaaaguugggaggaggugccauaucucggaaagagggaagaccaguggugcggcucucuuauaggccugacaagcagagcuacgugggccaaaaacauccagaccgcaauuaaucaaguccgcucccuaaucgggaacgaggaauacacugacuauaugcccucaaugaagcgguucaggcgagaggaagaggaggccggagugcugugguga

SEQ ID NO: 14766 - RNA, 9876 nt, Artificial Sequence
  derived and/or modified CDS sequence (opt3) from DENV-2__EU482445__SS-prME
agcgccggcaugauaauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggacccuuaaaaucuugauuggcguuaucauaacauggaucgggaugaacucucgcagcacuucacugagugugucccucguccuggugggaauuguaacccuuuaccugggcgugaugguucaggcagauagcgguugugucgugucuuggaagaauaaggaguugaaaugcgggucaggaaucuucauuacggacaacgugcacacauggaccgaacaguauaaguuucaacccgagaguccaagcaaacucgccuccgcuauccagaaggcccaggaagagggcauaugugguauuagaucugucacuaggcuggagaauuuaauguggaaacagaucacacccgaacugaaccacauucuagcagagaaugaaguuaagcucaccaucaugacuggcgauauaaaagggaucaugcaagccggaaagcggucgcugcgcccucagccaaccgagcuuaaguacagcuggaaaacauggggcaaggcuaaaauguuguccacggaaucauauaaccagaccuuccugauugacgggccggagacuacagagugccccaauaccaacagagccuggaauagucucgaaguggaggauuacggauuuggcguguucacaacuaacaucuggcugaaguuaaaagaaaagcaggacgcauuuugugacucuaagcugaugagcgcggcuauuaaagauaauagggccguacaugcagacauggguuauuggaucgaguccgcccuuaacgauaccuggaagauagagaaggcuucauucauugaagucaagaauugccacuggccuaaaagccauacguuguggucuaacggggugcucgaguccgaaaugaucaucccaaagaaccuggccggacccguuagucaacacaauuaccguccuggcuaccacacacagauugcagguccauggcaucuaggcaagcuggagauggacuucgauuuuugugacgggaccacugugaucgucaccgaagauugcggaaaccggggccccagccuccgaacaacuaccgcuucugggaaacugauuacagaguggugcuguagauccugcacgcuuccgccuuugagguaucgcggagaggacggcuguugguacgguauggaaauacggccacugaaggagaaagaagagaauuuagugaacucacucguuaccgccgggcacggacagguggauaauuucagucugggcguacuugguauggcgcuguuuuuggaagagaugcucagaacuagggucggcacaaagcaugccauccugcuaguggcugugagcuucgucacccugauuacugggaacaugucguuuaaagaccucggacgcguugugguaauggugggcgcaacaauggccgaugacaucgggaugggagucaccuaucuggcucuuuuggccgcauucaaggugcgacccacguuugcggccggccuguuacuccggaagcugacuuccaaagagcuuaugaugaccacaauugguaucguucugcuaucucaaagcaccauaccugaaacugugcucgagcugacagaugcuuuggcccuggggaugauggucuuaaagaucgugcguaauauggaaaaauaccagcucgcaguuaccauuauggcuauccugugcgugcccaacgccgucauucuucagaaugcauggaagguaucauguacaauccuggccgugguuaguguguccccauugcuccugacuucuagccagcagaaaaccgacuggauaccucuagcucugacgauuaagggacuuaaccccacagcgaucuuccucaccacucuguccagaaccaauaaaaagaggucauggccauugaacgaggccaucauggcagucggcauggugagcauucuggcuaguucuuuacucaagaaugacauaccgaugacaggcccucugguagccgggggacuucugacugugugcuaugucuugaccggucgcuccgccgaucucgaacuggagcgggcuacggacguuaaaugggaggaucaggcagaaaucagcggcucgucacccauucuaucuaucacaauuagugaggacggguccaugagcaucaagaacgaagaggaggaacagacccugacuauacuuaucagaacaggacuccuggugauuucuggcuuguuuccaaucagcauucccaucaccgccgcggcuugguacuuaugggaggugaaaaagcagagggccgguguccugugggaugugccuuccccacccccuauggggaaagcagaacucgaggacggagccuaucgaauaaagcaaaagggcauucugggcuacucacagaucggggcuggaguuuacaaagaagguacuuuccacacaauguggcauguaacccgcggcgcagugcuuaugcacaaggggaaacggaucgagccgaguugggccgaugucaagaaagaccugauuagcuauggaggcgguuggaaguuggagggggaauggaaggagggagaagaggugcagguucuagcgcuggaaccaggcaaaaaucccagagcugugcagacgaagccuggccucuuuaaaacuaacaccgggacaaucggagccgucucucuggauuucuccccagguaccucaggcagucccauaauugacaagaaagggaaggugguaggacuuuacggcaacggugucgugacaaggagcggggcauauguuuccgccaucgcucaaacugagaagucuauugaggauaauccugaaaucgaggacgauauauuucguaaacgccgguuaaccauuauggaccugcacccgggagccggcaagacgaaaagauaccuccccgcaaucgugagggaagcuaucaagcgaggcuugcggacacugauucucgccccaacucgcgucguggcggccgagauggaagaggcacugagagggcuuccuaucagguaucagacccccgcuauucgggccgagcauacaggacgagaaauaguugaccugaugugucacgcuaccuucacuaugagauugcuaucgccagugcgcgucccuaacuacaaucugaucauuauggaugaggcacauuucaccgaccccgccagcaucgccgcuagggguuauaucucaacacguguggaaaugggcgaggcggcagggauuuuuaugacggccacuccaccgggaucccgggauccuuucccccagaguaacgcuccaauaaucgacgaggaaagagagauucccgaaaggucuuggaauaccggccacgaguggguaacagauuuuaaagguaagaccgugugguucguuccuagcaucaaggccgggaacgacauugcagccugccuccgcaaaaauggaaagaaagucauccaauuaucccgaaagacuuuugauucagaauacgugaaaacaagaaccaacgacugggauuucguggucacgacugacauaucugagaugggcgcuaauuuuaaggcggagcggguaaucgauccaaggcgcuguaugaaacccgugauucugacagacggcgaagaacguguuauccuugccgggccuaugccggugacccauagcagugcagcucagagacggggaaggauuggucgcaacccaaagaaugaaaacgaccaguacaucuauaugggcgagccccuggaaaaugaugaggacugcgcccacuggaaggaggcaaaaaugcucuuggauaacauaaauaccccugaagggauuauccccuccauguucgagccagaacgagagaaggucgacgccauugauggagaauacagacugcggggcgaggcuaggaaaacuuuuguggaccucaugcgcagaggugaucugccuguuuggcuugccuauaagguggcggcagaggggaucaacuacgccgacaggcggugguguuucgauggcaucaaaaacaaucagauccuagaagagaacgucgaaguggagauuuggacaaaggagggagaacguaagaaacugaagccccgcugguuggacgcucgaaucuauagcgauccauuagcccugaaagaguuuaaggaguucgcugcaggcagaaaaucucucacccugaaucuuauuacagagauggggaggcugccuacuuucaugacgcaaaagacccgggacgcccucgauaacuuggcuguacugcacacagccgaagcaggaggucgcgcguacaaucaugcccuaucagagcugccggagacucucgaaacccuucuguuauugacacugcucgcuaccgugacuggcgggaucuuucuguuccuuauguccggaagaggcauagguaagaugacgcuggggaugugcugcauuaucaccgccaguauccucuugugguaugcacagauucagccccacuggaucgcugccagcauaauucuggaguuuuucuuaaucguucuacugauuccagaaccugagaaacagaggacaccccaagacaaccagcucacuuacgucgugaucgcaauacuuaccguggucgccgcuacaauggcgaaugaaaugggcuuucuggagaagaccaaaaaggacuugggacugggcucgaucgccacucagcagccagagucuaacauucucgauaucgaccugcggccugcauccgcuuggacacuuuacgccguugccacgaccuucgugacucccaugcuccgacauagcauugaaaauucaaguguaaacgugucucugacagcaaucgcuaaucaagccaccgucuugauggggcugggaaaagguuggccguuauccaagauggauauuggcgugccacuacuggcgaucggguguuauagccagguuaacccuauaacccucacagcugcccuucuguugcugguggcacacuacgccauuaucggacccggccuccaggcuaaggcaacuagagaggcccagaaacgcgcggcugccgguaucaugaagaauccaacggucgacgggauuaccguaauagaucuggaccccaucccuuaugauccgaaauuugaaaagcaacuuggccaggugauguuacugauucucugcguuacacagguguugaugaugaggacuaccugggcacugugugaggcccuaacacuggcuaccggacccaucucaacucucugggaaggcaacccagggcgguucuggaauacgacaauugccgucaguauggcaaacaucuuucguggaagcuaccuugcuggcgccggucuguuguucuccauaaugaaaaauaccacuaacaccagaagggggacaggaaacaucggcgagacucugggugagaaguggaaaucucgccucaaugcgcugggcaagagcgaauuucaaauuuauaagaaauccgggauccaggagguggaccggaccuuagccaaggaaggaauuaaacgaggcgagacagaucaccaugcagucucaagagggucugcuaaacuuaggugguucguggagcgcaacaugguuacgccugaaggaaaagugguagaccugggcugcgguagagggggauggaguuacuauuguggcggucucaagaaugugagagaggucaagggccuaaccaaagggggacccggccacgaggaaccuaucccaaugucgacuuacggguggaaccugguucguuugcagagcggaguggaugucuuuuucauacccccugaaaagugcgacacacugcucugugauauuggcgaguccucuccaaaucccaccguggaggccgguaggacucuucggguacugaacuugguggaaaauuggcugaacaauaacacacaguucugcaucaaaguucucaauccguacaugccuucagugaucgagaagauggaagcauuacaacgcaaauaugggggagcucugguccgaaacccacuuagcagaaauuccacccaugagauguacugggugaguaacgccucuggcaauauugucagcucagugaacaugauauccaggaugcugaucaaccgguuuacgaugcgccacaagaaggccaccuaugaacccgacguugaccuaggcagugggacaagaaauauuggaaucgagagcgagauuccuaaccucgauaucauagguaaaaggaucgaaaagauuaaacaggagcaugaaacuucuuggcacuacgaccaggaucacccauauaagaccugggcguaccauggcuccuaugagacaaaacagacugggucagcuagcucgaugguaaauggagugguccgacuguugaccaagcccugggacgugcugccgacaguuacccaaauggcaaugacugauacgacaccuuucggccagcagcggguguuuaaggaaaaagucgacacccguacucaggagcccaaggaggguaccaaaaagcucaugaaaaucacagccgaauggcuuuggaaggagcuggggaaaaagaagacgccaagaauguguacccgcgaagaguucacuaggaaagugcggucuaacgcugccuuaggagcaauuuuuacagaugagaauaaguggaaaagugccagagaagcuguagaggacucccgcuucugggaacugguggauaaggagaggaacuugcaccucgaaggcaaaugcgagaccuguguuuacaauaugaugggcaagcgagagaagaaacugggggaauuuggaaaggcgaaagguagccgggccaucugguacauguggcuaggcgcaagauuccuugaguuugaagcucugggguuccucaacgaggaccauugguuuucaagggaaaauucccugucuggagucgagggcgaggguuugcacaagcugggguauauucuccgcgaugugagcaaaaaggaaggaggcgccauguacgcagacgacacugccggcugggauacacguauaacccuugaggaccugaagaacgaagagauggugacaaaucacauggaaggggagcauaaaaaguuagcugaggccaucuucaaacugacuuaucaaaacaaggucguucgggugcagagaccuacccccaggggaacgguaauggauauuaucagucgccgagaccagcgggguuccggccaaguggggaccuacggauugaauacauuuacuaacauggaagcgcagcucaucagacagauggagggcgaaggugucuucaaaaauauucagcaccugaccgugacagaggagguugcagugcaaaacuggcuagccagggucgggcgcgaaagacuuagccggauggcuauaucuggagaugacugcgugguaaagccacuggaugacagguucgccaacgcacucacugcucugaaugauaugggcaagauccguaaagacauucagcagugggagcccucaaagggcuggaacgauuggacccagguuccuuuuugcagucaucacuuccaugaauugaucaugaaagacgggcgaguguuagucgugccaugucgcaaucaagaugagcugauuggacgggcccggaucucccagggugcuggcuggagccucagggaaacggccugccuugggaagucuuaugcacagauguggucgcugauguacuuucaccgcagagaccuacggcuggcggccaacgcuauauguucagccgugccgagccacuggguccccacauccaggaccacuuggaguauccaugcaaaacacgaguggaugacaaccgaggacaugcucacuguuuggaaucgaguguggauucgugaaaacccuuggauggaggauaagaccccaguagaaucuugggaggaaauccccuauuugggaaagagagaggaccaguggugcggcagccugauuggucuuacaucccgcgcuacgugggccaaaaauauccaagcagccauaaaccaggugcggucacugauugggaaugaggaauacaccgauuacaugccuaguaugaagagguucagacgcgaggaagaggaagcgggaguccucugguga

SEQ ID NO: 14767 - RNA, 9876 nt, Artificial Sequence
  derived and/or modified CDS sequence (opt3) from DENV-2__EU482446__SS-prME
agcgccggcaugauaauuaugcugauacccaccgugauggcuuuccaccucacuacuagaaacggggagccucauaugaucgucgguauucaagaaaaaggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacuacagagugccccaauaccaacagagccuggaauagucuggaaguggaggauuacggauuuggcguguucacaacuaacaucuggcucaagcugaaagaaaagcaggacgcauuuugugacucuaaguuaaugagcgcggcuauuaaagauaauagggccguacaugcagacauggguuauuggaucgaguccgcccugaacgauaccuggaagauagagaaggcuucauucauugaagucaagaauugccacuggccuaaaagccauacgcuuuggucuaacgggguguuggaguccgaaaugaucaucccaaagaaccucgccggacccguuagucaacacaauuaccguccuggcuaccacacacagauugcagguccauggcaucugggcaagcuagagauggacuucgauuuuugugacgggaccacugugaucgucaccgaagauugcggaaaccggggccccagccugcgaacaacuaccgcuucugggaaacucauuacagaguggugcuguagauccugcacgcugccgccucuuagguaucgcggagaggacggcuguugguacgguauggaaauacggccauugaaggagaaagaagagaaucuggugaacucauuaguuaccgccgggcacggacagguggauaauuucagucucggcguacuggguauggcgcuuuuucuggaagagauguugagaacuagggucggcacaaagcaugccauccuccugguggcugugagcuucgucacccuaauuacugggaacaugucguuuaaagaccugggacgcguugugguaauggugggcgcaacaauggccgaugacaucgggaugggagucaccuaucucgcucugcuugccgcauucaaggugcgacccacguuugcggccggcuugcuguuacggaagcucacuuccaaagagcugaugaugaccacaauugguaucguucuucugucucaaagcaccauaccugaaacugugcuagagcucacagaugcucuggccuuggggaugaugguccugaagaucgugcguaauauggaaaaauaccaguuagcaguuaccauuauggcuauccucugcgugcccaacgccgucauucugcagaaugcauggaagguaucauguacaauccuugccgugguuaguguguccccacuguugcucacuucuagccagcagaaaaccgacuggauaccucuggcucuaacgauuaagggacugaaccccacagcgaucuuccuuaccacucucuccagaaccaauaaaaagaggucauggccacugaacgaggccaucauggcagucggcauggugagcauuuuggcuaguucucuguuaaagaaugacauaccgaugacaggcccucucguagccgggggacugcuuacugugugcuauguccugaccggucgcuccgccgauuuggaacucgagcgggcuacggacguuaaaugggaggaucaggcagaaaucagcggcucgucacccauucugucuaucacaauuagugaggacggguccaugagcaucaagaacgaagaggaggaacagacccuaacuauacugaucagaacaggacuucucgugauuucuggccuguuuccaaucagcauucccaucaccgccgcggcuugguacuugugggaggugaaaaagcagagggccggugucuuaugggaugugccuuccccacccccuauggggaaagcagaacuggaggacggagccuaucgaauaaagcaaaagggcauucucggcuacucacagaucggggcuggaguuuacaaagaagguacuuuccacacaauguggcauguaacccgcggcgcagugcugaugcacaaggggaaacggaucgagccgaguugggccgaugucaagaaagaccuuauuagcuauggaggcgguuggaagcuggagggggaauggaaggagggagaagaggugcagguuuuggcgcuagaaccaggcaaaaaucccagagcugugcagacgaagccuggccuguuuaaaacuaacaccgggacaaucggagccgucucucucgauuucuccccagguaccucaggcagucccauaauugacaagaaagggaaggugguaggacuguacggcaacggugucgugacaaggagcggggcauauguuuccgccaucgcucaaacugagaagucuauugaggauaauccugaaaucgaggacgauauauuucguaaacgccggcuuaccauuauggacuuacacccgggagccggcaagacgaaaagauaccugcccgcaaucgugagggaagcuaucaagcgaggccuccggacauugauucuggccccaacucgcgucguggcggccgagauggaagaggcacucagagggcugccuaucagguaucagacccccgcuauucgggccgagcauacaggacgagaaauaguugaccuuaugugucacgcuaccuucacuaugagacuguugucgccagugcgcgucccuaacuacaaucuaaucauuauggaugaggcacauuucaccgaccccgccagcaucgccgcuagggguuauaucucaacacguguggaaaugggcgaggcggcagggauuuuuaugacggccacuccaccgggaucccgggauccuuucccccagaguaacgcuccaauaaucgacgaggaaagagagauucccgaaaggucuuggaauaccggccacgaguggguaacagauuuuaaagguaagaccgugugguucguuccuagcaucaaggccgggaacgacauugcagccugccugcgcaaaaauggaaagaaagucauccaacucucccgaaagacuuuugauucagaauacgugaaaacaagaaccaacgacugggauuucguggucacgacugacauaucugagaugggcgcuaauuuuaaggcggagcggguaaucgauccaaggcgcuguaugaaacccgugauuuuaacagacggcgaagaacguguuauccuggccgggccuaugccggugacccauagcagugcagcucagagacggggaaggauuggucgcaacccaaagaaugaaaacgaccaguacaucuauaugggcgagccccuugaaaaugaugaggacugcgcccacuggaaggaggcaaaaaugcugcucgauaacauaaauaccccugaagggauuauccccuccauguucgagccagaacgagagaaggucgacgccauugauggagaauacagauugcggggcgaggcuaggaaaacuuuuguggaccugaugcgcagaggugaucucccuguuuggcuggccuauaagguggcggcagaggggaucaacuacgccgacaggcggugguguuucgauggcaucaaaaacaaucagauccuugaagagaacgucgaaguggagauuuggacaaaggagggagaacguaagaaacuaaagccccgcuggcuggacgcucgaaucuauagcgauccauuggccuuaaaagaguuuaaggaguucgcugcaggcagaaaaucucugacccucaaucugauuacagagauggggaggcuuccuacuuucaugacgcaaaagacccgggacgcccuggauaaccucgcuguauugcacacagccgaagcaggaggucgcgcguacaaucaugcccugucagagcuaccggagacucuggaaacccuccuucuguuaacauugcuggcuaccgugacuggcgggaucuuucucuuccugauguccggaagaggcauagguaagaugacgcuugggaugugcugcauuaucaccgccaguauccugcucugguaugcacagauucagccccacuggaucgcugccagcauaauuuuggaguuuuuccugaucguuuuacuaauuccagaaccugagaaacagaggacaccccaagacaaccagcugacuuacgucgugaucgcaauacucaccguggucgccgcuacaauggcgaaugaaaugggcuuucuugagaagaccaaaaaggaccugggauugggcucgaucgccacucagcagccagagucuaacauucuggauaucgaccuccggccugcauccgcuuggacacuguacgccguugccacgaccuucgugacucccaugcuucgacauagcauugaaaauucaaguguaaacgugucucucacagcaaucgcuaaucaagccaccguccugaugggguugggaaaagguuggccgcuguccaagauggauauuggcgugccauuacuagcgaucggguguuauagccagguuaacccuauaacccugacagcugcccuccuucuguugguggcacacuacgccauuaucggacccggccugcaggcuaaggcaacuagagaggcccagaaacgcgcggcugccgguaucaugaagaauccaacggucgacgggauuaccguaauagaucucgaccccaucccuuaugauccgaaauuugaaaagcaacugggccaggugaugcuuuuaauucugugcguuacacaggugcucaugaugaggacuaccugggcauugugugaggcccugacacuagcuaccggacccaucucaacucugugggaaggcaacccagggcgguucuggaauacgacaauugccgucaguauggcaaacaucuuucguggaagcuaccucgcuggcgccggucuucuguucuccauaaugaaaaauaccacuaacaccagaagggggacaggaaacaucggcgagacuuugggugagaaguggaaaucucgccugaaugcgcucggcaagagcgaauuucaaauuuauaagaaauccgggauccaggagguggaccggacccuggccaaggaaggaauuaaacgaggcgagacagaucaccaugcagucucaagagggucugcuaaguuaaggugguucguggagcgcaacaugguuacgccugaaggaaaagugguagaccuuggcugcgguagagggggauggaguuacuauuguggcggucugaagaaugugagagaggucaagggccucaccaaagggggacccggccacgaggaaccuaucccaaugucgacuuacggguggaaccuaguucgucugcagagcggaguggaugucuuuuucauacccccugaaaagugcgacacauugcugugugauauuggcgaguccucuccaaaucccaccguggaggccgguaggacucuccggguacuuaaccugguggaaaauugguugaacaauaacacacaguucugcaucaaaguucugaauccguacaugccuucagugaucgagaagauggaagcacuccaacgcaaauaugggggagcuuuaguccgaaacccacugagcagaaauuccacccaugagauguacugggugaguaacgccucuggcaauauugucagcucagugaacaugauauccaggaugcuuaucaaccgguuuacgaugcgccacaagaaggccaccuaugaacccgacguugaccugggcagugggacaagaaauauuggaaucgagagcgagauuccuaaccuagauaucauagguaaaaggaucgaaaagauuaaacaggagcaugaaacuucuuggcacuacgaccaggaucacccauauaagaccugggcguaccauggcuccuaugagacaaaacagacugggucagcuagcucgaugguaaauggagugguccgacuccugaccaagcccugggacguguugccgacaguuacccaaauggcaaugacugauacgacaccuuucggccagcagcggguguuuaaggaaaaagucgacacccguacucaggagcccaaggaggguaccaaaaagcugaugaaaaucacagccgaauggcucuggaaggagcuugggaaaaagaagacgccaagaauguguacccgcgaagaguucacuaggaaagugcggucuaacgcugcccugggagcaauuuuuacagaugagaauaaguggaaaagugccagagaagcuguagaggacucccgcuucugggaauuaguggauaaggagaggaaccugcacuuggaaggcaaaugcgagaccuguguuuacaauaugaugggcaagcgagagaagaaacucggggaauuuggaaaggcgaaagguagccgggccaucugguacauguggcugggcgcaagauuccuagaguuugaagcucuuggguuccugaacgaggaccauugguuuucaagggaaaauucccucucuggagucgagggcgagggucugcacaaguugggguauauucugcgcgaugugagcaaaaaggaaggaggcgccauguacgcagacgacacugccggcugggauacacguauaacccucgaggaccuuaagaacgaagagauggugacaaaucacauggaaggggagcauaaaaagcuggcugaggccaucuucaaauuaacuuaucaaaacaaggucguucgggugcagagaccuacccccaggggaacgguaauggauauuaucagucgccgagaccagcgggguuccggccaaguggggaccuacggacugaauacauuuacuaacauggaagcgcaguugaucagacagauggagggcgaaggugucuucaaaaauauucagcaccucaccgugacagaggagguugcagugcaaaacuggcuggccagggucgggcgcgaaagacuaagccggauggcuauaucuggagaugacugcgugguaaagccacuugaugacagguucgccaacgcacugacugcucucaaugauaugggcaagauccguaaagacauucagcagugggagcccucaaagggcuggaacgauuggacccagguuccuuuuugcagucaucacuuccaugaacugaucaugaaagacgggcgaguguuggucgugccaugucgcaaucaagaugaguuaauuggacgggcccggaucucccagggugcuggcuggagccugagggaaacggccugccucgggaagucuuaugcacagauguggucgcuuauguacuuucaccgcagagaccugcggcuagcggccaacgcuauauguucagccgugccgagccacuggguccccacauccaggaccacuuggaguauccaugcaaaacacgaguggaugacaaccgaggacaugcugacuguuuggaaucgaguguggauucgugaaaacccuuggauggaggauaagaccccaguagaaucuugggaggaaauccccuaucucggaaagagagaggaccaguggugcggcagcuugauuggucugacaucccgcgcuacgugggccaaaaauauccaagcagccauaaaccaggugcggucacuuauugggaaugaggaauacaccgauuacaugccuaguaugaagagguucagacgcgaggaagaggaagcgggaguccugugguga

SEQ ID NO: 14768 - RNA, 9876 nt, Artificial Sequence
  derived and/or modified CDS sequence (opt3) from DENV-2__EU482448__SS-prME
agcgccggcaugauaauuaugcugauacccaccgugauggcuuuccaccucacuacuagaaacggggagccucauaugaucgucgguauucaagaaaaaggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacuacagagugccccaauaccaacagagccuggaauagucuggaaguggaggauuacggauuuggcguguucacaacuaacaucuggcucaagcugaaagaaaagcaggacgcauuuugugacucuaaguuaaugagcgcggcuauuaaagauaauagggccguacaugcagacauggguuauuggaucgaguccgcccugaacgauaccuggaagauagagaaggcuucauucauugaagucaagaauugccacuggccuaaaagccauacgcuuuggucuaacgggguguuggaguccgaaaugaucaucccaaagaaccucgccggacccguuagucaacacaauuaccguccuggcuaccacacacagauugcagguccauggcaucugggcaagcuagagauggacuucgauuuuugugacgggaccacugugaucgucaccgaagauugcggaaaccggggccccagccugcgaacaacuaccgcuucugggaaacucauuacagaguggugcuguagauccugcacgcugccgccucuuagguaucgcggagaggacggcuguugguacgguauggaaauacggccauugaaggagaaagaagagaaucuggugaacucauuaguuaccgccgggcacggacagguggauaauuucagucucggcguacuggguauggcgcuuuuucuggaagagauguugagaacuagggucggcacaaagcaugccauccuccugguggcugugagcuucgucacccuaauuacugggaacaugucguuuaaagaccugggacgcguugugguaauggugggcgcaacaauggccgaugacaucgggaugggagucaccuaucucgcucugcuugccgcauucaaggugcgacccacguuugcggccggcuugcuguuacggaagcucacuuccaaagagcugaugaugaccacaauugguaucguucuucugucucaaagcaccauaccugaaacugugcuagagcucacagaugcucuggccuuggggaugaugguccugaagaucgugcguaauauggaaaaauaccaguuagcaguuaccauuauggcuauccucugcgugcccaacgccgucauucugcagaaugcauggaagguaucauguacaauccuugccgugguuaguguguccccacuguugcucacuucuagccagcagaaaaccgacuggauaccucuggcucuaacgauuaagggacugaaccccacagcgaucuuccuuaccacucucuccagaaccaauaaaaagaggucauggccacugaacgaggccaucauggcagucggcauggugagcauuuuggcuaguucucuguuaaagaaugacauaccgaugacaggcccucucguagccgggggacugcuuacugugugcuauguccugaccggucgcuccgccgauuuggaacucgagcgggcuacggacguuaaaugggaggaucaggcagaaaucagcggcucgucacccauucugucuaucacaauuagugaggacggguccaugagcaucaagaacgaagaggaggaacagacccuaacuauacugaucagaacaggacuucucgugauuucuggccuguuuccaaucagcauucccaucaccgccgcggcuugguacuugugggaggugaaaaagcagagggccggugucuuaugggaugugccuuccccacccccuauggggaaagcagaacuggaggacggagccuaucgaauaaagcaaaagggcauucucggcuacucacagaucggggcuggaguuuacaaagaagguacuuuccacacaauguggcauguaacccgcggcgcagugcugaugcacaaggggaaacggaucgagccgaguugggccgaugucaagaaagaccuuauuagcuauggaggcgguuggaagcuggagggggaauggaaggagggagaagaggugcagguuuuggcgcuagaaccaggcaaaaaucccagagcugugcagacgaagccuggccuguuuaaaacuaacaccgggacaaucggagccgucucucucgauuucuccccagguaccucaggcagucccauaauugacaagaaagggaaggugguaggacuguacggcaacggugucgugacaaggagcggggcauauguuuccgccaucgcucaaacugagaagucuauugaggauaauccugaaaucgaggacgauauauuucguaaacgccggcuuaccauuauggacuuacacccgggagccggcaagacgaaaagauaccugcccgcaaucgugagggaagcuaucaagcgaggccuccggacauugauucuggccccaacucgcgucguggcggccgagauggaagaggcacucagagggcugccuaucagguaucagacccccgcuauucgggccgagcauacaggacgagaaauaguugaccuuaugugucacgcuaccuucacuaugagacuguugucgccagugcgcgucccuaacuacaaucuaaucauuauggaugaggcacauuucaccgaccccgccagcaucgccgcuagggguuauaucucaacacguguggaaaugggcgaggcggcagggauuuuuaugacggccacuccaccgggaucccgggauccuuucccccagaguaacgcuccaauaaucgacgaggaaagagagauucccgaaaggucuuggaauaccggccacgaguggguaacagauuuuaaagguaagaccgugugguucguuccuagcaucaaggccgggaacgacauugcagccugccugcgcaaaaauggaaagaaagucauccaacucucccgaaagacuuuugauucagaauacgugaaaacaagaaccaacgacugggauuucguggucacgacugacauaucugagaugggcgcuaauuuuaaggcggagcggguaaucgauccaaggcgcuguaugaaacccgugauuuuaacagacggcgaagaacguguuauccuggccgggccuaugccggugacccauagcagugcagcucagagacggggaaggauuggucgcaacccaaagaaugaaaacgaccaguacaucuauaugggcgagccccuugaaaaugaugaggacugcgcccacuggaaggaggcaaaaaugcugcucgauaacauaaauaccccugaagggauuauccccuccauguucgagccagaacgagagaaggucgacgccauugauggagaauacagauugcggggcgaggcuaggaaaacuuuuguggaccugaugcgcagaggugaucucccuguuuggcuggccuauaagguggcggcagaggggaucaacuacgccgacaggcggugguguuucgauggcaucaaaaacaaucagauccuugaagagaacgucgaaguggagauuuggacaaaggagggagaacguaagaaacuaaagccccgcuggcuggacgcucgaaucuauagcgauccauuggccuuaaaagaguuuaaggaguucgcugcaggcagaaaaucucugacccucaaucugauuacagagauggggaggcuuccuacuuucaugacgcaaaagacccgggacgcccuggauaaccucgcuguauugcacacagccgaagcaggaggucgcgcguacaaucaugcccugucagagcuaccggagacucuggaaacccuccuucuguuaacauugcuggcuaccgugacuggcgggaucuuucucuuccugauguccggaagaggcauagguaagaugacgcuugggaugugcugcauuaucaccgccaguauccugcucugguaugcacagauucagccccacuggaucgcugccagcauaauuuuggaguuuuuccugaucguuuuacuaauuccagaaccugagaaacagaggacaccccaagacaaccagcugacuuacgucgugaucgcaauacucaccguggucgccgcuacaauggcgaaugaaaugggcuuucuugagaagaccaaaaaggaccugggauugggcucgaucgccacucagcagccagagucuaacauucuggauaucgaccuccggccugcauccgcuuggacacuguacgccguugccacgaccuucgugacucccaugcuucgacauagcauugaaaauucaaguguaaacgugucucucacagcaaucgcuaaucaagccaccguccugaugggguugggaaaagguuggccgcuguccaagauggauauuggcgugccauuacuagcgaucggguguuauagccagguuaacccuauaacccugacagcugcccuccuucuguugguggcacacuacgccauuaucggacccggccugcaggcuaaggcaacuagagaggcccagaaacgcgcggcugccgguaucaugaagaauccaacggucgacgggauuaccguaauagaucucgaccccaucccuuaugauccgaaauuugaaaagcaacugggccaggugaugcuuuuaauucugugcguuacacaggugcucaugaugaggacuaccugggcauugugugaggcccugacacuagcuaccggacccaucucaacucugugggaaggcaacccagggcgguucuggaauacgacaauugccgucaguauggcaaacaucuuucguggaagcuaccucgcuggcgccggucuucuguucuccauaaugaaaaauaccacuaacaccagaagggggacaggaaacaucggcgagacuuugggugagaaguggaaaucucgccugaaugcgcucggcaagagcgaauuucaaauuuauaagaaauccgggauccaggagguggaccggacccuggccaaggaaggaauuaaacgaggcgagacagaucaccaugcagucucaagagggucugcuaaguuaaggugguucguggagcgcaacaugguuacgccugaaggaaaagugguagaccuuggcugcgguagagggggauggaguuacuauuguggcggucugaagaaugugagagaggucaagggccucaccaaagggggacccggccacgaggaaccuaucccaaugucgacuuacggguggaaccuaguucgucugcagagcggaguggaugucuuuuucauacccccugaaaagugcgacacauugcugugugauauuggcgaguccucuccaaaucccaccguggaggccgguaggacucuccggguacuuaaccugguggaaaauugguugaacaauaacacacaguucugcaucaaaguucugaauccguacaugccuucagugaucgagaagauggaagcacuccaacgcaaauaugggggagcuuuaguccgaaacccacugagcagaaauuccacccaugagauguacugggugaguaacgccucuggcaauauugucagcucagugaacaugauauccaggaugcuuaucaaccgguuuacgaugcgccacaagaaggccaccuaugaacccgacguugaccugggcagugggacaagaaauauuggaaucgagagcgagauuccuaaccuagauaucauagguaaaaggaucgaaaagauuaaacaggagcaugaaaucucuuggcacuacgaccaggaucacccauauaagacuugggcguaccauggcuccuaugagaccaaacagacagggucagcuagcucgaugguaaauggagugguccgacuccugacuaagcccugggacguguugccgaccguuacacaaauggcaaugaccgauacuacgccuuucggccagcagcggguguuuaaggaaaaagucgacacacguacccaggagcccaaggaggguacuaaaaagcugaugaaaauuaccgccgaauggcucuggaaggagcuugggaaaaagaagacaccaagaauguguacgcgcgaagaguucaccaggaaagugcggucuaacgcugcccugggagcaaucuuuacugaugagaauaaguggaaaagugccagagaagcuguagaggacucccgcuucugggaauuaguggauaaggagaggaaccugcacuuggaaggcaaaugcgagacauguguuuacaauaugaugggcaagcgagagaagaaacucggggaauuuggaaaggcgaaagguagccgggccauuugguacauguggcugggcgcaagauuccuagaguuugaagcucuuggguuccugaacgaggaccauugguuuucaagggaaaauucccucucuggagucgagggcgagggucugcacaaguugggguauauacugcgcgaugugagcaaaaaggaaggaggcgccauguacgcagacgacaccgccggcugggauacucguaucacacucgaggaccuuaagaacgaagagauggugaccaaucacauggaaggggagcauaaaaagcuggcugaggccauuuucaaauuaacauaucaaaacaaggucguucgggugcagagaccuacucccaggggaaccguaauggauaucaucagucgccgagaccagcgggguuccggccaaguggggacguacggacugaauaccuuuacaaacauggaagcgcaguugauuagacagauggagggcgaaggugucuucaaaaauauacagcaccucacugugaccgaggagguugcagugcaaaacuggcuggccagggucgggcgcgaaagacuaagccggauggcuaucucuggagaugacugcgugguaaagccacuugaugacagguucgccaacgcacugacagcucucaaugauaugggcaagauucguaaagacauccagcagugggagcccucaaagggcuggaacgauuggacucagguuccuuuuugcagucaucacuuccaugaacugauuaugaaagacgggcgaguguuggucgugccaugucgcaaucaagaugaguuaaucggacgggcccggauaucccagggugcuggcuggagccugagggaaaccgccugccucgggaagucuuaugcacagauguggucgcuuauguacuuucaccgcagagaccugcggcuagcggccaacgcuaucuguucagccgugccgagccacuggguccccacguccaggacaaccuggaguauucaugcaaaacacgaguggaugacuacagaggacaugcugaccguuuggaaucgaguguggauccgugaaaacccuuggauggaggauaagacuccaguagaaucuugggaggaaauucccuaucucggaaagagagaggaccaguggugcggcagcuugaucggucugaccucccgcgcuacaugggccaaaaauauacaagcagccauuaaccaggugcggucacuuaucgggaaugaggaauacacggauuacaugccuaguaugaagagguucagacgcgaggaagaggaagcgggaguccugugguga

SEQ ID NO: 14769 - RNA, 9876 nt, Artificial Sequence
  derived and/or modified CDS sequence (opt3) from DENV-2__EU482449__SS-prME
accgccggagugauaauuaugcugauacccacagcuauggcauuccaccucacuacgaggaacggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguggcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugagaugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaagcagccugcaacccuucggaaauauugcaucgaagccaaguugacaaacacuaccacagagagucgcuguccaacucaaggagagcccucccugaaugaagaacaggacaaacgauuuguuugcaagcauucuaugguggauagaggcugggguaacggguguggacuguucggcaagggcgggaucgucacaugcgcuauguuuacaugcaaaaagaauauggaaggaaaaauugugcagccugagaaccucgaauacaccauagugaucacuccacacagcggugaggagcaugccgucggcaaugacacggggaagcacggaaaagaaauuaagaucacaccgcaguccucaaacaccgaggcagaacugacuggcuaugguaccguuacaauggaguguagucccaggaccgggcuugauuucaaugaaauggugcuguugcaaauggaggacaaggcuuggcucguacaccggcagugguuucuggauuuaccucugccauggcuccccggcgccgacacucagggaagcaacuggauacagaaggagacacuugugacguucaagaauccucaugcgaaaaagcaagacgucgugguucugggcucucaggaaggggccaugcacaccgcauugacuggagcuacagagauucagauguccucagguaaccuacuguuuaccggccaucucaaaugccgucugcgcauggauaaacuucaacugaaagggaugagcuacaguauguguacaggaaaguucaagaucgugaaagaaaucgccgagacucagcacggcaccauugucaucagagugcaguaugagggugacgggucuccaugcaagauucccuucgaaauaauggauuuggagaaaaggcauguacucggccggcugaucacgguuaacccgauugugaccgaaaaggacuccccugucaauaucgaggcugaacccccauuuggagauagcuacaucauuauaggcguggagccugggcaguuaaaacugaacugguucaagaagggaucgucuaucggucaaauguuugagacaacuaugcgaggcgccaaacgcauggcaauucuaggggacaccgccugggauuucggaucccucggcggugucuuuacaucaaucgggaaggcucugcaccagguguucggcgcgauuuacggagcagccuuuaguggcguuagcuggacuaugaaaauccuuauaggggcuaucauuaccuggaucggaaugaacuccagaucuacgagcuugucagugagucugguacucgucggcgugauuacacuguaucuuggugccaugguucaggcagacuccggguguguggucagcuggaagaacaaagaacugaagugcggaucuggcaucuucauaaccgauaaugugcacacuuggacagagcaguacaaguuucaacccgaaucaccaaguaaauuggccagcgcuauucagaaggcccaugaggaagguaucuguggcauuagguccguaacccggcucgagaaccugauguggaaacagaucacucccgaguuaaaucacauacugucugaaaacgaggugaagcuaaccaucaugacaggggacauuaaaggaaucaugcaggcaggcaagcgcucgcucagaccucaaccaacggaacugaaauauagcuggaagaccugggggaaggcgaaaaugcuuuccacugagucacauaaucagacauucuugauugauggaccggaaaccgcugagugccccaacacaaauagggccuggaacagucuggagguugaagacuacggcuuuggugucuucacuaccaauaucuggcucaagcugcgugagaaacaggacguguuuugugauucuaaguuaaugagcgcagccauaaaagacaaccgggcugugcacgccgauaugggguauuggauugaauccgcacugaaugacacguggaagauggagaaggcuucauucaucgaggucaaaagcugccacuggccuaagucucauacacuuugguccaacggaguuuuggaaagugagaugaucauuccaaagagcuucgccggccccgugucucagcacaacuaccgaccugguuauuacacccaaacugcgggcccauggcaucucgggaagcuggaaauggauuuugacuucugugagggaaccacagugguagucacugaagauugcggcaauagagggcccucccuaaggaccacaacggccucaggaaaacugaucaccgaguggugcugucgcaguugcacucucccgccucugcgguacagaggcgaggacgguuguugguaugggauggaaauuaggccacuuaaggagaaggaagagaacuuggugaauagccugguuacagcuggacacggccagauagauaacuuuucguuaggugugcucggcauggcacuguuccuugaagagaugcugcgcacccgagucgggacuaaacaugccaucuugcucguggcuguuuccuuuaugacacugauuaccggaaauaugucuuuccgggaccuaggccgugugaugguaauggucggggccacgaugacugaugacaucggaaugggcgugaccuaccuggcacuccuggcggccuuuaaggugagacccacauucgcugccggucuuuugcugaggaaauuaaccagcaaggagcucaugauggcaacuauugggaucgcucugcuuucacagaguacaauaccugaaaccauccuggagcuaacagaugcccucgcacugggaaugauggucuugaaaauuguucgcaacauggaaaaguaucaacuggccgugacuaucauggcuauuuccugcguacccaaugcggugaucuuacagaacgccuggaaggucucuuguaccauacucgcagcugugagcguuuccccacugcuucugacgucaagccagcagaaagccgacuggauuccuuuggcccucacaaucaagggccugaaucccaccgcuaucuuucuaacuacccugagucggacaucuaaaaagagauccuggccacuuaacgaggcaauuauggccgugggcauggucagcauacucgcgucgucacuguugaaaaaugacaucccgaugacugggccucugguggcuggagguuuacucaccguuugcuacgugcugacgggcaggucugccgaucuugaacuggagcgagcaacagacgucaagugggaggaucaagccgaaauuaguggguccagccccaucuugucuauuaccaucagcgaggacggauccaugucaaucaagaaugaagaggaggaacagacucucacaauccugauucgcaccggccuacugguaaucaguggucuuuucccagugagcauucccaucacugcugcagccugguaucucugggagguuaagaagcagcgggcgggggugcugugggaugucccuucuccacccccugugggaaaagcugaauuggaggacggcgccuacagaauaaagcagaaaggcauuuuaggguauucccaaaucggagcugguguauacaaggaaggcacauuucacaccauguggcacgugacgagaggggcaguccugaugcaucguggaaaacgcaucgagccgucaugggcagauguuaagaaggaccucauuaguuacggcgguggguggaaacuggagggagaauggaaggagggcgaagagguacaggugcuugcccuggaaccaggcaaaaauccccgggcaguccagacuaagccuggguuguucaaaaccaacacaggaaccaucggugcugugagccuagauuuuuccccaggcacaucugggucgcccauaguugacagaaagggaaagguagugggccuguaugguaauggggucgugacuaggagcggagccuacguuucagcgauugcccagaccgagaaauccaucgaggauaacccugaaauugaggacgauaucuuccgaaagaaacggcucacgauaauggaccugcacccgggcgcaggcaagacaaaacgcuaucuucccgcuauugugagagaagccaucaagaggggguuacggacucugauccucgcuccaacccgagucguggcagccgagauggaagaggccuugagaggacugccuauucgcuaccaaacacccgcuaucagggcggagcauaccggucgugaaauuguagaccucaugugucacgcaacuuucaccaugcggcugcuuaguccagucagagugccuaacuauaaucugauaaucauggaugaggcccauuuuacagaccccgcuucuauugccgcaaggggcuacaucagcacgcgcguugaaaugggggaggccgcuggaaucuucaugacugcgaccccaccgggcucccgagauccuuuuccccagucaaacgccccaauuauagacgaggaaagagagauccccgaacggucuuggagcaguggucacgagugggugacagauuucaaggggaaaaccgucugguuugugccuuccauuaaggcaggaaaugacaucgcugccugcuugaggaaaaacggcaagaaaguuauucagcuaagccgcaagacuuucgauucugaauaugugaagacacguaccaaugacugggauuuugucgugacgacugacaucucagagaugggcgcaaacuucaaagccgagagaguaauagauccacggagguguaugaagcccgugauccugacagacggggaagaacgcguuauucucgcuggaccuaugccggucacccacuccagugccgcgcaacgaagaggucggaucggcaggaaucccaaaaacgaaaaugaccaguacauuuacaugggggagcccuuagaaaacgaugaggacugcgcacauuggaaggaggccaaaaugcugcuugauaauaucaacaccccugaaggaauaauucccagcauguuugagccagaacgcgagaagguggacgcuaucgauggcgaauauagacugaggggugaggcccggaaaacuuucguggaccucaugcgucgcggggauuugccugucuggcuggcuuaccgaguagcagccgagggcauuaauuaugcugacagaaggugguguuuugauggagugaagaacaaucagauccucgaagagaacguugaaguggagauauggacaaaggagggcgaacggaaaaagcugaaaccccgcuggcuugacgccagaaucuacucggauccacuagcacugaaggaguucaaagaguucgcggccgggaggaagucuuugaccuuaaaccugauuacagagaugggacggcucccuacuuuuaugacgcagaaggcucgagacgcccuggauaaucuugcaguccugcacaccgcugaagccgguggcagagcauauaaccaugcccucuccgaguugccggagacacuggaaacucuacugcuccuuacccuguuagcuacagugaccgggggaaucuucuuguuucugaugagcggcaaagguguugggaagaugacucucggcauguucugcauuaucacggcgucaauacugcuuugguacgcccaaauucagccccacuggaucgcagcuaguaucauucuggaguuuuuccucaucguguugcugauaccagaaccugagaaacagcgcaccccacaggacaaucaauuaacauaugucgugauugccauccuaacuguaguggccgcaaccauggcuaacgaaaugggauuucuggagaagaccaagaaagaccucggccuugggucuauugccacccaggagccagaauccaauauccuggauauagacuugaggccugcgagcgcuuggacucuguacgccguugcaacaacguucgucacccccaugcuccggcacucaaucgagaacaguagcgugaaugugucccugacugccauugcuaaccaggcaacaguccuuaugggacucgguaaaggcuggccgcugucuaaaauggauaucgggguuccauugcuggccauuggaugcuacagccaggugaauccuaucaccuuaaccgcggcucuacugcuccuuauugcccauuaugcaaucauaggccccggucugcaagccaaggcuacacgugaagcccagaaaagagcagcugccgggauuaugaagaacccaacuguagacggcaucacggugaucgauuuggaccccauuccuuacgauccgaaauuugagaagcagcugggacaggucaugcuccugauacuuugugugacccaaguuuuaaugaugaggacaacuugggcgcugugcgaagcccucaccuuggcaacaggccccaucuccacccugugggaggggaauccaggacgcuucuggaacacuacgauugcugugucaauggccaauaucuuucggggcucuuaucuagccggugcugggcuacucuucaguauuaugaagaacacaaccaauacucgaagaggaaccggcaacaucggugagacacuuggcgaaaaauggaagucgaggcugaaugccuuggggaaaagcgaguuucagauauacaagaaauccggaauccaggaagucgaccgcacucuggccaaggagggcauuaaaagaggggagaccgaucaccaugcgguaucuagaggaucagcuaagcuccguugguucguggaaaggaacaugguuacaccugagggcaagguggucgaccuggguugugggcggggaggcuggagcuauuacugcgguggccuuaaaaacgugcgcgaagucaaggggcuaacgaaaggaggccccgggcacgaggaaccuaucccaauguccaccuauggauggaaucuggugcgacuccaaaguggcguugauguguucuuuacucccccugagaagugugacacacuacugugcgauauuggugagucuagcccaaaccccaccaucgaagcagggagaacuuugaggguacugucacucguggagaauuggcuuaacaaugacacacaguucuguauaaaaguccugaacccguacaugccuuccguuauugaaaagauggagaccuugcagcggaaguacggaggcgcccuggugcgcaauccacucaguagaaacagcacgcaugaaauguauugggucucuaaugcuaccggcaacaucguguccucaguaaauaugaucagcaggauguuaauuaaccgauuuacaaugaaacacaagaaagccacuuacgagcccgacguggaucuggggucgggaacccggaauauagguaucgagucugaaauuccuaaccuugacaucauuggcaagcguaucgagaaaauaaagcaggaacacgagacaaguuggcauuaugaucaagaccacccauacaagacuugggcauaucauggguccuacgaaaccaaacagacaggaagcgccucauccaugguuaauggcguggucagacugcuaaccaagcccugggauguggucccgauggugacucagauggcuaugacggacacaaccccuuucggucagcaacgcguuuuuaaagagaagguagauacuaggacccaggagcccaaagaagggacaaagaagcucaugaaaaucacggcggaguggcuguggaaggaauugggcaaaaagaaaaccccacggaugugcacuagagaggaguucacacgcaaggugaggucuaacgccgcacugggcgcuauuuuuaccgacgaaaacaaauggaaaagcgcccgagaggcagucgaagauagucgguucugggagcucguggacaaggaaagaaaucuucaccuggagggcaaaugugagacuugcguuuauaacaugauggggaagagggagaaaaaguuaggagaguuugguaaagccaagggcucccgcgcuaucugguacauguggcugggggcccguuucuuggaauuugaggcgcucggauuccugaaugaagaucacugguuuagccgggagaacucucuaucaggcguggagggugaagggcuucauaagcugggauacauucucagagacgucaguaaaaaggagggcggcgcaauguaugccgacgauacagcugggugggacaccaggaucacacuggaagauuugaaaaaugaggaaauggugacuaaccacauggagggagagcauaagcgccuggccgaagcaauuuucaaacucaccuaccagaauaagguagugcgaguucagcggccuacgcccagagguaccgucauggacauaaucuccaggcgcgaucaaagaggcagcggacaggugggaacauauggccuuaacacuuucaccaauauggaggcucagcugauucggcaaauggaaggugaggggaucuuuaagucuauccagcacuuaacagugacugaggaaauugccguccagaacuggcuggcuaggguuggacgugagcgauugucgcgcauggccauaucaggcgacgauugugugguaaaaccacucgacgauagauucgcaagcgcgcugaccgcccuaaaugacaugggcaaggugcggaaagauauccagcaaugggaacccuccaagggguggaacgacuggacgcaggucccuuuuugcagucaucacuuccacgagcuuauuaugaaagauggaagggugcugguugugccaugccgcaaucaggacgaacucaucgguagagcucggauuucucagggcgccggguggagccugaaggagacagcauguuugggaaaguccuacgcucaaauguggucauuaauguauuuucauaggcgagaccugcgucucgccgcaaacgccaucugcagugcggucccgucucacugggugcccaccagcagaacuacaugguccauacaugcuaaacacgaguggaugaccacugaagauaugcuuaccguauggaaucgcguuuggauccaggagaacccuuggauggaagacaagacaccaguggagucaugggaagagguccccuaccugggcaaacgggaggaucaguggugugguagccuaauugggcugacgucuagggccaccugggcaaagaacauccagacugccauuaaucaagugagaucccucaucggaaacgaagaguauacagacuacaugccuaguaugaaacgcuuccggagggaagaggaagaggcuggcguguugugguga

SEQ ID NO: 14770 - RNA, 9876 nt, Artificial Sequence
  derived and/or modified CDS sequence (opt3) from DENV-2__EU482450__SS-prME
agcgcaggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucagcacaauuaccguccuggcuaccacacgcagauugcugguccauggcaucugggcaagcuagagauggacuucgauuuuugugacgggacaaccguggucgugacugaagauugcggaaaccggggccccagccugcgaaccacaacugccucugggaagcucaucaccgaguggugcuguagauccugcacacugccgccucuuagguaucgcggagaggacggcuguugguacgguauggaaauucggccauugaaagagaaggaagagaaucugguuaacucauuagugacggcggggcacggacaaguagauaauuucagucucggcguccuggguauggcccuuuuucuggaagagauguugagaaccagggugggcacuaaacaugcuauacuccugguggcagucagcuucguuacacuaaucaccgggaacaugucguuuaaggaccugggacgcgugguagugauggucggcgccacuaugacagaugacauugggaugggagugaccuaucucgcucugcuugccgcauucaaaguucgacccacguuugcggccggcuugcuguuacggaagcucacuuccaaggagcugaugaugaccacaaucgguauugugcuucugucucagagcgcuaucccugaaaccguccuagagcucacugaugcccuggcauuggggaugauggugcugaaaauaguucguaauauggaaaaguaccaguuagcugugacaaucauggccauucucugcguccccaacgcaguaauccugcagaaugccuggaaagugucauguaccauucuugcuguugugagugucuccccacuguugcucacaucuagccaacagaagacugacuggaucccucuggcgcuaaccauaaaaggacugaaccccacggccauuuuccuuacaacccucuccagaacuaauaagaaaaggucauggccacugaacgaggcaaucauggcugugggcaugguaagcaucuuggccaguucucuguuaaagaaugacauuccgaugaccggcccucucguggccgggggacugcuuacagucugcuauguucugacuggucgcuccgcugauuuggaacucgagcgggcaaccgacgugaagugggaggaucaggccgaaauaagcggcucgucacccauccugucuauuacgaucagugaggacggguccaugagcauuaaaaacgaagaggaggaacagacacuaaccauccugauaagaacuggacuucucgugaucucuggccuguuuccaauuagcauccccauuacagcggcugccugguacuugugggaggucaagaaacaaagggccgguguguuaugggauguuccuuccccacccccuauggggaaggccgaacuggaggacggagcuuaucgaaucaaacagaagggcauacucggcuacucacagauuggggcaggaguauacaaggaagguaccuuccacacuauguggcaugugacacgcggcgccguccugaugcacaaagggaagcggaucgagccgaguugggcggaugugaaaaaggaccuuaucagcuauggaggcgguuggaaacuggagggggaauggaaggagggagaagagguucagguguuggcucuagaaccaggcaagaaucccagagccguccaaaccaaaccuggccuguuuaagacgaacacugggaccauuggagcagugucucucgauuucuccccagguacaucaggcagucccaucauagacaaaaaggggaaaguagucggacuguacggcaacggugugguuaccaggagcggggccuauguguccgcuauugcccagacagagaagucuaucgaggauaauccugaaauugaggacgauaucuuucguaagcgccggcuuacuauaauggacuuacacccgggagcaggcaaaaccaagagauaccugcccgcuauugucagggaagccaucaaacgaggccuccggacguugauccuggcgccaacacgcgugguugccgcagagauggaagaggcucucagagggcugccuauuagguaucagacucccgccauccgggcugagcauaccggacgagaaauuguggaccuuaugugucacgcaacauucaccaugagacuguugucgccaguccgcgugccuaacuacaaucuaauaaucauggaugaggcccauuucacugaccccgccagcauugcugcgagggguuauaucucaacccguguagaaaugggcgaggcagccgggaucuuuaugacagcuacgccaccgggaucccgggauccuuucccccaaaguaacgccccaauuauagacgaggaaagagagauccccgaaaggucuuggaauagcggccacgagugggugacugauuuuaaggguaaaaccguuugguucgucccuuccauuaaggcagggaacgacaucgccgcuugccugcgcaagaauggcaagaaggugauucagcucucacgaaaaacauuugauucugaauacgugaagaccagaacuaacgacugggauuucgucguaacaaccgacaucagcgagaugggcgcgaauuuuaaagccgagcgggugauagauccaaggcgcuguaugaagcccguuaucuuaacggacggcgaagaacgugugauucuggcagggccuaugccggucacucauaguuccgcugcccagagacggggaaggaucggucgcaaccccaaaaaugaaaacgaccaguacauuuauaugggcgagccccuugaaaaugaugaggacugcgcacacuggaaggaggccaagaugcugcucgauaacaucaauacaccugaagggauaauucccagcauguucgagccagaacgagagaaaguggacgcuaucgauggagaauacagauugcggggcgaggccaggaagaccuuuguugaccugaugcgcagaggugaucucccuguguggcuggcguauaaagucgcagccgaggggauuaacuacgcugacaggcggugguguuucgauggcaucaagaacaaucaaauacuugaagagaacguggaaguagagaucuggaccaaagagggagaacguaagaagcuaaaaccccgcuggcuggacgcccgaauuuauucugauccauuggcuuuaaaggaguuuaaagaguucgcagccggcagaaagucacugacucucaaucugaucacagagauggggaggcuuccuaccuucaugacacagaaaacucgggacgcucuggauaaccucgccguguugcacacggcagaagcgggaggucgcgccuacaaucaugcucuguccgagcuaccggagacccuggaaacacuccuucuguuaacuuugcuggccaccguuacaggcgggauuuuucucuuccugaugaguggaagaggcaucgguaagaugacccuugggaugugcugcauaauuacugcaagcauccugcucugguaugcucagauccagccccacuggauugccgcaucgaucauauuggaguuuuuccugauugucuuacuaaucccagaaccugagaagcaaaggacgccccaggacaaccagcugaccuacguggugauugccauccucacagucguugcugcgacuauggccaaugaaaugggcuuucuugagaaaaccaagaaagaccugggauugggcucuauagcaacacagcaaccagaguccaacauccuggauauugaccuccggccugcuagcgccuggacccuguacgccguggcaacuacauucguaacgcccaugcuucgacauucaaucgaaaauaguucugugaacgucucccucaccgcuauugccaaucaggcgacugugcugaugggguugggaaaggguuggccgcugagcaaaauggauaucggcguuccauuacuagcuauuggguguuauucacaggugaacccuaucacacugaccgccgcacuccuucuguuggucgcccacuacgcuauaauuggacccggccugcaggcaaaggccaccagagaggcgcaaaagcgcgcugccgcagguaucaugaaaaauccaacaguagacgggaucacugugauugaucucgaccccauaccuuaugauccgaaguuugaaaaacagcugggccagguuaugcuuuuaauccugugcgugacgcaaguccucaugaugaggaccacaugggccuugugugaggcucugacucuagccaccggacccauuaguacacugugggaaggcaacccagggcgguucuggaauaccacuaucgcagugagcauggcuaacauuuuucguggauccuaccucgccggcgcgggucuucuguucucuaucaugaagaauacgacaaacaccagaagggggacuggaaacaugggcgagaccuugggugagaaauggaaaagccgccugaaugcccucggcaaauccgaauuucagauauauaagaagucagggauccaggaggucgaccggacacuggcaaaagaaggaauuaagcgaggcgagacugaucaccaugcugugucuagagggagugccaaauuaaggugguucguugagcgcaacauggugaccccugaaggaaagguaguggaccuuggcugcgguagagggggauggucguacuauuguggcggucugaaaaaugucagagagguuaagggccucacaaaagggggacccggccacgaggaaccuaucccaaugagcacguacggguggaaccuagugcgucugcaguccggagucgauguguuuuucauucccccugaaaaaugcgacaccuugcugugugauaucggcgagucuucaccaaaucccacuguagaggcagguaggacacuccgggugcuuaaccugguugaaaauugguugaacaauaacacccaauucugcauaaaggugcugaauccguacaugccuagcgucauugagaaaauggaagcucuccagcgcaaguaugggggagccuuagugcgaaacccacuguccagaaauaguacucaugagauguacugggucucuaacgccagcggcaauaucgugucauccguuaacaugaucaguaggaugcuuauuaaccgguuuacaaugcgccacaaaaaggcgaccuaugaacccgacguagaccugggcagcgggacgagaaauauaggaaucgagucugagauuccuaaccuagauaucauugguaagaggaucgagaaaauaaagcaggagcaugaaaccuccuggcacuacgaccaggaucacccauauaaaacaugggcuuaccauggcucauaugagacuaagcaaaccgggagcgcaucgucuauggugaauggagucgugcgacuccugacaaaacccugggacguuuugccgacugugacccagauggccaugacagauaccacuccuuucggccagcagcgggucuuuaaggaaaagguggacacgcguacacaagagcccaaagaggguaccaagaaacugaugaagaucacugcugaauggcucuggaaagagcuugggaagaaaaagaccccaagaauguguacacgcgaagaguucacgaggaagguacggaguaacgccgcacugggagccauuuuuaccgaugagaauaaauggaaguccgcuagagaagcgguggaggacagccgcuucugggaauuaguugauaaagagaggaaccugcacuuggaaggcaagugcgagacuugugucuacaauaugaugggcaaacgagagaagaagcucggggaauuuggaaaagccaaggguucacgggcaaucugguacauguggcugggcgcuagauuccuagaguuugaagcccuuggguuccugaacgaggaccauugguuuuccagggaaaauucucucagcggaguggagggcgagggucugcacaaauugggguauauucugcgcgaugugaguaagaaagaaggaggcgcaauguacgccgacgacacagcuggcugggauacccguaucacucucgaggaccuuaagaacgaagagauggucacaaaucacauggaaggggagcauaagaaacuggccgaggcgauuuucaaguuaaccuaucagaacaaaguugugcggguacagagaccuacacccaggggaacugugauggauauaaucucccgccgagaccaacgggguagcggccaggucgggaccuacggacugaauacguuuaccaacauggaagcacaguugauuagacagauggagggcgaagguguguucaagaauauccaacaccucacaguuacugaggagguggccgucaaaaacuggcuggcuaggguggggcgcgaaagacuaucucggauggccaucucaggagaugacugcguaguuaagccacuugaugacagguucgcaaacgcucugaccgcccucaaugauaugggcaagauucguaaagacauacagcagugggagcccaguaagggcuggaacgauuggacacaggugccuuuuugcucccaucacuuccaugaacugaucaugaaagacgggcgagucuugguggugccaugucgcaaucaagaugaguuaauugguagagcucggaucagccagggagccggcuggucucugagggaaacugcaugccucgggaagucguaugcgcagauguggucacuuauguacuuucaccgcagagaccugcggcuagccgcuaacgccauuuguagcgcagucccgucccacuggguucccaccaguaggacgacauggucuauccaugcuaaacacgaguggaugaccacugaggacaugcugacaguguggaaucgaguauggauacgugaaaacccuuggauggaggauaagaccccaguggaaagcugggaggaaauccccuaucucggaaagagagaggaccaguggugcggcuccuugauuggucugacuucacgcgccaccugggccaaaaauauccaagccgcgauuaaccagguccggagucuuaucgggaaugaggaauacgcugauuacaugccuucuaugaagagguucagacgcgaggaagaggaagccggagugcugugguga

SEQ ID NO: 14771 - RNA, 9876 nt, Artificial Sequence
  derived and/or modified CDS sequence (opt3) from DENV-2__EU569721__SS-prME
agcgcaggcaugauaauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucagagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccaacagaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaagugggaggaucaggccgaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagcggcugccugguacuugugggaggugaagaaacaaagggccggugucuuaugggaugugccuuccccacugcccauggggaaggccgaacucgaggacggagcuuaucgaauaaaacagaagggcauucugggcuacucacagaucggggcaggaguuuacaaggaagguaccuuccacacuauguggcauguaacacgcggcgccgugcuuaugcacaaagggaagcggaucgagccuaguugggcggaugucaaaaaggaccugauuagcuauggaggcgguuggaaauuggagggggaauggaaggagggagaagaggugcagguucuagcucuggaaccgggcaagaauccaagagccgugcaaaccaaacccggccucuuuaagacgaacacugggaccaucggagcagucucucuggauuucuccccugguacaucaggcaguccaauaauugacaaaaaggggaaagugguaggacuuuacggcaacggugucgugaccaggagcggggccuauguuuccgcuaucgcccagacagagaagucuauugaggauaaucccgaaaucgaggacgauauauuucguaagaaacgcuuaacuauuauggaccugcacccuggagcaggcaagaccaaacgguaccucccggcuaucgugagagaagccaucaagaggggcuugcgaacgcugauucucgcgcccacacgggucguggccgcagagauggaagaggcucugcgcgggcuuccaaucagauaucagacuccugccauuagggcugagcauaccggacgggaaauaguugaccugaugugucacgcaacauucaccaugcgauugcuaucgcccgugagagucccaaacuacaaucugaucauuauggaugaggcccauuucacugacccugccagcaucgcugcgcgcgguuauaucucaaccaggguggaaaugggcgaggcagccgggauuuuuaugacagcuacgcccccaggaucccgugauccguucccucaaaguaacgcccccauaaucgacgaggaacgggagauuccagaaagaucuuggaauagcggccacgaguggguaacugauuuuaaagguaagaccgugugguucguucccuccaucaaggcagggaacgacauugccgcuugccucaggaaaaauggaaagaaagucauccaguuaucacgcaagacauuugauucugaauacgugaaaacccgaacuaacgacugggauuucguggucacaaccgacauaagcgagaugggcgcgaauuuuaaggccgagagaguaaucgauccucggagguguaugaaaccagugauucugacggacggcgaagaacgcguuauccuugcagggcccaugccugugacucauaguuccgcugcccagcguagaggacggauugguaggaacccgaagaaugaaaacgaccaguacaucuauaugggcgagccacuggaaaaugaugaggacugcgcacacuggaaggaggccaaaaugcucuuggauaacauaaauacacccgaagggauuaucccuagcauguucgagcccgaacgcgagaaggucgacgcuauugauggagaauaccgacugagaggcgaggcccggaaaaccuuuguggaccucaugaggcgcggugaucugccaguuuggcuugcguauaagguggcagccgaggggaucaacuacgcugacagaaggugguguuucgauggcaucaaaaacaaucaaauccuagaagagaacgucgaaguggagauuuggaccaaggagggagaacggaagaaacugaagccucguugguuggacgcccgcaucuauucugaucccuuagcucugaaagaguuuaaggaguucgcagccggccgaaaaucacucacucugaaucuuauuacagagauggggagacugccaaccuucaugacacagaagacuagggacgcucucgauaacuuggccguacugcacacggcagaagcgggaggucgggccuacaaucaugcucuauccgagcugccugagacccucgaaacacuucuguuauugacucugcucgccaccgugacaggcgggaucuuucuguuccuuaugaguggacgcggcauagguaagaugacccuggggaugugcugcauuaucacugcaagcauccucuugugguaugcucagauucagccgcacuggaucgccgcaucgauaauucuggaguuuuucuuaaucguucuacugauucccgaaccagagaaacaaagaacgccucaggacaaccagcucaccuacgucgugaucgccauacuuacaguggucgcugcgacuauggccaaugaaaugggcuuucuggagaagaccaaaaaggacuugggacugggcucuaucgcaacacagcaacccgaguccaacauucucgauaucgaccugaggccagcuagcgccuggacccuuuacgccguugcaacuacauucgugacgccuaugcuccggcauucaauugaaaauaguucuguaaacgugucccugaccgcuaucgccaaucaggcgacugucuugauggggcugggaaaagguuggcccuuaagcaagauggauauuggcgugccgcuacuggcuaucggguguuauucacagguuaacccaauaacacucaccgccgcacuucuguugcugguggcccacuacgcuauuaucggaccuggccuccaggcaaaggccacccgagaggcgcagaaaagagcugccgcagguaucaugaagaaucccacagucgacgggauuacuguaauagaucuggacccaauccccuaugauccuaaauuugaaaagcagcuuggccaggugauguuacugauucucugcguuacgcaaguguugaugaugcgcaccacaugggcccugugugaggcucuaacucuggccaccggaccgaucaguacacucugggaaggcaaccccgggagguucuggaauaccacuauugcagucagcauggcuaacaucuuucggggauccuaccuugccggcgcgggucuguuguucucuauaaugaaaaauacgacaaacacccguagagggacuggaaacaugggcgagacccugggugagaaguggaaaagcaggcucaaugcccugggcaaguccgaauuucagaucuauaagaaaucagggauucaggagguggaccgcacauuagcaaaggaaggaaucaaacggggcgagacugaucaccaugcugucucucgagggagugccaaacuuagaugguucguggagaggaacaugguuaccccagaaggaaaagugguagaccugggcugcggucgcgggggauggucguacuauuguggcggucucaagaaugugcgggaggucaagggccuaacaaaagggggaccuggccacgaggaaccaauuccuaugagcacguacggguggaaccugguuagauugcaguccggaguggaugucuuuuucaucccacccgaaaagugcgacacccugcucugugauauaggcgagucuucaccuaauccaacuguggaggcaggucguacacuuaggguacugaacuugguggaaaauuggcugaacaauaacacccaauucugcauuaaaguucucaaucccuacaugccgagcgugaucgagaagauggaggcuuuacagcggaaauaugggggagcccugguccgcaacccucuuucccgaaauaguacucaugagauguacugggugucuaacgccagcggcaauaucgucucauccgugaacaugauuaguagaaugcugauaaacagguuuacaaugcggcacaagaaggcgaccuaugaaccagacguugaccuaggcagcgggacgcgcaauaucggaauugagucugagacccccaaccucgauaucauugguaaaagaaucgaaaagauaaaacaggagcaugaaacauccuggcacuacgaccaggaucacccuuauaagacuugggcuuaccauggcucauaugagaccaaacaaacagggagcgcaucgucuaugguaaauggaguggucaggcuguugacuaagccaugggacgugcugcccaccguuacacagauggccaugaccgauacuacgccguucggccagcagcgaguguuuaaggaaaaagucgacacacggacccaagagccuaaggaggguacuaaaaagcucaugaaaaucaccgcugaauggcuuuggaaggagcuggggaaaaagaagacaccccguauguguacgagagaagaguucacccgcaaagugaggaguaacgccgcauuaggagccauuuuuacugaugagaauaaguggaaauccgcucgggaagcgguagaggacagcagauucugggaacugguggauaaggagcgcaacuugcaccucgaaggcaaaugcgagacauguguuuacaauaugaugggcaagagggagaagaaacugggggaauuuggaaaggccaaagguucacgagcaaucugguacauguggcuaggcgcucgguuccuugaguuugaagcccugggguuccucaacgaggaccauugguuuuccagagaaaauucucugagcggagucgagggcgaggguuugcacaagcugggguauauucucagggaugugaguaaaaaggaaggaggcgcaauguacgccgacgacaccgcuggcugggauacucgcaucacacuugaggaccugaagaacgaagagauggugaccaaucacauggaaggggagcauaaaaaguuagccgaggcgauuuucaaacugacauaucagaacaaggucguucgugugcagcggccaacuccuagaggaaccguaauggauauaaucuccaggcgcgaccaacgagguagcggccagguggggacguacggauugaauaccuuuacaaacauggaagcacagcucauucggcagauggagggcgaaggugucuucaaaaauauccaacaccugacugugaccgaggagguugccgugcagaacuggcuagcuagagucgggagggaacgccuuucuagaauggccaucucaggagaugacugcgugguaaagccccuggaugaccgguucgcaaacgcucucacagcccugaaugauaugggcaagauuaggaaagacauacagcagugggagccaaguaagggcuggaacgauuggacucaaguucccuuuugcucccaucacuuccaugaauugaucaugaaagacgggcguguguuagucgugccuugucgaaaucaggaugagcugauuggacgcgcuagaaucagccagggugccggcuggucucuccgggaaaccgcaugccuugggaagucguaugcgcagauguggucacugauguacuuucacaggcgcgaccuaagacuggccgcuaacgccauuuguagcgcagugccaucccacugggucccgacgagucggacaaccuggucuauccaugcuaaacacgaguggaugacuacagaggacaugcucaccguuuggaauaggguguggauacgagaaaaccccuggauggaggauaagacuccuguagaaagcugggaggaaaucccauauuugggaaagcgugaggaccaauggugcggcucccugauuggucuuaccucaagagccacaugggccaaaaauauccaggccgcgauuaaccaggugcgcagucugaucgggaaugaggaauacacggauuacaugcccucuaugaagcgguucaggagagaggaagaggaagcuggaguccucugguga

SEQ ID NO: 14772 - RNA, 9876 nt, Artificial Sequence
  derived and/or modified CDS sequence (opt3) from DENV-2__EU482451__SS-prME
agcgccggcaugaucauuaugcugauacccaccgugauggcuuuccaccucacuacucggaacggggaaccucauaugaucgucgguauucaagaaaaggguaaaucccuucuguuuaagacggaagacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacaggcgcugagcugaccgguuaugggacugugaccauggaauguagccccagaacaggccuugauuucaaugagaugguccuguugcaaauggaaaacaaggccuggcucgugcacaggcagugguuucuggacuuaccucugccauggcuccccggagcagauaagcaggagucuaauuggauccagaaagagacccuuguuacuuucaagaacccucaugcuaaaaagcaagacguggucgugcugggcucccaggaaggggccaugcacacagcguugacgggagccaccgagauacagaugucaagcgguaaucuacuguuuacuggccaucucaaaugccggcugcguauggacaaacuucaacugaaggggaugaguuacucuauguguacaggaaaauucaagguaguuaaagaaauugcagagacccagcacggcacaaucgugauccgcguccaguaugagggugauggguccccaugcaagauucccuucgaaaucauggacuuggagaaaagauacgugcucggcaggcugauuacugucaacccgauagugaccgaaaaggauagcccuguuaacaucgaggcugaacccccauuuggagacucguacauuaucaucggcguggagccugggcaguuaaagcugaauugguucaaaaagggaucuuccauuggucaaauguuugagacgaccaugcggggcgccaaacgaauggcuauacuaggggauacagccugggacuucggaucacucggcgguguauuuacaaguaucgggaaggcacugcaucaggucuucggcgccauuuauggagcugcguuuagcggcguguccuggaccaugaaaauccuuauugggguuaucauaacauggaucggaaugaacucucgcagcacuucauugagugugucccugguccucgugggcauuguaacccuguaccuuggugugaugguucaggcagauagcgggugugucgugucuuggaagaauaaggaacugaaaugcggaucaggcaucuucgugacggacaacguccacacauggaccgagcaguauaaguuucaacccgaaaguccaagcaaauuggccuccgcuauucagaaggcccaggaggaagguaucuguggcauaagaucuguuacuaggcucgagaaucugauguggaaacagauuacacccgaguuaaaccacauccuggcagaaaaugaggugaagcuaaccauuaugacuggggauaucaaaggaauaaugcaagccggcaagcggucgcuccgcccucagccaaccgaacugaaguacagcuggaaaacaugggggaaggcuaaaaugcuuuccacggagucauauaaccagaccuucuugaucgacggaccggaaacugccgagugccccaauacaaacagagcauggaauagucuggagguggaagauuacggcuuugguguauucaccacaaacauuuggcucaagcugaaagagaagcaggacgcguuuugugacucuaaguuaaugagcgcugccaucaaagauaauagggcaguccaugccgacaugggguauuggauugaauccgcucugaacgauacuuggaagaucgagaaagccucauucauagaggugaagaauugccacuggccuaaaagccauacccuuuggucuaacggaguuuuggaauccgagaugauuaucccaaagaaccucgcaggccccgugagucaacacaauuaccguccugguuaccacacgcagaucgcuggcccauggcaucuggggaagcuagaaauggacuucgauuuuugugacggaacaaccgucauugugacugaggauugcggcaaccgggggcccagccugcgaaccacaacugccucuggaaaacucaucaccgaauggugcuguagauccugcacacugccgccucuuagguaucgcggcgaggacgguuguugguacgggauggagauucggccauugaaggaaaaagaggaaaaucugguuaacucauuagugacggcgggacacggccagguagauaauuucagucucgguguccugggcauggcccuuuuucuggaggaaauguugagaaccaggguggggacuaagcaugcuauacuccugguggcagucagcuucguuacacuaaucaccggaaacaugucguuuaaagaccugggccgcgugguagugauggucggggccacuauggcugaugacauuggaaugggcgugacauaucucgcccugcuugcagcguucaagguucgacccaccuuugccgcugguuugcuguuacggaagcucacguccaaagagcugaugaugacuaccaucgggauugugcuucugucucaaagcacaaucccugagaccguccuagaacucacugaugcccuggcauugggaaugauggugcugaagauaguucguaauauggagaaauaccaguuagcugugacaaucauggccauucucugcguccccaacgcaguaauccugcagaaugccuggaaggugucauguaccauucuugcuguugugagugucuccccacuguugcucacaucuagccagcagaagacugacuggaucccucuggcgcuaaccauaaagggccugaaccccacggccauuuuccuuacaacccucuccagaacuaauaaaaagaggucauggccacugaacgaagcaaucauggcugugggcaugguaagcaucuuggccaguucucuguuaaagaaugacauuccgaugaccgggccucucguggccggaggucugcuuacagucugcuauguucugacuggccgcuccgcugauuuggagcucgaacgggcaaccgacgugaaaugggaggaucaggccgagauaagcgggucgucacccauccugucuauuacgaucagugaagacggauccaugagcauuaagaacgaggaagaggagcagacacuaaccauccugauaagaacuggccuucucgugaucucuggucuguuuccaauuagcauccccauuacagcggcugccugguacuugugggaagucaaaaagcagagggcagggguguuaugggauguuccuuccccacccccuaugggaaaagccgagcuggaagacggcgcuuaucgaaucaagcaaaagggcauacucggguacucacagauuggagcaggaguauacaaagagggcaccuuccacacuauguggcaugugacacgcggggccguccugaugcacaagggaaaacggaucgaaccgaguugggcggaugugaagaaagaccuuaucagcuauggcgguggguggaagcuggagggagaguggaaggaaggcgaggaaguucagguguuggcucuagagccaggcaaaaaucccagagccguccagaccaagccugggcuguuuaaaacgucuacuggaaccauuggugcagugucccucgauuucucaccaggcacaagugggagccccaucauagacaagaaaggaaagguagucggccuguacgguaacggggugguuaccagguccggagccuaugugucugcuauugcccaaacagaaaagucgaucgaggauaacccugagauugaagacgauaucuuucguaaacgccggcuuacuauaauggacuuacacccgggcgcaggcaagaccaaaagauaccugcccgcuauugucagggaggccaucaagcgagggcuccggacguugauccuggcgccaacacgcgugguugccgcagaaauggaggaagcucucagaggacugccuauuagguaucagacucccgccauccgggcugagcauaccggucgagagauuguggaccuuaugugucacgcaacauucaccaugagacuguugagcccaguccgcgugccuaauuacaaccuaauaaucauggaugaagcccauuucacugaccccgccucaauugcugcgaggggcuauaucuccacccguguagagaugggggaagcagccggaaucuuuaugacagcuacgccaccgggcagucgggauccuuucccccagucuaaugccccaauuauagacgaggagagagaaauccccgagaggagcuggaacuccggucacgaaugggugacugauuuuaaagggaagaccguuugguucgucccuucaauuaaggcaggaaaugacaucgccgcuugccugcgcaaaaacggcaagaaagugauucaacucucucgaaagacauuugauagcgaguacgugaaaaccaagacuaaugacugggauuucgucguaacaaccgacaucagugaaaugggcgcgaacuuuaaagccgagagagugauagauccacggagguguaugaagcccguuaucuuaacggacggggaggaacgcgugauucuggcaggaccuaugccggucacucauuccagcgcugcccagcguagaggucggaucggcaggaauccaaagaacgagaaugaccaguacauuuauaugggggaaccccuugagaacgaugaagacugcgcacacuggaaagaggccaagaugcugcucgauaauaucaacacaccugagggaauaauucccucuauguucgaaccagagcgcgaaaaaguggacgcuaucgauggcgaguaccgauugagaggugaagcccggaagaccuuuguugaccugaugaggcgcggggaucucccuguguggcuggcguauaaagucgcagccgagggcauuaauuacgcugacagaaggugguguuucgauggaaucaagaacaaccagauacuugaggaaaauguggagguagaaaucuggaccaaggagggcgagcggaaaaagcuaaaaccccguuggcuggacgcccgcauuuauucagauccauuggcuuuaaaggaauuuaaagaguucgcagccgggcgaaagucccugacucucaaccugaucacagaaaugggaagacuuccuaccuucaugacacaaaagacuagggacgcucuggauaaucucgccguguugcacacggcagaggcggguggccgggccuacaaccaugcucugagugaacuaccggagacccuggagacacuccuucuguuaacuuugcuggccaccguuacagggggaauuuuucucuuccugaugagcggccgcgguaucgggaaaaugacccuuggcaugugcugcauaauuacugcaucgauccugcucugguaugcucagauccagccccacuggauugccgcaucuaucauauuggaauuuuuccugauugucuuacuaaucccagagccugaaaagcagagaacgccccaagacaaucagcugaccuacguggugauugccauccucacagucguugcugcgacuauggccaacgagaugggauuucuugagaagaccaagaaagaccugggcuugggguccauagcaacacagcagccagagagcaauauccuggauauugaccucaggccugcuucagccuggacccuguacgccguggcaacuacauucguaacgcccaugcuucggcauaguaucgagaacucuuccgugaaugucagccucaccgcuauugccaaccaagcgacugugcugaugggauuggguaagggcuggccgcugucaaagauggauaucgggguuccauuacuagcuauuggauguuauagucaggugaauccuaucacacugaccgccgcacuccuucuguuggucgcccacuacgcuauaauuggccccggucugcaggcaaaagccacccgagaagcgcagaagagagcugccgcagggaucaugaaaaacccaacaguagacggcaucacugugauugaucucgaccccauaccuuaugauccgaaguuugagaaacaacugggacagguuaugcuuuuaauccugugcgugacgcagguccucaugaugcgcaccacaugggccuugugugaagcucugacucuagccaccggccccauuagcacacugugggaggggaauccaggaagguucuggaacaccacuaucgcaguguccauggcuaauauuuuucggggcucuuaccucgccggugcggggcuucuguucagcaucaugaagaacacgacaaauacccguagaggaacuggcaacauaggugaaaccuugggcgagaaauggaaguccaggcugaacgcccucgggaagucagaguuucaaacauauaaaaagucuggaauccaggaagucgaccgcacucuggcaaaagagggcauuaagagaggggaaaccgaucaccaugcugugagucgaggaucggccaaauuaagaugguucguugagaggaauauggugacaccugagggcaagguaguggaccuugguugcgggcgcggaggcuggagcuacuauugugguggccugaagaacguccgggaaguuaaagggcucacgaagggaggccccgggcacgaggaaccuaucccaauguccaccuacggauggaaucuagugagacugcagucuggcgucgauguguuuuucauucccccugagaaaugcgacacuuugcugugugauaucggugaaucaagcccaaaccccacaguagaggcagggcguacccucagggugcuuaaucugguugagaacugguugaauaacaauacucaguucugcauaaaggugcugaacccguacaugccuuccgucauugagaaaauggaggcucuccaacggaaguauggaggcgccuuagugcgcaauccacugagucgaaacucuacacaugaaauguacugggucagcaaugccucaggcaacaucguguccaguguuaauaugaucagcagaaugcuuauuaacagguuuaccaugcggcacaagaaagcgacguaugagcccgacguagaccuggggucuggaacccgcaacauagguaaugaauccgagaucccuaaccuagauauuaucggcaagagaauugagaaaaucaagcaggaacaugagacaucauggcacuacgaccaggaucacccauauaaaacuugggcuuaccaugggagcuaugaaaccaagcagacaggaucggcaucuaguauggugaauggcgucgugaggcuccugacuaagcccugggacguuuugccgaccgugacacaaauggccaugaccgauacuacgccuuucggucagcagcgagucuuuaaagagaagguggacacacggacccaggaacccaaagaggggacuaagaaacugaugaagauaaccgcugaguggcucuggaaagaacuuggaaagaagaaaacaccacguauguguacgagagaggaguucacccgcaagguaagguccaacgccgcacugggcgccaucuuuacugaugagaauaaauggaaaagcgcucgggaggcgguggaagacucaagauucugggaguuaguugauaaagaacgcaaccugcacuuggagggcaagugcgaaacaugugucuacaauaugauggggaagagggagaaaaagcucggagaguuugguaaagccaagggcucccgagcaauuugguacauguggcugggggcucgguuccuagaauuugaggcccuuggauuccugaacgaagaccauugguuuucuagagagaauagccucaguggcguggaaggugaggggcugcacaaauugggauauauccugagggauguguccaagaaggagggcggcgcaauguacgccgacgacaccgcugggugggauacucgcauuacacucgaagaccuuaaaaacgaggaaauggucaccaaucacauggagggagaacauaagaaacuggccgaggcgaucuucaaguuaacauaucaaaacaaaguugugcguguacagcggccuacucccagagguaccgugauggauauuauaagcaggcgcgaccagcgaggcucugggcaagucggaacguacggccugaauaccuuuacaaacauggaggcacaguugauccggcagauggaaggugaggggguguucaagaauauucagcaccucacuguuaccgaagagguggccguccaaaacuggcuggcuagagugggaagggagcgccuaucaagaauggccaucaguggcgaugacugcguaguuaagccacuugaugaccgguucgcaaacgcucugacagcccucaaugauaugggcaaaaucaggaaggacauucagcagugggaacccuccaaaggguggaacgauuggacucaggugccuuuuugcagccaucacuuccaugagcugauaaugaaggacggacgugucuugguggugccaugucgaaaucaagaugaauuaaucggucgcgcuagaauuucucagggcgccggguggucgcugcgggagaccgcaugccucggaaaaucauaugcgcagauguggagccuuauguacuuucacaggcgcgaccugagacuagccgcuaacgccaucuguuccgcagucccgagucacuggguucccacgucucggacaaccuggagcauucaugcuaagcacgaauggaugacuacagaggacaugcugaccguguggaauaggguauggauccgagagaacccuuggauggaagauaagacuccaguggaguccugggaagagauacccuaucucggcaaacgugaagaccaguggugcgguucauugaucgggcugaccaguagagccacaugggcaaagaauauucaagucgccaucaaccaggugcgcucucuuauuggaaaugaggaguacacggauuacaugccuagcaugaaacgguucaggagagaagaggaagaggcgggcguucugugguga

SEQ ID NO: 14773 - RNA, 9876 nt, Artificial Sequence
  derived and/or modified CDS sequence (opt3) from DENV-2__EU660413__SS-prME
agcgcaggaaugauaauuaugcugauaccaaccgugauggcuuuccaccucacaacuagaaacggggaaccucauaugaucguaggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggagagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggauucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacaggguucgauuuuaaugaaaugguccuucugcaaauggagaacaaggccugguuggugcacaggcagugguuccucgaccugccuuuaccauggcugcccggcgcagauaagcaggagucuaauuggauccagaaagaaacccucguuacuuuuaagaacccucaugcuaaaaagcaagacguggucauacuuggaucccaggagggcgccaugcacacagcgcugacgggggccaccgaaauucagaugucaagcggaaauuugcuauucacuggucaucugaaaugccggcuccguauggacaagcugcaacuuaagggcaugaguuacucuauguguacagggaaauucaaggugguaaaagagaucgcagagacccagcacggaacaaucguuauucgcgugcaguaugaaggcgaugguuccccaugcaagauccccuuugagauuauggaccuggagaagagauacgucuuggggaggcucauaacugugaacccgaucgucaccgagaaggauagcccugugaacauugaagcugagcccccauucggcgacucguacaucaucauuggaguugagccuggccagcugaaguuaaauugguuuaaaaaggggucuuccauaggacaaauguucgaaacgaccaugcggggugccaaacgaauggcuauccugggcgauacagccugggacuuugggucacuaggaggcguguucacaaguauugguaaggcacuccaucagguauuuggggccaucuauggcgcugcguucagcggagucuccuggaccaugaaaauucugaucggcgugauaaucacauggauugggaugaacucucgcagcacuucacuuaguguuuccuuggugcuggucggaaucgugacccucuaccugggcguaauggugcaggcagauagcgguuguguugucucuuggaagaauaaggagcuuaaaugcgggucaggaauuuuuaucacggacaacgugcacacauggaccgaacaguauaaguuccaacccgagaguccaagcaaacuggccuccgcuauacagaaggcccaggaagagggcauuugugguaucagaucugugacuagguuggagaaucucauguggaaacagauuacacccgaacugaaccacaucuuagcagagaaugaagucaagcugaccauaaugacuggcgauauccgggggauuaugcaagccggaaaacgcucgcuaagaccucagccaaccgagcucaaguacagcuggaagacauggggcaaagcuaagaugcuguccacggaaucauauaaccagaccuuucuuaucgacgggccggagacugccgagugccccaauacaaacagggcauggaauaguuuggaaguugaggauuacggauucggcguguuuaccacaaacauuuggcugaaacucaaggaaaaacaggacgcguucugugacucuaagcugaugagcgcugccaucaaggauaaucgugcagugcaugccgacauggguuauuggauagaguccgcuuuaaacgauacuuggaaaauugagaaggccucauucaucgaagucaagaauugccacuggccuaagagccauacccuguggucuaacgggguccuugaguccgaaaugaucauucccaaaaacuuggcaggacccgugagucaacacaauuaccggccuggcuaccacacgcagaucgcugguccauggcaucucggcaagcuggagauggacuuugauuucugugacgggacaaccguuauugugacugaagauugcggaaaccgaggccccagccuaagaaccacaacugccucugggaagcugauaaccgaguggugcuguagguccugcacacucccgccucugcgcuaucggggagaggacggcuguugguacgguauggaaaucagaccacuuaaagagaaggaagagaauuuggucaacucacuggugacggcggggcacggacagguugauaauuuuaguuuaggcgugcucgguauggcccuguuccuugaagagaugcugaggacccgcguaggcacuaaacaugcuauuuugcucgucgcagugagcuuugugacacugaucaccgggaacaugucguucaaggaccuaggacgagucguugugaugguaggcgccacuauggcugaugacauugggaugggagugacauaucuggcccuccuggcagcguuuaaaguccggcccaccuucgccgcuggccuuuugcugcguaaguuaacguccaaggagcucaugaugacuaccaucgguauagugcugcuuucucaaagcacaaucccugaaaccguucuggagcuaacugaugcccucgcacuggggaugaugguguugaaaauugucagaaauauggaaaaguaccagcuggcugugacaaucauggccauuuuaugcguucccaacgcagugauccuccagaaugccuggaaagucucauguaccauacuggcuguagugaguguuuccccacuucuguugacaucuagccagcaaaagacugacuggauuccucucgcgcugaccaucaaaggacuaucccccacggccaucuuucugacaacccuuucaaggagcaacaagaaacgcaguuggccacucaaugaggcaauuauggcugugggcauggucucuauacuggccuccagcuugcugaagaacgacaucccgaugacuggcccuuuaguggccgggggacuccugaccguaugcuaugugcuuacaggucggucggcugaucuggaauuggagagagcaacugacgucaagugggaggaucaggccgaaauuucaggcucuagucccauccucuccauuaccaucagcgaggacgggucuaugagcaucaaaaaugaagaggaggaacagacgcugacaauccuaauuaggaccggacugcuuguuaucuccggccucuucccaauuucaauccccauaacugcggcugccugguaccugugggaggugaagaaacagcgagccgguguguugugggaugucccuaguccacccccuauggggaaggccgaauuagaggacggagcuuaucgcauuaaacaaaagggcauccugggcuacagccagaucggggcaggaguguacaaggaagguacauuucacaccauguggcauguuacucggggcgccguacucaugcacaaagggaagagaauugagccgucuugggcggaugugaaaaaggaccugaucuccuauggaggcgguuggaaacuugagggggaauggaaggagggagaagagguccaggugcuggcuuuggaaccaggcaagaaccccagggccguucagacaaaaccuggccuauucaagaccaauacggggacuauaggagcagugucacuggauuuuaguccagguaccagcggcucccccauuaucgacaaaaaggggaaagucgugggacucuacggcaacgguguagucacacguucuggggccuaugugucggcuauugcccaaaccgaaaagagcaucgaggauaacccugaaauagaggacgauauuuuccgcaagcggagacugacaaucauggaccuucacccgggagcaggcaaaacuaagagguacuuacccgcuaucguucgagaagccauuaaacggggccugcgcacccucaucuuggcgccaacgagaguggucgccgcagagauggaagaggcucugagggggcucccuauucgguaucagacacccgccauacgagcugagcauacuggaagagaaaucguggaccugaugugucacgcaaccuucacaaugcgccuucugucaccaguuagggugccuaauuacaacuugauuaucauggaugaggcccauuuuaccgaccccgccuccaucgcugcgcgugguuauauuaguacucgggucgaaaugggcgaggcagccgggauauucaugaccgcuacaccaccgggaucuagagauccuuuuccccagagcaaugccccaaucauugacgaggaaagggagauccccgaacgcuccuggaacucaggccacgagugggugacggauuucaaggguaaaacuguaugguuugugccuucuauuaaggcagggaaugacaucgccgcuugccuacgaaagaacggcaaaaagguuauacaacugagcagaaaaaccuucgauagugaauacgucaagacacggaccaaugacugggauuuuguggugacuacagacaucuccgagaugggcgcgaacuucaaagccgagagggucauugauccacgccguuguaugaagcccguaauccucaccgacggcgaagagagagugauuuuagcagggccuaugccgguuacgcauagcucugcugcccagcggaggggacgcaucggucgaaaucccaaaaacgaaaaugaccaguacauauauaugggcgagccccuggaaaacgaugaggacugcgcacacuggaaggaggccaagaugcuucuggauaauauuaacacuccugaagggaucauucccucaauguuugagccagaaagagagaaaguggacgcuaucgauggagaauaccggcucaggggcgaggcccgcaagacauucgucgacuugaugagaaggggugaucugccuguguggcucgcguauaaaguugcagccgaggggauaaauuacgcugaccggcguugguguuuugauggcaucaagaacaaccagauucuggaagagaauguggaagucgagaucuggaccaaagagggagaacgcaagaaacuuaaaccccgauggcuagacgccagaauuuauuccgauccacuggcuuugaaggaguucaaagaguucgcagccggcaggaagaguuuaacccugaaccucaucacugagauggggcggcugccuacauuuaugacccagaaaacucgcgacgcucuugauaaucuggccgugcuccacacugcagaagcgggagguagagccuacaaccaugcuuugagcgagcugccggagacgcuagaaacccugcuccuucugacauuauuggccacuguaaccggcgggauauuccuguuucucaugucgggaaggggcauugguaagaugacacuggggaugugcugcaucaucaccgcaucuauucuucugugguaugcucaaauccagccccacuggauagccgcauccauuauccucgaguucuuuuugauugugcuguuaaucccagaaccugagaagcagcggacuccccaagacaaucagcuaacguacguugucauagccauccugaccgugguggcugcgacaauggccaacgaaaugggcuuccucgagaaaacuaagaaagaccuuggacugggcgggauugcaacccagcagccagagagcaauaucuuggauauugaccugcgaccugcuucagccuggacacucuacgccgucgcaaccacuuuuguuacacccaugcugagacauaguaucgaaaacucuuccgugaauguaagccuuacggcuauugccaaccaagcgaccgugcucaugggacuggguaagggcuggccguugucaaaaauggauaucggggucccacuguuagcuauaggauguuauagucaggugaauccuauuacucuaacagccgcacugcuccuucugguugcccacuacgcuaucaucggccccgguuugcaggcaaaggccacccgcgaggcgcagaagagggcugccgcagggauuaugaaaaacccaaccguggacggcauaacagucaucgaucuggaccccauuccuuaugauccgaaguucgaaaaacaacucggacagguaaugcugcuuaucuuaugcgugacucagguucugaugaugcggacgaccugggcccucugugaggcuuugacacuggccacuggccccauuagcacccuaugggaagggaauccaggacguuuuuggaacacaaccaucgcaguguccauggcuaauauauucagaggcucuuaccuggccggugcggggcuccuuuuuagcaucaugaagaacacuacgaauacaaggcgcggaaccggcaacauuggugagacucugggcgagaaauggaagucccgguugaacgcccuggggaaaucagaguuccaaaucuauaagaagucuggcauucaggaggucgaccgaacccucgcaaaagaaggcaucaagagaggggagacagaucaccaugcugugaguaggggaucggccaaacugcgcugguuugucgagcggaauauggugacuccugaaggcaagguuguggacuuagguugcgggagaggaggcuggagcuacuauugugguggccuuaaaaacguacgugaggugaaggggcugaccaagggaggccccgggcacgaagaaccuauaccaauguccacauacggauggaaucucgucaggcuacagucuggcguugauguguucuucauucccccugaaaaaugcgacacgcuguugugugauaucggugagucaagcccaaaccccaccgucgaggcagggcggacucugcgcgugcucaaucuuguagaaaacuggcugaauaacaauacacaguuuugcaucaagguguugaacccguacaugccuuccguuauugagaaaauggaagcucugcaacgaaaguauggaggcgcccucgugagaaauccauuaaguaggaacucuacccaugagauguacugggucagcaaugccucaggcaacauaguguccagugucaauaugaucagccggaugcugauuaaccgcuucacuaugagacacaaaaaggcgacauaugaacccgacguggaccuugggucuggaaccaggaacaucgguauugaguccgagaagccuaaucuggauaucauaggcaaacgaaucgaaaagauuaaacaggagcaugaaacgucauggcacuacgaccaggaucacccauauaagaccugggcuuaccaugggagcuaugagacaaaacagacuggaucggcaucuaguaugguuaacggcguagugcggcuacucaccaagcccugggacguccugccgacagugacucaaauggccaugaccgauacaaccccuuuuggucagcagcguguuuucaaggaaaaaguggacacuagaacgcaggagcccaaggaggggaccaaaaaguugaugaaaaucacagcugaauggcuguggaaggagcucggcaaaaagaagacuccacgcauguguaccagggaagaguuuacacggaaagucagauccaaugccgcacuuggcgccauuuucacggaugagaacaaguggaaaagcgcucgcgaagcgguggaggacucaagguuuugggaacugguagauaaggagcgaaauuuacaccuggaaggcaaaugcgagaccuguguguacaacaugauggggaagcgggagaagaaauugggagaguucgguaaggccaaaggcuccagagcaaucugguacauguggcucggggcuagguuucuggaguucgaagcccuaggauuucuuaaugaggaccauugguucucucgcgaaaacagccugaguggcguugagggugaggggcuccacaagcugggauauauuuugcgugaugucuccaaaaaggaaggcggcgcaauguacgccgacgacacugcugggugggauacacggauaacccuggaggaccucaagaaugaagagauggugacuaaccacauggaaggagagcauaagaaacuugccgaggcgaucuuuaaacugacauaucaaaauaaaguggucagaguucagaggccuaccccacgcgguacagugauggauauuaucagccgacgggaccagagaggcucugggcaaguaggaacuuacggcuuaaacaccuucacgaauauggaagcacagcugaucaggcagauggagggugaagggguguucaaaaacauucagcacuugaccgucacagaggagguggccguucauaauuggcucgcucgcgugggaagagaacggcugucaaggauggccauaaguggcgaugacugcgucgugaagccacuagaugaccguuuugcaaacgcucuuacugcccugaacgauaugggcaagauccgaaaagacauucaacagugggagcccuccaagggguggaaugauuggacccagguaccuuucugcagccaccauuuucacgaacucaucaugaaagacggacgcguucugguggucccauguagaaaccaggaugaguugauuggucgggcuaggaucucucaaggcgccggguggucguuacgcgaaacagcaugccugggaaagucauaugcgcagauguggagccucauguacuuccacagacgggaccuuaggcuggccgcuaaugccauauguuccgcagugccgagucauugggugcccacuucucgaaccacguggagcauccacgcuaaacaugaguggaugacaaccgaggacaugcuaacugucuggaaccguguuuggauuagagaaaauccuuggauggaggauaagacaccaguggaauccugggaggaaauccccuaucugggcaagcgcgaggaccaguggugcgguucacucauuggguugaccagucgggccacuugggccaaaaacauccaggccgcgauaaaucaaguaaggucucugauuggaaacgaggaauacaccgauuacaugccuagcaugaagagauuucgccgggaggaagaggaagcuggcgugcuuugguga

SEQ ID NO: 14774 - RNA, 9876 nt, Artificial Sequence
  derived and/or modified CDS sequence (opt3) from DENV-2__EU660414__SS-prME
agcgcaggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuugggugcugaggcauccuggcuucaccauaauggccgcaaucuuggccuacacaauuggcaccacgcacuuucagcggguucucaucuucauucugcugacugcuguggcaccaucuaugacaaugcgcugcaucgggauaucgaacagagauuuugucgaaggagugucagguggcagcuggguagacauuguucucgagcacgggaguugugugaccacuauggccaagaauaagcccacauuagauuucgaacugaucaaaaccgaggcuaagcagccugccacgcuuaggaaauauugcauugaagcgaaguugaccaacacaacuaccgagucccgguguccaacacaaggagagcccucucugaaagaagaacaggacaagcgcuuugucugcaagcauagcaugguggaucgaggcugggguaauggguguggacuauucggcaaaggcgggaucgugacuugcgcaauguuuaccugcaagaaaaacauggaaggaaagaucguccagccugagaaucucgaauacacaauuguugugaccccacacuccggugaggagcaugccguaggcaacgacacugggaaacacggacaggaaauaaaggugacgccgcaaucaaguaucacagaggcugaacugaccggcuaugguacugucaccauggaguguagccccagaacagggcuugauuucaaugaaauggugcuguugcagauggagaacaaagccuggcucguucacaggcagugguuucuggacuuaccucugccauggcuccccggcgcagauaagcaggagucuaauuggauucaaaaggaaacccuugugacuuucaaaaacccucaugcuaagaaacaggacgucgugguacugggaucccaggagggcgccaugcacacagcguugacgggggccaccgaaauccaaaugucaagcggaaaucuacuguuuacuggucaucucaagugccggcugcguauggacaaacuucagcugaagggcaugaguuacucuauguguacagggaaguucaaaguugugaaggagauagcagagacccagcacggaacaauugucauccgcgugcaguaugaaggcgaugguuccccaugcaaaauccccuucgagauuauggacuuggaaaagagauacguccucgggaggcugaucacugugaacccgauuguuaccgagaaagauagcccugugaacauagaagcugagcccccauuuggcgacucguacaucauuaucggaguagagccuggccaauuaaagcugaauugguucaagaaagggucuuccaucggacagauguuugaaacgaccaugcggggugccaagcgaauggcuauucuaggcgauacagccugggacuucgggucacucggaggcgucuuuacaaguauagguaaagcacugcaucagguguucggggccaucuauggcgcugcguuuagcggaguuuccuggaccaugaagauucuuaucggcgugauuaucacauggauagggaugaacucucgcagcacuucauugagugucucccuggugcucguaggaaucgugacccuguaccuuggcguuaugguccaggcagauagcgguuguguggugucuuggaaaaauaaggagcugaagugcgggucaggaauuuucaucacggacaacguccacacauggaccgaacaauauaaauuucagcccgagaguccaagcaaguuggccuccgcuauucagaaagcccaggaagagggcaucugugguauaagaucuguuacuaggcucgagaaucugauguggaagcaaauuacacccgaauuaaaccacauccuggcagagaaugaagugaaacuaaccauuaugacuggcgauaucaaggggauaaugcaggccggaaaacggucgcuccgcccucagccaaccgagcugaaguacagcuggaagacauggggcaaagcuaagaugcuuuccacggaaucauauaaccagaccuucuugaucgacgggccggagacugccgagugccccaauacaaacagagcauggaauagucuggaaguggaggauuacggauuuggcguauucaccacaaacauuuggcucaaacugaaggaaaaacaagacgcguuuugugacucuaaguuaaugagcgcugccaucaaggauaauagggcaguccaugccgacauggguuauuggauugaguccgcucugaacgauacuuggaaaaucgagaaggccucauucauagaagugaaaaauugccacuggccuaagagccauacccuuuggucuaacgggguuuuggaguccgaaaugauuauccccaagaaccucgcaggacccgugagucagcacaauuaccguccuggcuaccacacgcagaucgcugguccauggcaucugggcaagcuagagauggacuucgauuuuugugacgggacaaccgucauugugacugaagauugcggaaaccggggccccagccugcgaaccacaacugccucugggaagcucaucaccgaguggugcuguagauccugcacacugccgccucuuagguaucgcggagaggacggcuguugguacgguauggaaauucggccauugaaagagaaggaagagaaucugguuaacucauuagugacggcggggcacggacaaguagauaauuucagucucggcguccuggguauggcccuuuuucuggaagagauguugagaaccagggugggcacuaaacaugcuauacuccugguggcagucagcuucguuacacuaaucaccgggaacaugucguuuaaggaccugggacgcgugguagugauggucggcgccacuauggcugaugacauugggaugggagugacauaucucgcccugcuugcagcguucaaaguucgacccaccuuugccgcuggcuugcuguuacggaagcucacguccaaggagcugaugaugacuaccaucgguauugugcuucugucucagagcacaaucccugaaaccguccuagagcucacugaugcccuggcauuggggaugauggugcugaaaauaguucguaauauggaaaaguaccaguuagcugugacaaucauggccauucucugcguccccaacgcaguaauccugcagaaugccuggaaagugucauguaccauucuugcuguugugagugucuccccacuguugcucacaucuagccaacagaagacugacuggaucccucuggcgcuaaccauaaaaggacugaaccccacggccauuuuccuuacaacccucuccagaacuaauaagaaaaggucauggccacugaacgaggcaaucauggcugugggcaugguaagcaucuuggccaguucucuguuaaagaaugacauuccgaugaccggcccucucguggccgggggacugcuuacagucugcuauguucugacuggucgcuccgcugauuuggaacucgagcgggcaaccgacgugaagugggaggaucaggccgaaauaagcggcucgucacccauccugucuauuacgaucagugaggacggguccaugagcauuaaaaacgaagaggaggaacagacacuaaccauccugauaagaacuggacuucucgugaucucuggccuguuuccaauuagcauccccauuacagcggcugccugguacuugugggaggucaagaaacaaagggccgguguguuaugggauguuccuuccccacccccuauggggaaggccgaacuggaggacggagcuuaucgaaucaaacagaagggcauacucggcuacucacagauuggggcaggaguauacaaggaagguaccuuccacacuauguggcaugugacacgcggcgccguccugaugcacaaagggaagcggaucgagccgaguugggcggaugugaaaaaggaccuuaucagcuauggaggcgguuggaaacuggagggggaauggaaggagggagaagagguucagguguuggcucuagaaccaggcaagaaucccagagccguccaaaccaaaccuggccuguuuaagacgaacacugggaccauuggagcagugucucucgauuucuccccagguacaucaggcagucccaucauagacaaaaaggggaaaguagucggacuguacggcaacggugugguuaccaggagcggggccuauguguccgcuauugcccagacagagaagucuaucgaggauaauccugaaauugaggacgauaucuuucguaagcgccggcuuacuauaauggacuuacacccgggagcaggcaaaaccaagagauaccugcccgcuauugucagggaagccaucaaacgaggccuccggacguugauccuggcgccaacacgcgugguugccgcagagauggaagaggcucucagagggcugccuauuagguaucagacucccgccauccgggcugagcauaccggacgagaaauuguggaccuuaugugucacgcaacauucaccaugagacuguugucgccaguccgcgugccuaacuacaaucuaauaaucauggaugaggcccauuucacugaccccgccagcauugcugcgagggguuauaucucaacccguguagaaaugggcgaggcagccgggaucuuuaugacagcuacgccaccgggaaaccgggauccuuucccccaauccaaugccccaauuauagacgaggaaagagagauccccgaaaggaguuggaacucuggccacgagugggugacugauuuuaaggguaaaaccguuugguucgucccuagcauuaaggcagggaaugacaucgccgcuugccugcgcaagaacggcaagaaggugauucagcucucccgaaaaacauuugauucagaauacgugaagaccagaaucaaugacugggauuucgucguaacuacagacauaucugagaugggcgcgaacuuuaaagccgagcgggugaucgauccaaggcgcuguaugaagcccguuauuuuaaccgacggcgaagaacgugugauccuggcagggccuaugccggucacgcauagcagugcugcccagagacggggaaggauuggucgcaaucccaaaaacgaaaaugaccaguacaucuauaugggcgagccccuugaaaacgaugaggacugcgcacacuggaaggaggccaagaugcugcucgauaauauaaacacuccugaagggauuauccccuccauguucgagccagaacgagagaaaguggacgcuauugauggagaauacagauugcggggcgaggccaggaagacauuuguugaccugaugcgcagaggugaucucccuguguggcuggcguauaaagucgcagccgaggggaucaacuacgcugacaggcggugguguuucgauggcauaaagaauaaccaaauccuugaagagaauguggaaguagagauuuggaccaaagagggagaacguaagaagcuaaaaccccgcuggcuggacgcccgaaucuauagcgauccauuggcuuuaaaggaguuuaaagaguucgcagccggcagaaagucucugacccucaaccugauuacugagauggggaggcuuccuacauucaugacccagaaaacacgggacgcucuggauaaucucgccguguugcacacugcagaagcgggaggucgcgccuacaaccaugcucugucagagcuaccggagacgcuggaaacccuccuucuguuaacauugcuggccacuguuaccggcgggaucuuucucuuccugauguccggaagaggcauagguaagaugacacuugggaugugcugcauuaucaccgcaaguauccugcucugguaugcucagauucagccccacuggaucgccgcaagcauaauuuuggaguuuuuccugaucgucuuacuaauuccagaaccugagaagcaaaggacuccccaggacaaucagcugacguacguggugaucgccauacucaccgucguugcugcgacaauggccaacgaaaugggcuuucuugagaaaacuaagaaagaccugggauugggcucgaucgcaacccagcaaccagagucuaauauucuggauaucgaccuccggccugcuuccgccuggacacuguacgccguggcaaccacuuucguaacacccaugcuucgacauagcauugaaaacucaagugugaaugucucucucacggcuaucgccaaccaggcgaccgugcugaugggguugggaaaggguuggccgcuguccaaaauggauauuggcguuccauuacuagcuaucggguguuauagccaggugaauccuauaacucugacagccgcacuccuucuguuggucgcccacuacgcuauuaucggacccggccugcaggcaaaggccaccagagaggcgcaaaagcgcgcugccgcagguaucaugaaaaacccaaccguagacgggauuacagugauagaucucgaccccaucccuuaugauccgaaguuugaaaaacagcugggccagguuaugcuuuuaauucugugcgugacucaaguccucaugaugaggacgaccugggccuugugugaggcucugacacuagccacuggacccaucucaacccugugggaaggcaguccagggcgguucuggaauacaaccauugcagugagcauggcuaacaucuuucguggauccuaccucgccggcgcgggucuucuguucucuauaaugaagaauacuacgaacacaagaagggggaccggaaacaugggcgagacuuugggugagaaauggaaaagccgccugaaugcccucggcaaauccgaauuucagaucuauaagaagucagggauucaggaggucgaccggacccuggcaaaagaaggaaucaagcgaggcgagacagaucaccaugcugugucuagagggagugccaaauuaaggugguucguugagcgcaacauggugacuccugaaggaaagguaguggaccuuggcugcgguagagggggauggucguacuauuguggcggucugaaaaaugucagagagguuaagggccucaccaaagggggacccggccacgaggaaccuauuccaaugagcacauacggguggaaccuagugcgucugcaguccggagucgauguguuuuucaucccaccugaaaaaugcgacacguugcugugugauauaggcgagucuucaccaaaucccaccguagaggcagguaggacucuccgggugcuuaaccugguugaaaauugguugaacaauaacacacaauucugcauuaaggugcugaauccguacaugccuagcgucaucgagaaaauggaagcucuccagcgcaaguaugggggagccuuagugcgaaacccacuguccagaaauaguacccaugagauguacugggucucuaacgccagcggcaauaucgugucauccguuaacaugauuaguaggaugcuuauaaaccgguuuacuaugcgccacaaaaaggcgacauaugaacccgacguagaccugggcagcgggaccagaaauaucggaauugagucugagacgccuaaccuagauaucauugguaagaggaucgagaaaauaaagcaggagcaugaaaccuccuggcacuacgaccaggaucacccauauaaaacaugggcuuaccauggcucauaugagacuaagcaaaccgggagcgcaucgucuauggugaauggagucgugcgacuccugacaaaacccugggacguuuugccgacugugacccagauggccaugacagauaccacuccuuucggccagcagcgggucuuuaaggaaaagguggacacgcguacacaagagcccaaagaggguaccaagaaacugaugaagaucacugcugaauggcucuggaaagagcuugggaagaaaaagaccccaagaauguguacacgcgaagaguucacgaggaagguacggaguaacgccgcacugggagccauuuuuaccgaugagaauaaauggaaguccgcuagagaagcgguggaggacagccgcuucugggaauuaguugauaaagagaggaaccugcacuuggaaggcaagugcgagacuugugucuacaauaugaugggcaaacgagagaagaagcucggggaauuuggaaaagccaaggguucacgggcaaucugguacauguggcugggcgcuagauuccuagaguuugaagcccuuggguuccugaacgaggaccauugguuuuccagggaaaauucucucagcggaguggagggcgagggucugcacaaauugggguauauucugcgcgaugugaguaagaaagaaggaggcgcaauguacgccgacgacacagcuggcugggauacccguaucacucucgaggaccuuaagaacgaagagauggucacaaaucacauggaaggggagcauaagaaacuggccgaggcgauuuucaaguuaaccuaucagaacaaaguugugcggguacagagaccuacacccaggggaacugugauggauauaaucucccgccgagaccaacgggguagcggccaggucgggaccuacggacugaauacguuuaccaacauggaagcacaguugauuagacagauggagggcgaagguguguucaagaauauccaacaccucacaguuacugaggagguggccguccagaacuggcuggcuaggguggggcgcgaaagacuaucucggauggccaucucaggagaugacugcguaguuaaaccacuugaugacagguucgcaaacgcucugaccgcccucaaugauaugggcaagauucguaaggacauacagcagugggagcccaguaaaggcuggaacgauuggacacaagugccuuuuugcucccaucacuuccaugaacugaucaugaaggacgggcgagucuugguggugccaugucgcaaucaggaugaguuaauugguagagcucggaucagccagggagccggcuggucucugagggaaacugcaugccucgggaaaucguaugcgcagauguggucacuuauguacuuucaccgcagagaccugcggcuagccgcuaacgccauuuguagcgcagucccgucccacuggguucccaccaguaggacgacauggucuauccaugcuaagcacgaguggaugaccacugaggacaugcugacaguguggaaucgaguauggauacgugaaaacccuuggauggaggauaaaaccccaguggaaagcugggaggaaauccccuaucucggaaagagagaggaccaauggugcggcuccuugauuggucugacuucacgcgccaccugggcaaagaauauccaggucgccauuaaccaggugcggagucuuaucgggaaugaggaauacacagauuacaugccuucuaugaaaagguucagacgcgaggaagaggaagcgggaguucugugguga

SEQ ID NO: 14775 - RNA, 9876 nt, Artificial Sequence
  derived and/or modified CDS sequence (opt3) from DENV-2__EU660415__SS-prME
agcgccggcaugauaauuaugcugauacccaccgugauggcuuuccaccucacuacuagaaacggggagccucauaugaucgucgguauucaagaaaaggguaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagcgguacgugcucgggaggcugauuacugucaacccgauagugaccgagaaggauagcccuguuaacaucgaagcugagcccccauuuggcgacucguacauuaucaucggagugggcccugggcaguuaaagcugaauugguucaaaaagggaucuuccauuggucaaauguuugagacgaccaugcggggcgccaaacgaauggcuauacuaggggauacagccugggacuucggaucacucggcgguguauuuacaaguaucgggaaggcacugcaucaggucuucggcgccauuuauggagcugcguuuagcggcguguccuggaccaugaaaauccuuauugggguuaucauaacauggaucggaaugaacucucgcagcacuucauugagugugucccugguccucgugggcauuguaacccuguaccuuggugugaugguucaggcagauagcgggugugucgugucuuggaagaauaaggaacugaaaugcggaucaggcaucuucauuacggacaacgugcacacauggaccgagcaguauaaguuucaacccgaaaguccaagcaaauuggccuccgcuauccagaaggcccaggaggaagguauauguggcauuagaucugucacuaggcucgagaaucugauguggaaacagaucacacccgaguuaaaccacauucuggcagaaaaugagguuaagcuaaccaucaugacuggggauauaaaaggaaucaugcaagccggcaagcggucgcuccgcccucagccaaccgaacugaaguacagcuggaaaacaugggggaaggcuaaaaugcuuuccacggagucauauaaccagaccuucuugauugacggaccggaaacugccgagugccccaauacaaacagagcauggaauagucuggagguggaagauuacggcuuugguguguucaccacaaacaucuggcucaagcugaaagagaagcaggacgcguuuugugacucuaaguuaaugagcgcugccauuaaagauaauagggcaguacaugccgacaugggguauuggaucgaauccgcucugaacgauacuuggaagauagagaaagccucauucauugaggucaagaauugccacuggccuaaaagccauacccuuuggucuaacggaguguuggaauccgagaugaucaucccaaagaaccucgcaggccccguuagucaacacaauuaccgucuggguuaccacacgcagauugcuggcccuuggcaucuagggaagcuggaaauggacuucgauuuuugugacggaacaaccgugaucgucacugaggauugcggcaaccgggggccaagccuccgaaccacaacugccucuggaaaacugauuaccgaauggugcuguagauccugcacacuucccccguugagguaucgcggcgaggacgguuguugguacgggauggagauacggccucugaaggaaaaagaggaaaauuuagugaacucacucguuacggcgggacacggccagguggauaauuucagucuggguguacuuggcauggcccuguuuuuggaggaaaugcucagaaccagggucgggacuaagcaugcuauccugcuaguggcagugagcuucgucacacugauuaccggaaacaugucguuuaaagaccucggccgcguugugguaauggugggggccacuauggcugaugacaucggaaugggcgucacauaucuggcccuuuuggcagcguucaaggugcgaccaaccuuugccgcuggucuguuacuccggaagcugacguccaaagagcuuaugaugacuaccauugggaucguucugcuaucucaaagcacaauacccgagaccgugcucgaacugacugaugccuuggcacugggaaugauggucuuaaagaucgugcguaauauggagaaauaccagcucgcuguuacaauuauggccauccugugcgugccuaacgcagucauucuucagaaugccuggaagguaucauguaccauccuggcugugguuagugugucccccuugcuccugacaucuagccagcagaaaacugacuggauaccacuagcgcugaccauuaagggccuuaacccuacggccaucuuccucacaacccuguccagaacuaauaaaaagaggucauggcccuugaacgaagcaaucauggcugucggcauggugagcauucuggccaguucuuuacucaagaaugacauaccaaugaccgggccgcugguagccggaggucuucugacagugugcuaugucuugacuggccgcuccgcugaucucgagcuggaacgggcaaccgacguuaaaugggaggaucaggccgagaucagcgggucgucaccuauucuaucuaucacgauuagugaagacggauccaugagcaucaagaacgaggaagaggagcagacacugaccauacuuaucagaacuggccuccuggugauuucugguuuguuucccaucagcauuccaaucacagcggcugccugguacuuaugggaagugaaaaagcagagggcagggguccugugggaugugcccuccccuccacccaugggaaaagccgagcucgaagacggcgcuuaucgaauaaagcaaaagggcauucugggguacucacagaucggagcaggaguuuacaaagagggcaccuuccacacuauguggcauguaacacgcggggccgugcuuaugcacaagggaaaacggaucgaaccuaguugggcggaugucaagaaagaccugauuagcuauggcgguggguggaaguuggagggagaguggaaggaaggcgaggaagugcagguucuagcucuggagccgggcaaaaauccaagagccgugcagaccaagcccgggcucuuuaaaacgaacacuggaaccaucggugcagucucucuggauuucuccccuggcacaucagggaguccaauaauugacaagaaaggaaaggugguaggccuuuacgguaacggggucgugaccaggagcggagccuauguuuccgcuaucgcccaaacagaaaagggcauugaggauaaucccgagaucgaagacgauauauuucguaaacgccgguuaacuauuauggaccugcacccuggcgcagggaagaccaaaagauaccucccggcuaucgugagggaggccaucaagcgaggauugcggacgcugauucucgcgcccacacgcgucguggccgcagaaauggaggaagcucugagaggucuuccaaucagguaucagacuccugccauucgggcugagcauaccggccgagagauaguugaccugaugugucacgcaacauucaccaugagauugcuaucucccgugcgcgucccaaacuacaaucugaucauuauggaugaagcccauuucacugacccugccucgaucgcugcgaggggguauaucagcacccguguggagaugggagaagcagccggcauuuuuaugacagcuacgcccccagguucacgggauccguucccucaguccaacgcccccauaaucgacgaggagagagaaauuccagagaggaguuggaacucugggcacgaauggguaacugauuuuaaaggaaagaccgugugguucguucccagcaucaaggcaggcaacgacauugccgcuugccuccgcaaaaauggcaagaaagucauccaauuaucccgaaagacauuugauucagaguacgugaaaaccagaacuaacgacugggauuucguggucacaaccgacauaucugaaaugggggcgaauuuuaaggccgagcggguaaucgauccuaggcgcuguaugaaaccagugauucugacggacggagaggaacguguuauccuugcaggucccaugccugugacucauagcagugcugcccagagacggggcaggauugggcgcaacccgaagaaugagaacgaccaguacaucuauaugggagaaccacuggagaaugaugaagacugcgcacacuggaaggaggccaaaaugcucuuggauaacauaaauacacccgagggcauuaucccuuccauguucgaacccgagcgagaaaaggucgacgcuauugauggugaguacagacugagaggggaagccaggaaaaccuuuguggaccucaugcgcagaggcgaucugccaguuuggcuugcguauaagguggcagccgagggaaucaacuacgcugacaggcggugguguuucgauggcaucaaaaauaaucagauccuagaggaaaacgucgagguggaaauuuggaccaaggagggggagcguaagaaacugaagccucgcugguuggacgcccgaaucuauagcgaucccuuagcucugaaagaauuuaaggaguucgcagccggaagaaaaucucucacucugaaucuuauuacagaaauggguaggcugccaaccuucaugacacaaaagacucgggacgcucucgauaacuuggccguacugcacacggcagaggcgggcgggcgcgccuacaaucaugcucuaucagaacugccugagacccucgagacacuucuguuauugacucugcucgccaccgugacaggaggcaucuuucuguuccuuauguccgguagagggauaggcaagaugacccugggaaugugcugcauuaucacugcaaguauccucuugugguaugcucagauucagccgcacuggaucgccgcaagcauaauucuggaauuuuucuuaaucguucuacugauucccgagccagaaaaacagaggacgccucaagacaaccagcucaccuacgucgugaucgccauacuuacaguggucgcugcgacuauggccaaugagaugggcuuucuggaaaagaccaaaaaggacuucggguugggaucgaucgcaacacagcagcccgagucuaacauucuggauaucgaccuccggccagcuuccgccuggacccuguacgccguugcaacuacauuugugacgccuaugcuucgacauagcauugaaaauucaaguguaaacgugucucucaccgcuaucgccaaucaagcgacuguccugauggguuugggcaaaggguggccccuguccaagauggauauuggagugccguuacuagcuaucggcuguuauagccagguuaacccaauaacacugaccgccgcacuccuucuguugguggcccacuacgcuauuaucgguccugggcugcaggcaaaggccaccagagaagcgcagaaacgcgcugccgcaggcaucaugaagaaucccacagucgacggaauuacuguaauagaucucgacccaauccccuaugauccuaaauucgagaagcaacugggccaggugaugcuuuuaauucugugcguuacacaggugcucaugaugaggaccacaugggccuugugugaagcucugacucuagccaccgggccgaucucaacacugugggagggaaaccccggccgguuuuggaauaccacuauugcagucaguauggcuaacaucuuccgugguagcuaccucgccggggcgggacuucuguuuuccauaaugaaaaauacgacaaacaccagaaggggcacugguaacaucggcgaaaccuugggggagaaguggaaaucucgccugaaugcccucggaaagagcgaguuccaaauuuauaagaaauccggcauccaggaaguggaccggacacuggcaaaggaggggauuaaacgaggagaaacugaucaccaugcugucucaagaggcucugccaaguuaaggugguuuguggagcgcaacaugguuaccccagaggguaaagugguagaccuugggugcggacggggcgguuggaguuacuauuguggcgggcugaagaaugugagagaagucaagggacucacaaaaggcgggccuggacacgaggaacccaucccuaugucgacguacggcuggaaccuaguucgucugcagagcgguguggaugucuucuucauaccacccgagaagugcgacaccuugcugugugauauuggggaauccucuccuaauccaacuguggaggcaggaaggacacuccggguacuuaaccugguggagaauugguugaacaauaacacccaguuuugcaucaaaguucugaaucccuacaugccgucagugaucgaaaagauggaggcucuccaacgcaaauauggcggcgccuuaguccgaaacccucugagcagaaauuccacucaugaaauguacugggugaguaacgccucugggaauauugucagcucagugaacaugauauccaggaugcuuaucaaccgguucacaaugcgccacaagaaggcgaccuaugagccagacguugaccugggaagugguacgagaaauauuggcaucgaaagcgagauucccaaccuagauaucauagggaaaaggaucgagaagauuaaacaggaacaugagaccucuuggcacuacgaccaggaucacccuuauaagacaugggcuuaccauggauccuaugaaacuaaacagaccggcucagcaagcucgaugguaaauggugugguccgacuccugacaaagccaugggacguguugcccacuguuacccaaauggccaugacagauaccacuccguuugggcagcagcggguguucaaggagaaagucgacacgcguacacaggaaccuaaggagggaaccaaaaagcugaugaaaaucacugcugaguggcucuggaaggaacuuggcaaaaagaagacccccagaauguguacacgcgaggaauuuacgaggaaagugcggucuaacgccgcacugggcgccauuuucaccgaugagaauaaguggaaaagugcuagagaggcgguagaagacucccgcuuuugggaguuaguggauaaggaaaggaaccugcacuuggaggggaaaugcgaaacuuguguuuacaauaugaugggaaagcgagagaagaaacucggugaguucggcaaggccaaagggagccgggcaaucugguacauguggcugggagcuagauuucuagaguucgaggcccuuggcuuucugaacgaagaccauugguucucaagggaaaauucccucucuggugucgaaggggagggacugcacaaguugggcuauauucugcgcgaugugagcaaaaaggagggcggggcaauguacgccgacgacacagcuggaugggauacccguauaacucucgaagaccuuaagaacgaggaaauggugacaaaucacauggagggugaacauaaaaagcuggccgaggcgaucuuuaaauuaaccuaucaaaacaaggucguucgggugcagagaccaacaccuaggggcacuguaauggauauuaucagucgccgagaccagcggggguccggacaagugggcaccuacggucugaauacguucaccaacauggaggcacaguugaucagacagauggaaggggagggagucuucaaaaauauucagcaccucacagugacugaagagguugccgugcaaaacuggcuggcuagggucggccgcgagagacuaagccggauggccauaucuggcgaugacugcgugguaaagccccuugaugacagguuugcaaacgcucugaccgcccucaaugauauggggaagauccguaaagacauucagcagugggaaccaucaaagggauggaacgauuggacacagguucccuucugcagucaucacuuucaugagcugaucaugaaagacggucgaguguuggucgugccuugucgcaaucaagaugaauuaauuggcagagcucggaucucccagggggccggauggagccugagggagacugcaugccucggcaagucuuaugcgcagauguggucgcuuauguacuuccaccgcagagaccugcggcuagccgcuaacgugauauguucagccgucccaagccacuggguuccgaccuccaggacgacauggaguauccaugcaaaacacgaauggaugaccacugaggacaugcugacaguguggaaucgaguauggauucgugagaaccccuggauggaagauaagaccccuguggagucuugggaagagaucccauaucucgguaagagagaagaccaguggugcgggagcuugauuggacugacuucccgcgcuaccugggccaaaaauauccaagcagccauaaaccagguccggucacuuauuggcaaugaggaguacacagauuacaugcccaguaugaagagguuuagacgcgaagaggaagaggcgggcgugcugugguga

SEQ ID NO: 14776 - RNA, 9876 nt, Artificial Sequence
  derived and/or modified CDS sequence (opt3) from DENV-2__EU687249__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaagcuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggaaaaaagauacauucucgggaggcugauaacugugaacccgaucgucaccgagaaggauagcccugugaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacuaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggccagagaagagggcauuugugguaucaggucugugacucggcucgagaaucugauguggaaacagauuacacccgaauuaaaccacauccuggcagagaaugaagucaagcuaaccauaaugacuggcgauaucaaagggauuaugcaggccggaaagcgcucgcucagaccucaaccaaccgagcugaaguacagcuggaaaacauggggcaaggcuaaaaugcuuuccacggaaucauauaaccagaccuucuugaucgacgggccggagacugccgagugccccaauacaaacagggcauggaauagucuggaaguugaggauuacggauuuggcguguucaccacaaacauuuggcucaagcugaaagaaaagcaggacgcguuuugugacucuaaguuaaugagcgcugccaucaaagauaaucgugcagugcaugccgacauggguuauuggauagaguccgcucugaacgauacuuggaagauugagaaagccucauucaucgaaguaaagaauugccacuggccuaaaagccauacccuuuggucuaacggggucuuggaguccgaaaugaucauuccaaagaaccucgcaggacccgugagucagcacaauuaccggccuggcuaccacacgcaaaucgcugguccauggcaucugggcaagcuagagauggacuucgauuuuugugacgggacaaccguuauugugacugaagauugcggaaaccgaggccccagccugagaaccacaacugccucugggaaacucauaaccgaguggugcuguagguccugcacacugccgccucuucgcuaucggggagaggacggcuguugguacgguauggaaaucagaccauugaaggagaaagaagagaaucuggucaacucauuagugacggcggggcacggacagguugauaauuucagucucggcgugcuggguauggcccuuuuucuggaagagauguugaggacccgcguaggcacuaagcaugcuauucuccuggucgcagugagcuucaugacacuaaucaccgggaacaugucguuuaaagaccugggacgaguggucguuauggugggcgccacuauggcugaugacauugggaugggaguaacauaucucgcccugcuugcagcguucaaggugcggcccaccuuugccgcuggcuugcuguuacguaagcucacguccaaagagcugaugaugacuaccaucgguauaguccuucugucucagagcacaaucccugaaaccgugcuagagcucacugaugcccuggcauuggggaugaugguucugaagauugugagaaauauggaaaaauaccaauuagcugucacaaucauggccauucucugcgugcccaacgcaguuauccugcagaaugccuggaaggugucauguaccauacuugcugucguaaguguguccccacuguugcucacaucuagccagcagaaaacugacuggauuccucuggcgcuaaccaucaagggacugaaccccacggccaucuuccuuacaacccucuccaggacuaauaaaaagcgcucauggccacugaacgaggcaauuauggcuguuggcauggugagcauauuggccaguucucuguuaaagaaugacaucccgaugaccggcccucucgucgccgggggacugcuuacagugugcuauguacugacuggucgguccgcugauuuggaacucgagagagcaaccgacgugaaaugggaggaucaagccgaaauuagcggcucgucacccauccugucuauuacgaucagugaggacggguccaugagcauaaagaacgaagaggaggaacagacacuaaccauccugauuaggacuggacuucucgucaucucuggccuguuuccaauuagcauccccauaacagcggcugccugguacuugugggagguuaaaaagcagcgagcagguguguuaugggaugugccuuccccacccccuauggggaaagccgaacuggaggacggagcuuaucgcauuaagcagaagggcauccucggcuacucacaaaucggggcaggagucuacaaagaagguaccuuccacacuauguggcaugugacacggggcgccguucugaugcacaaggggaaaagaauugagccgaguugggcggauguaaagaaagaccuuaucagcuauggaggcgguuggaagcuggagggggaauggaaggagggagaagaggugcaggucuuggcucuagaaccaggcaaaaaucccagggccgugcagaccaagccuggccuguuuaaaacgaacacugggaccauaggagcaguuucucucgauuucuccccagguacaucaggcagucccauuaucgacaagaaagggaagguggucggacuguacggcaacggugugguaacccguagcggggccuaugucuccgcuauugcccagacagagaagucuaucgaggauaauccugaaauagaggacgauauuuuucgcaaacggagacuuacuaucauggacuuacacccgggagcaggcaagaccaaaagguaccugcccgcuaucgugcgagaagccauuaagcggggccuccgcacguugauccuggcgccaacaagaguuguggccgcagagauggaagaggcucucagggggcugccuauucgguaucaaacucccgccauacgagcugagcauaccggaagagaaaucgucgaccuuaugugucacgcaacauucaccaugcgccuguugucgccagugaggguuccuaacuacaaucuaauuaucauggaugaggcccauuucacugaccccgccagcaucgcugcgcgugguuauauuucaacccggguggaaaugggcgaggcagccgggauauuuaugacagcuacgccaccgggauccagagauccuuucccccagaguaacgccccaaucauugacgaggaaagggagauccccgaacgcucuuggaauagcggccacgagugggucacugauuuuaaagguaagaccgugugguucguaccuuccauuaaggcagggaacgacaucgccgcuugccugcgaaaaaauggaaagaaagugauacagcucucaagaaagacauuugauucugaauacguuaaaacccggacuaacgacugggauuucgucgugacaaccgacaucagcgagaugggcgcgaauuuuaaggccgagagggugauugauccacgccguuguaugaaacccgucaucuuaacggacggcgaagagagaguaauucuggcagggccuaugccggugacucauaguuccgcugcccaacggaggggacgcaucggucgaaacccaaagaaugaaaacgaccaguacauauauaugggcgagccccuugaaaaugaugaggacugcgcacacuggaaggaggccaaaaugcugcucgauaacauuaauacaccugaagggaucauucccagcauguucgagccagaaagagagaagguugacgcuaucgauggagaauaccgguugaggggcgaggcccgcaaaaccuuuguggaccugaugagaaggggugaucucccugucuggcuggcguauaagguggcagccgaggggauaaacuacgcugaccggcguugguguuucgauggcaucaaaaacaaucagauucuugaagagaacguugaaguggagaucuggaccaaggagggagaacgcaagaaacuaaagccccgauggcuggacgccagaauuuauucugauccauuggcuuuaaaagaguuuaaggaauucgcagccggcaggaaaucacugacucucaaucugaucacagagauggggcggcuuccuaccuucaugacacagaagacucgcgacgcucuggauaaccucgccgucuugcacacggcagaagcgggagguagagccuacaaucaugcucuguccgagcuaccggagacccuggaaacacuccuucuguuaacuuugcuggccaccgugacaggcgggauauuucucuuccugaugaguggaaggggcauugguaagaugacccuugggaugugcugcaucaucacugcaagcauucugcucugguaugcucaaauccagccccacuggauagccgcaucgauuaucuuggaguuuuuccugauuguauuacuaaucccagaaccugagaaacagcggacgccccaggacaaccaacugaccuacgugguuauagccauccucacagucguggcugcgacuauggccaaugaaaugggcuuucuugagaagaccaaaaaggaccugggauugggcucuauugcaacacagcagccagaguccaacauccuggauauugaccuccgaccugcuagcgccuggacccuguacgccguggcaacuacauucgucacgcccaugcuuagacauucaaucgaaaauaguucuguuaacgugucccucaccgcuauugccaaucaggcgacuguacugaugggguugggaaaagguuggccgcugagcaagauggauaucggcgugccauuacuagcuauaggguguuauucacaagucaacccuauuacacugaccgccgcacuccuucuguugguggcccacuacgcuaucaucggacccggccugcaggcaaaggccacccgcgaggcgcagaaaagggcugccgcagguauuaugaagaauccaacaguugacgggauaacugugaucgaucucgaccccauuccuuaugauccgaaauuugaaaagcagcugggccaagucaugcuuuuaauccugugcguaacgcaggugcucaugaugcggaccacaugggccuugugugaggcucugacucuagccaccggacccauuaguacacugugggaaggcaacccagggcguuucuggaauaccacuaucgcaguuagcauggcuaacauauuuagaggauccuaccucgccggcgcgggucuucuguucucuaucaugaaaaauacgacaaacaccaggcgcgggacuggaaacauuggcgagaccuugggugagaaguggaaaagccggcugaaugcccucggcaaguccgaauuucagaucuauaagaaaucagggauucaagagguggaccgaacacuggcaaaggaaggaaucaaaagaggcgagacugaucaccaugcugucucuagggggagugccaaguuacgcugguucguggagcggaacauggucaccccugaaggaagagugguugaccuuggcugcggucgugggggauggucguacuauuguggcggucugaaaaaugugagggagguaaagggccucacaaaggggggacccggccacgaagagccuauaccaaugagcacguacggguggaaccuagugcggcugcaguccggagucgauguuuuuuucauucccccugaaaaaugcgacaccuugcugugugauaucggcgagucuucaccaaaucccacuguggaggcaggucgcacacuccgaguccuuaaccugguggaaaauugguugaacaauaacacccaguucugcaucaagguacugaauccguacaugccuagcgugauugagaaaauggaagcucuccagagaaaguaugggggagccuuaguuaggaacccacugucccggaauaguacucaugagauguacugggugucuaacgccagcggcaauauagucucauccgugaacaugaucagucgcaugcuuauuaacagauuuacaaugaggcacaaaaaggcgaccuaugaacccgacgucgaccugggcagcgggacgcgaaauaucggaauugagucugaggugccuaaccuagauaucauagguaagcggaucgaaaaaauuaagcaagagcaugaaaccuccuggcacuacgaccaggaucacccauauaaaacaugggcuuaccauggcucauaugagacuaagcagaccgggagcgcaucgucuaugguuaauggaguagugcgucuccugacaaaacccugggacgucuugccgacugugacccagauggccaugacagauaccacuccuuucggccaacagagaguuuuuaaggaaaagguggacacgcgcacacaggagcccaaagaggguaccaagaaacugaugaagaucacugcugaauggcucuggaaagagcuugggaagaaaaagaccccaaggauguguacacgggaagaguucacgagaaagguccgcaguaacgccgcacugggagccauuuuuaccgaugagaauaaauggaaguccgcuagggaagcgguggaggacagccgauucugggaauuaguagauaaagagcggaaccugcacuuggaaggcaagugcgagacuuguguguacaauaugaugggcaaaagagagaagaagcucggggaauuuggaaaagccaaggguucaagggcaaucugguacauguggcugggcgcucgcuuccuagaguuugaagcccuuggguuccugaacgaggaccauugguuuucccgugaaaauucucucagcggaguugagggcgagggucugcacaaauugggguauauucugcgggaugucaguaagaaagaaggaggcgcaauguacgccgacgacacagcuggcugggauaccagaauaacucucgaggaccuuaagaacgaagagauggugacaaaucacauggaaggggagcauaagaaacuggccgaggcgaucuucaaguuaaccuaucagaacaaaguggucaggguucaacgcccuacaccccgaggaacugugauggauauuaucucccggagagaccagagggguagcggccagguagggaccuacggacugaauacguuuaccaacauggaagcacaauugauccgccagauggagggcgaagguguguucaagaauauucagcaccucacagucacugaggagguggccguucagaacuggcuggcuagaguggggcgggaaaggcuaucucguauggccauaucaggagaugacugcgucgugaaaccacuugaugaccgauucgcaaacgcucugaccgcccucaaugauaugggcaagauccgcaaggacauucaacagugggagcccaguaaaggcugguccgauuggacacagguaccuuuuugcagccaucacuuccaugaacugaucaugaaggacgggagaguuuugguggucccaugucggaaccaggaugaguuaauuggaagggcucgcaucucucaaggugccggcuggucgcugagagaaacugcaugccucgggaaaucauaugcgcagauguggagccuuauguacuuucaccggagggaccugcgacuagccgcuaaugccauauguuccgcagugccgagucacugggugcccaccucucguacgacauggagcauccaugcuaagcacgaguggaugaccacugaggacaugcugacagucuggaacagaguuuggauucgcgaaaauccuuggauggaggauaaaaccccaguggaauccugggaggaaauccccuaucucggaaagcgggaggaccaguggugcggcucauugauuggucugacuaguagggccaccugggcaaagaacauccaggccgcgauaaaucaaguaagaucucuuauugggaacgaggaauacacagauuacaugccuagcaugaaacgcuuccggagggaggaagaggaagcuggagugcugugguga

SEQ ID NO: 14777 - RNA, 9876 nt, Artificial Sequence
  derived and/or modified CDS sequence (opt3) from DENV-2__EU660416__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaagcuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggaaagaagguacgugcucgggcggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcgaggugccaagcgcauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucuagaagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuaggucugucacucggcucgagaaucugauguggaagcagaucacacccgaauuaaaccacauucuggcagagaaugaaguuaaacuaaccaucaugacuggcgauauaaaggggaucaugcaagccggaaaacgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucaacacaauuaccggccuggcuaccacacgcagauugcugguccauggcaucugggcaagcuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaagagaaggaagagaaucuggugaacucauuaguuacggcggggcacggacagguggauaauuucagucucggcguacuggguauggcccuuuuucuggaagagauguugaggacccgcgucggcaugaaacaugcuauccuccugguggcagugagcuucgucacucuaauuacagggaacaugucguuuaaggaccugggacgaguugugguaauggugggcgccaccauggcugaugacaucgggaugggagucacuuaucucgcccugcuugcagcguucaaagugcggcccacauuugccgcuggcuugcuguuacguaagcucaccuccaaggagcugaugaugacgacuauugguaucguucuucugucucaaagcaccauaccugaaacagugcuagagcucaccgaugcccuggcauuggggaugaugguccugaaaaucgugagaaauauggaaaaguaccaguuagcuguuacuauuaugacaauccucugcgugcccaacgccgucauucugcagaaugcauggaaaguaucauguaccauccuugccgugguuaguguguccccacuguugcucacaucuagcaggcagaagacugacuggauaccucuggcucuaaccauuaaaggacugaaccccacggcgaucuuccuuacaacccucucccgcacuaauaagaaacggucauggccacugaacgaggccaucauggcagucggcauggugagcauuuuggcuaguucucuguuaaagaaugacauaccgaugaccggcccucucguagccgggggacugcuuacagugugcuauguccugacugguagauccgccgauuuggaacucgagagggcuaccgacguuaagugggaggaucaagcagaaaucagcggcucgucacccauucugucuaucacgauuagugaggacggguccaugagcaucaaaaacgaagaggaggaacagacacuaaccauacugauccgaacuggacuucucgugauuucuggccuguuuccaaucagcauucccaucacagccgcggcuugguacuugugggaggugaagaaacagcgcgccggugucuuaugggaugugccuuccccacccccuauggggaaggcagaacuggaggacggagccuaucggauaaaacagaagggcauucucggcuacucacaaaucggggcuggaguuuacaaggaagguaccuuccacacuauguggcauguaacaagaggcgcagugcugaugcacaaagggaagaggaucgagccgaguugggccgaugucaaaaaggaccuuauuagcuauggaggcgguuggaaacuggagggggaauggaaggagggagaagaggugcagguuuuggcgcuagaaccaggcaagaauccccgugcugugcagaccaaaccuggccuguuuaagacgaacacugggaccaucggagccgucucucucgauuucuccccagguacaucaggcagucccauaauugacaaaaaggggaaagugguaggacuguacggcaacggugucgugacccgcagcggggcauauguuuccgccaucgcucagacagagaagucuauugaggauaauccugaaaucgaggacgauauauuucggaagagaaggcuuacuauuauggacuuacacccgggagccggcaaaaccaagcgauaccugcccgcaaucgugcgggaagcuaucaaacgcggccucagaacguugauucuggccccaacaagggucguggcggccgagauggaagaggcacuccgggggcugccuauccgauaucaaacucccgcuauuagagccgagcauaccggacgcgaaauaguugaccuuaugugucacgcuacauucaccaugaggcuguugucgccagugcgugucccuaacuacaaucuaaucauuauggaugaggcacauuucacugaccccgccagcaucgccgcucgggguuauaucucaaccagaguggaaaugggcgaggcggcagggauuuuuaugacagccacgccaccgggauccagggauccuuucccccagaguaacgcuccaauaaucgacgaggaacgcgagauucccgaacgaucuuggaauagcggccacgaguggguaacugauuuuaaggguaaaaccgugugguucguuccuuccaucaaggccgggaacgacauugcagccugccugagaaagaauggaaaaaaggucauccagcucucacggaaaacauuugauucugaauacgugaagaccaggacuaacgacugggauuucguggucacaaccgacauaagcgagaugggcgcuaauuuuaaagcggagcgcguaaucgauccacguagauguaugaagcccgugauuuuaacggacggcgaagagcggguuauccuggccgggccuaugccggugacucauaguuccgcagcucaaaggcgcggacgaauugguagaaacccaaaaaaugaaaacgaccaguacaucuauaugggcgagccccuugaaaaugaugaggacugcgcccacuggaaggaggcaaagaugcugcucgauaacauaaauacaccugaagggauuauccccagcauguucgagccagaacgggagaaagucgacgccauugauggagaauacagguugcgcggcgaggcuagaaagaccuuuguggaccugaugaggcggggugaucucccuguuuggcuggccuauaaaguggcggcagaggggaucaacuacgccgaccgucgcugguguuucgauggcauaaagaacaaucagauccuugaagagaacgucgaaguggagauuuggaccaaagagggagaacgaaagaagcuaaaacccagauggcuggacgcuaggaucuauucugauccauuggccuuaaaggaguuuaaagaauucgcugcaggccggaagucacugacucucaaucugauuacagagauggggcgccuuccuaccuucaugacacagaaaacuagagacgcccuggauaaccucgcuguauugcacacggccgaagcaggagguagggcguacaaucaugcccuguccgagcuaccggagacccuggaaacacuccuucuguuaacuuugcuggcuaccgugacaggcgggaucuuucucuuccugaugaguggacggggcauagguaagaugacccuugggaugugcugcauuaucacugccagcauccugcucugguaugcacaaauucagccccacuggaucgcugccucgauaauuuuggaguuuuuccugaucguuuuacuaauuccagaaccugagaagcagcgaacgccccaggacaaccaacugaccuacgucgugaucgcaauacucacaguggucgccgcuacuauggcgaaugaaaugggcuuucuugagaaaaccaagaaagaccugggauugggcucuaucgccacacagcagccagaguccaacauucuggauaucgaccucagaccugcaagcgcuuggacccuguacgccguugccacuacauucgugacgcccaugcuucgccauucaauugaaaauaguucuguaaacgugucccucaccgcaaucgcuaaucaggccacuguccugaugggguugggaaaggguuggccgcugagcaaaauggauauuggcgugccauuacuagcgaucggguguuauucacaaguuaacccuauaacacugaccgcugcccuccuucuguugguggcacacuacgccauuaucggacccggccugcaggcuaaggcaaccagggaggcccagaagcgggcggcugccgguaucaugaaaaauccaacagucgacgggauuacuguaauagaucucgaccccaucccuuaugauccgaaguuugaaaaacagcugggccaagugaugcuuuuaauucugugcguuacgcaggugcucaugaugcguaccacaugggcauugugugaggcccugacucuagcuaccggacccaucaguacacugugggaaggcaacccagggagauucuggaauaccacuauugccgucagcauggcaaacaucuuuaggggauccuaccucgcuggcgccggucuucuguucucuauaaugaagaauacgacaaacacccgccgggggacuggaaacaugggcgagaccuugggugagaaauggaagagccgacugaaugcgcucggcaaauccgaauuucagaucuauaagaagucagggauucaagagguggacagaacacuggccaaagaaggaaucaagaggggcgagacugaucaccaugcagucucucgcgggagugcuaaauuacggugguucguggagagaaacaugguuaccccugaaggaaaggugguagaccuuggcugcggucgugggggauggucguacuauuguggcggucugaaaaaugugagggaggucaagggccucacaaaggggggacccggccacgaagagccuauuccaaugagcacguacggguggaaccuaguucggcugcaguccggaguggaugucuuuuucauccccccugaaaaaugcgacaccuugcugugugauauaggcgagucuucaccaaaucccacuguggaggccggucgcacacuccgaguacuuaaccugguggaaaauugguugaacaauaacacccaguucugcauuaagguucugaauccguacaugccuagcgugaucgagaaaauggaagcacuccagagaaaguaugggggagcuuuagucaggaacccacugucccggaauaguacucaugagauguacugggugucuaacgccagcggcaauaucgucucauccgugaacaugauuagucgcaugcuuauaaacagauuuacaaugaggcacaaaaaggccaccuaugaacccgacguugaccugggcagcgggacgcgaaauaucggaauugagucugagaucccuaaccuagauauuaucgguaagcggauagaaaaaaucaagcaagagcaugaaaccuccuggcacuacgaccaggaucacccauauaaaacaugggcguaccauggcucauaugagacuaagcagaccgggagcgcuucgucuaugguaaauggagugguccgucuccugacaaaacccugggacguguugccgacuguuacccagauggcaaugacagauaccacuccuuucggccaacagagaguguuuaaggaaaaggucgacacgcgcacacaggagcccaaagaggguaccaagaaacugaugaagauuacugccgaauggcucuggaaagagcuugggaagaaaaagaccccaaggauguguacacgggaagaguucacgagaaaggugcgcaguaacgcugcccugggagcaaucuuuaccgaugagaauaaauggaaguccgccagggaagcuguagaggacagccgauucugggaauuaguggauaaagagcggaaccugcacuuggaaggcaagugcgagacuuguguuuacaauaugaugggcaaaagagagaagaagcucggggaauuuggaaaagcgaaggguucaagggccauuugguacauguggcugggcgcacgcuuccuagaguuugaagcucuuggguuccugaacgaggaccauugguuuucccgugaaaauucucucagcggagucgagggcgagggucugcacaaauugggguauauccugcgggaugugaguaagaaagaaggaggcgccauguacgcagacgacacagccggcugggauaccagaauuacucucgaggaccuuaagaacgaagagauggugacaaaucacauggaaggggagcauaagaaacuggcugaggccauauucaaguuaaccuaucagaacaaagucguuagggugcaacgcccuacaccccgaggaacuguaauggauaucauuucccggagagaccagagggguagcggccagguggggaccuacggacugaauacguuuaccaacauggaagcgcaauugauccgccagauggagggcgaaggugucuucaagaauauccagcaccucacagugacugaggagguugcagugcagaacuggcuggccagagucgggcgggaaaggcuaucucguauggcuauuucaggagaugacugcgugguaaaaccacuugaugaccgauucgccaacgcacugaccgcucucaaugauaugggcaagauacgcaaggacauccaacagugggagcccaguaaaggcuggaacgauuggacacagguuccuuuuugcucccaucacuuccaugaacugauuaugaaggacgggagaguguuggucgugccaugucggaaucaggaugaguuaaucggaagggcccgcauuagccaaggugcuggcuggucucugagagaaacugccugccucgggaaaucguaugcacagauguggucacuuauguacuuucaccggagggaccugcgacuagcggccaacgcuaucuguagcgccgugccgucccacuggguccccaccagucguacgacauggucuauacaugcaaagcacgaguggaugaccacugaggacaugcugacaguuuggaauaaaguguggaucagagaaaacccuuggauggaggauaagaccccaguagaaagcugggaggaaauucccuaucucggaaagcgcgaggaccaguggugcggcuccuugaucggucugacuucacgggcuaccugggccaaaaauauucaggcagccaucaaccaagugaggagucuuauagggaaugaggaauacacagauuacaugccuucuaugaagagauuccgccgggaggaagaggaagcgggaguccugugguga

SEQ ID NO: 14778 - RNA, 9876 nt, Artificial Sequence
  derived and/or modified CDS sequence (opt3) from DENV-2__EU660417__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaagcuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggaaagaagguacgugcucgggcggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcgaggugccaagcgcauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucuagaagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuaggucugucacucggcucgagaaucugauguggaagcagaucacacccgaauuaaaccacauucuggcagagaaugaaguuaaacuaaccaucaugacuggcgauauaaaggggaucaugcaagccggaaaacgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucaacacaauuaccggccuggcuaccacacgcagauugcugguccauggcaucugggcaagcuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaagagaaggaagagaaucuggugaacucauuaguuacggcggggcacggacagguggauaauuucagucucggcguacuggguauggcccuuuuucuggaagagauguugaggacccgcgucggcacuaaacaugcuauccuccugguggcagugagcuucgucacacuaauuaccgggaacaugucguuuaaggaccugggacgaguugugguaauggugggcgccacuauggcugaugacaucgggaugggagucacauaucucgcccugcuugcagcguucaaagugcggcccaccuuugccgcuggcuugcuguuacguaagcucacguccaaggagcugaugaugacuaccauugguaucguucuucugucucaaagcacaauaccugaaaccgugcuagagcucacugaugcccuggcauuggggaugaugguccugaaaaucgugagaaauauggaaaaguaccaguuagcuguuacaauuaugaccauccucugcgugcccaacgccgucauucugcagaaugcauggaaaguaucauguacaauccuugccgugguuaguguguccccacuguugcucacuucuagcaggcagaagaccgacuggauaccucuggcucuaacgauuaaaggacugaaccccacagcgaucuuccuuaccacucucucccgcaccaauaagaaacggucauggccacugaacgaggccaucauggcagucggcauggugagcauuuuggcuaguucucuguuaaagaaugacauaccgaugacaggcccucucguagccgggggacugcuuacugugugcuauguccugaccgguagauccgccgauuuggaacucgagagggcuacggacguuaagugggaggaucaagcagaaaucagcggcucgucacccauucugucuaucacaauuagugaggacggguccaugagcaucaaaaacgaagaggaggaacagacccuaacuauacugauccgaacaggacuucucgugauuucuggccuguuuccaaucagcauucccaucaccgccgcggcuugguacuugugggaggugaagaaacagcgcgccggugucuuaugggaugugccuuccccacccccuauggggaaggcagaacuggaggacggagccuaucggauaaaacagaagggcauucucggcuacucacaaaucggggcuggaguuuacaaggaagguacuuuccacacaauguggcauguaaccagaggcgcagugcugaugcacaaagggaagaggaucgagccgaguugggccgaugucaaaaaggaccuuauuagcuauggaggcgguuggaaacuggagggggaauggaaggagggagaagaggugcagguuuuggcgcuagaaccaggcaagaauccccgugcugugcagacgaaaccuggccuguuuaagacuaacaccgggacaaucggagccgucucucucgauuucuccccagguaccucaggcagucccauaauugacaaaaaggggaaagugguaggacuguacggcaacggugucgugacacgcagcggggcauauguuuccgccaucgcucagacugagaagucuauugaggauaauccugaaaucgaggacgauauauuucggaagagaaggcuuaccauuauggacuuacacccgggagccggcaaaacgaagcgauaccugcccgcaaucgugcgggaagcuaucaaacgcggccucagaacauugauucuggccccaacuagggucguggcggccgagauggaagaggcacuccgggggcugccuauccgauaucaaacccccgcuauuagagccgagcauacaggacgcgaaauaguugaccuuaugugucacgcuaccuucacuaugaggcuguugucgccagugcgugucccuaacuacaaucuaaucauuauggaugaggcacauuucaccgaccccgccagcaucgccgcucgggguuauaucucaacaagaguggaaaugggcgaggcggcagggauuuuuaugacggccacuccaccgggauccagggauccuuucccccagaguaacgcuccaauaaucgacgaggaacgcgagauucccgaacgaucuuggaauagcggccacgaguggguaaccgauuuuaaggguaaaacagugugguucguuccuuccaucaaggccgggaacgacauugcagccugccugagaaagaauggaaaaaaggucauccagcucucacggaaaaccuuugauucugaauacgugaagacuaggacaaacgacugggauuucguggucaccacggacauaagcgagaugggcgcuaauuuuaaagcggagcgcguaaucgauccacguagauguaugaagcccgugauuuuaacugacggcgaagagcggguuauccuggccgggccuaugccggugacacauaguuccgcagcucaaaggcgcggacgaauugguagaaacccaaaaaaugaaaacgaccaguacaucuauaugggcgagccccuugaaaaugaugaggacugcgcccacuggaaggaggcaaagaugcugcucgauaacauaaauaccccugaagggauuauccccagcauguucgagccagaacgggagaaagucgacgccauugauggagaauacagguugcgcggcgaggcuagaaagaccuuuguggaccugaugaggcggggugaucucccuguuuggcuggccuauaaaguggcggcagaggggaucaacuacgccgaccgucgcugguguuucgauggcauaaagaacaaucagauccuugaagagaacgucgaaguggagauuuggacuaaagagggagaacgaaagaagcuaaaacccagauggcuggacgcuaggaucuauucugauccauuggccuuaaaggaguuuaaagaauucgcugcaggccggaagucacugacacucaaucugauuaccgagauggggcgccuuccuacauucaugacucagaaaacgagagacgcccuggauaaccucgcuguauugcacaccgccgaagcaggagguagggcguacaaucaugcccuguccgagcuaccggagacacuggaaacucuccuucuguuaaccuugcuggcuacagugaccggcgggaucuuucucuuccugaugaguggacggggcauagguaagaugacucuugggaugugcugcauuaucacggccagcauccugcucugguaugcacaaauucagccccacuggaucgcugccucgauaauuuuggaguuuuuccugaucguuuuacuaauuccagaaccugagaagcagcgaaccccccaggacaaccaacugacauacgucgugaucgcaauacucacuguggucgccgcuaccauggcgaaugaaaugggcuuucuugagaaaacaaagaaagaccugggauugggcucuaucgccacccagcagccagaguccaacauucuggauaucgaccucagaccugcaagcgcuuggacucuguacgccguugccacaacguucgugacccccaugcuucgccauucaauugaaaauaguucuguaaacgugucccucacugcaaucgcuaaucaggccacaguccugaugggguugggaaaggguuggccgcugagcaaaauggauauuggcgugccauuacuagcgaucggguguuauucacaaguuaacccuauaacccugaccgcugcccuccuucuguugguggcacacuacgccauuaucggacccggccugcaggcuaaggcaacaagggaggcccagaagcgggcggcugccgguaucaugaaaaauccaacugucgacgggauuacgguaauagaucucgaccccaucccuuaugauccgaaguuugaaaaacagcugggccaagugaugcuuuuaauucugugcguuacccaggugcucaugaugcguacaacuugggcauugugugaggcccugacccuagcuacaggacccaucaguacccugugggaaggcagcccagggagauucuggaacacuacgauugccgucuccauggcaaauaucuuuaggggaucuuaccucgcuggcgccggucuucuguucagcauaaugaagaacacaaccaauacucgccgggggaccggaaacaugggcgagacauugggugagaaauggaagucccgacugaacgcgcucggcaaaucagaauuucagaucuauaagaagucugggauucaagagguggacagaacucuggccaaagaaggaaucaagaggggcgagaccgaucaccaugcagucagucgcgggucggcuaaauuacggugguucguggagagaaauaugguuacaccugaaggaaaggugguagaccuuggcugcggucgugggggauggagcuacuauuguggcggucugaaaaacgugagggaggucaagggccucacgaaggggggacccggccacgaagagccuauuccaauguccaccuacggguggaaucuaguucggcugcagucuggaguggaugucuuuuucauccccccugaaaaaugcgacacuuugcugugugauauaggcgagucaagcccaaaccccacaguggaggccggucgcacccuccgaguacuuaaucugguggaaaacugguugaauaacaauacucaguucugcauuaagguucugaacccguacaugccuuccgugaucgagaaaauggaagcacuccagagaaaguaugggggagcuuuagucaggaauccacugagucggaacucuacacaugagauguacugggugagcaaugccucaggcaacaucgucuccagugugaauaugauuagccgcaugcuuauaaacagauuuaccaugaggcacaaaaaggccacguaugaacccgacguugaccugggcucugggacccgaaacaucggaauugaguccgagaucccuaaucuagauauuaucgguaagcggauagaaaaaaucaagcaagagcaugaaacaucauggcacuacgaccaggaucacccauauaaaacuugggcguaccauggcagcuaugagaccaagcagacagggucggcuucuaguaugguaaacggagugguccgucuccugacuaaacccugggacguguugccgaccguuacacagauggcaaugaccgauacuacgccuuucggccaacagagaguguuuaaggaaaaggucgacacacgcacccaggagcccaaagaggguacuaagaaacugaugaagauuaccgccgaauggcucuggaaagagcuugggaagaaaaagacaccaaggauguguacgcgggaagaguucaccagaaaggugcgcuccaaugcugcccugggagcaaucuuuacugaugagaacaaauggaagagcgccagggaagcuguagaggacucacgauucugggaauuaguggauaaagagcggaaucugcacuuggaaggcaagugcgagacauguguuuacaacaugaugggcaaaagagagaagaagcucggggaauuuggaaaagcgaaggguuccagggccauuugguacauguggcugggcgcacgcuuccuagaguuugaagcucuuggguuccugaaugaggaccauugguuuucucgugaaaacagccucaguggagucgagggcgagggucugcacaaauugggguauauccugcgggauguguccaagaaagaaggaggcgccauguacgcagacgacaccgccggcugggauacuagaauuacacucgaggaccuuaagaaugaagagauggugaccaaccacauggaaggggagcauaagaaacuggcugaggccauauucaaguuaacauaucagaauaaagucguuagggugcaacgcccuacuccccgaggaaccguaauggauaucauuagccggagagaccagagggguucuggccagguggggacguacggacugaacaccuuuacaaauauggaagcgcaauugauccgccagauggagggcgaaggugucuucaagaacauccagcaccucacugugaccgaggagguugcagugcagaauuggcuggccagagucgggcgggaaaggcuaucacguauggcuauuaguggagaugacugcgugguaaaaccacuugaugaccgauucgccaacgcacugacagcucucaacgauaugggcaagauacgcaaggacauccaacagugggagcccuccaaaggcuggaaugauuggacucagguuccuuuuugcagccaucacuuccaugaacugauuaugaaggacgggagaguguuggucgugccaugucggaaccaggaugaguuaaucggaagggcccgcauuucucaaggugcuggcuggucgcugagagaaaccgccugccucgggaaaucauaugcacagauguggagccuuauguacuuucaccggagggaccugcgacuagcggccaaugcuaucuguuccgccgugccgagucacuggguccccacgucucguacaaccuggagcauacaugcaaagcacgaguggaugacuacagaggacaugcugaccguuuggaacaaaguguggaucagagaaaauccuuggauggaggauaagacuccaguagaauccugggaggaaauucccuaucucggaaagcgcgaggaccaguggugcggcucauugaucggucugaccagucgggcuacaugggccaaaaacauucaggcagccaucaaucaagugaggucucuuauagggaacgaggaauacacggauuacaugccuagcaugaagagauuccgccgggaggaagaggaagcgggaguccugugguga

SEQ ID NO: 14779 - RNA, 9876 nt, Artificial Sequence
  derived and/or modified CDS sequence (opt3) from DENV-2__EU677137__SS-prME
agcgcaggaaugaucauuaugcugauacccaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucagcacaauuaccguccuggcuaccacacgcagauugcugguccauggcaucugggcaagcuagagauggacuucgauuuuugugacgggacaaccgugacugucaccgaagauugcggaagccggggccccucucugcgaacaacuaccgccuccgggaagcucaucacagaguggugcuguagaucaugcacgcugccgccucuuagguaucgcggagaggacggcuguugguacgguauggaaauucggccauugaaagagaaggaagagaaccuggugaauaguuuaguuaccgcggggcacggacaaguggauaacuucagccucggcguacuggguauggcccuuuuucuggaagagauguugagaacuagggucggcacaaaacaugcuauacuccugguggcagugucguucgucacccuaaucacugggaauauguccuuuaaggaccugggacgcguugugguaauggugggcgccacaauggcugaugacauugggaugggagucaccuaucucgcccugcuugcagcguucaaagugcgacccacguuugccgcuggcuugcuguuacggaagcucacuucuaaggagcugaugaugaccacaaucgguauuguucuucugagccagucaaccaucccugaaacugugcuagagcucacagaugcccuggcauuggggaugaugguccugaaaauagugcguaacauggaaaaguaccaguuagcuguuaccaucauggccauucucugcgugcccaaugcagucauccugcagaacgccuggaaaguaaguuguacaauucuugcugugguuuccgugucuccacuguugcucacuagcucccaacagaagaccgacuggaucccucuggcgcuaacggucaaaggacugaaucccacagccauauuccuuaccacucucucaagaaccaacaagaaaaggagcuggccacugaaugaggcaauuauggcugugggcaugguaaguaucuuggccucuucccuguuaaagaacgacaucccgaugacaggcccucucguggccgggggacugcuuacugucugcuauguucugaccggucgcagcgcugauuuggaacucgagcgggcaacggacgugaagugggaggaucaggccgaaauuucgggcucaucucccauacugaguaucacaauuuccgaggacgggagcaugucuaucaaaaaugaagaggaggaacagacccuaacuauucugaucagaacaggacuucucgugauaagcggccuguuuccaaucuccauucccaucaccgcggcugccugguacuugugggaggucaagaaacaaagggccgguguguuaugggauguuccuucaccacccccuauggggaaggccgaacuggaggacggagcuuaucgaauuaaacagaagggcauccucggcuacagucagauaggggcaggaguauacaaggaagguacuuuccacacaauguggcaugugacccgcggcgccguccugaugcacaaagggaagcggauugagccgagcugggcggaugugaaaaaggaccuuaucucuuauggaggcgguuggaaacuggagggggaauggaaggagggagaagagguucagguguuggcucuagaaccaggcaagaaccccagagccguccaaacgaaaccuggccuguuuaagacuaauaccgggacaaucggagcagugucccucgauuucucaccagguaccaguggcagccccauuaucgacaaaaaggggaaaguagucggacuguacggcaacggugugguuacaagguccggggccuaugugucugcuauagcccagacugagaagucgauugaggauaacccugaaaucgaggacgauauuuuucguaagcgccggcuuaccaucauggacuuacacccgggagcaggcaaaacgaagagauaccugcccgcuauagucagggaagccauuaaacgaggccuccggacauugauccuggcgccaacucgcgugguugccgcagagauggaagaggcucucagagggcugccuaucagguaucagacccccgccauucgggcugagcauacaggacgagaaaucguggaccuuaugugucacgcaaccuucacuaugagacuguugagcccaguccgcgugccuaauuacaaccuaauuauaauggaugaggcccauuucaccgaccccgccucaaucgcugcgagggguuauauuuccacacguguagaaaugggcgaggcagccgggaucuuuaugacggcuacuccaccgggaagucgggauccuuucccccaaucuaaugccccaaucauugacgaggaaagagagauacccgaaaggagcuggaacuccggccacgagugggugaccgauuuuaaggguaaaacaguuugguucgucccuucaaucaaggcagggaaugacauugccgcuugccugcgcaagaacggcaagaaggugauccagcucucucgaaaaaccuuugauagcgaauacgugaagacuagaacaaaugacugggauuucgucguaaccacggacauuagugagaugggcgcgaacuuuaaagccgagcgggugaucgauccaaggcgcuguaugaagcccguuauauuaacugacggcgaagaacgugugauccuggcagggccuaugccggucacacauuccagcgcugcccagagacggggaaggauuggucgcaaucccaaaaacgaaaaugaccaguacaucuauaugggcgagccccuugaaaacgaugaggacugcgcacacuggaaggaggccaagaugcugcucgauaauauuaacaccccugaagggaucauacccucuauguucgagccagaacgagagaaaguggacgcuauugauggagaauacagauugcggggcgaggccaggaagaccuuuguugaccugaugcgcagaggugaucucccuguguggcuggcguauaaagucgcagccgaggggaucaauuacgcugacaggcggugguguuucgauggcauuaagaacaaccaaauccuugaagagaauguggaaguagagauauggacuaaagagggagaacguaagaagcuaaaaccccgcuggcuggacgcccgaaucuauucagauccauuggcuuuaaaggaguuuaaagaguucgcagccggcagaaagucccugacacucaaccugauuaccgagauggggaggcuuccuacauucaugacucagaaaacgcgggacgcucuggauaaucucgccguguugcacaccgcagaagcgggaggucgcgccuacaaccaugcucugagugagcuaccggagacacuggaaacucuccuucuguuaaccuugcuggccacaguuaccggcgggaucuuucucuuccugaugagcggaagaggcauugguaagaugacucuugggaugugcugcaucauaacggcaucgauucugcucugguaugcucagauccagccccacuggaucgccgcaucuauuaucuuggaguuuuuccugauagucuuacuaauuccagaaccugagaagcaaaggaccccacaggacaaucagcugacauacguggugaucgccauucucacugucguugcugcgaccauggccaacgaaaugggcuuucuugagaaaacaaagaaagaccugggauugggcuccaucgcaacccagcaaccagagagcaauauacuggauaucgaccuccggccugcuucagccuggacucuguacgccguggcaacaacguucguaacccccaugcuucgacauaguauugaaaacucuuccgugaaugucagccucacugcuaucgccaaccaggcgacagugcugaugggguugggaaaggguuggccgcugucaaaaauggauauuggcguuccauuacuagcuaucggguguuauagucaggugaauccuauuacccugaccgccgcacuccuucuguuggucgcccacuacgcuaucauaggacccggccugcaggcaaaggccacaagagaggcgcaaaagcgcgcugccgcagguauuaugaaaaacccaacuguagacgggaucacggugaucgaucucgaccccauuccuuaugauccgaaguuugaaaaacagcugggccagguuaugcuuuuaauacugugcgugacccaaguccucaugaugaggacaacuugggccuugugugaggcucugacccuagccacaggacccaucagcacccugugggaaggcaauccagggcgguucuggaacacuacgauugcaguguccauggcuaauaucuuucguggaucuuaccucgccggcgcgggucuucuguucagcauuaugaagaacacaaccaauacuagaagggggaccggaaacaugggcgagacauugggugagaaauggaagucccgccugaacgcccucggcaaaucagaauuucagaucuauaagaagucugggauacaggaggucgaccggacucuggcaaaagaaggaaucaagcgaggcgagaccgaucaccaugcugugaguagagggucggccaaauuaaggugguucguugagcgcaauauggugacaccugaaggaaagguaguggaccuuggcugcgguagagggggauggagcuacuauuguggcggucugaaaaacgucagagagguuaagggccucacgaaagggggacccggccacgaggaaccuauuccaauguccaccuacggguggaaucuagugcgucugcagucuggagucgauguguuuuucaucccaccugaaaaaugcgacacuuugcugugugauauuggcgagucaagcccaaaccccacaguagaggcagguaggacccuccgggugcuuaaucugguugaaaacugguugaauaacaauacucaauucugcaucaaggugcugaacccguacaugccuuccgucauagagaaaauggaagcuaugcagcgcaaguaugggggagcccucgugcgaaauccauuaaguagaaacucuacacaugagauguacugggucagcaaugccucaggcaacauuguguccaguguuaauaugaucagcaggaugcugaucaaccgguuuaccaugcgccacaaaaaggcgacguaugaacccgacguagaccuuggcucugggaccagaaacauuggaauagaguccgagaucccuaaucuggauauuaucgguaagaggauugagaaaaucaagcaggagcaugaaacaucauggcacuacgaccaggaucacccauauaaaacuugggcuuaccauggcagcuaugagaccaagcaaacagggucggcaucuaguauggugaacggagucgugcgacuacucacuaaacccugggacguucugccgaccgugacacagauggccaugaccgauacuacgccuuucggccagcagcgggucuuuaaggaaaagguggacacacguacccaagagcccaaagaggguacuaagaaauugaugaagauaaccgcugaauggcuguggaaagagcucgggaagaaaaagacaccaagaauguguacgcgcgaagaguucaccaggaagguacgguccaaugccgcacuuggagccaucuuuacugaugagaacaaauggaaaagcgcuagagaagcgguggaggacucacgcuucugggaacugguugauaaagagaggaauuuacaccuggaaggcaagugcgagacaugugucuacaacaugaugggcaaacgagagaagaaguugggggaauuuggaaaagccaaggguucccgggcaauuugguacauguggcucggcgcuagauuccuggaguuugaagcccuaggguuccuuaaugaggaccauugguuuucuagggaaaacagccugaguggaguggagggcgagggucuccacaaacugggguauaucuugcgcgauguguccaagaaagaaggaggcgcaauguacgccgacgacaccgcuggcugggauacucguauuacacuggaggaccucaagaaugaagagauggucaccaaccacauggaaggggagcauaagaaacuugccgaggcgaucuucaagcugacauaucagaauaaaguugugcggguacagagaccuacucccaggggaaccgugauggauauuauaagccgccgagaccaacgggguucuggccaggucgggacguacggauuaaacaccuuuacaaauauggaagcacagcugaucagacagauggagggcgaagguguguucaagaacauucaacacuugacuguuaccgaggagguggccguccagaauuggcucgcuaggguggggcgcgaaagacugucacggauggccaucaguggagaugacugcguaguuaaaccacuagaugacagguucgcaaacgcucuuacagcccugaacgauaugggcaagauccguaaggacauucagcagugggagcccuccaaaggcuggaaugauuggacucaagugccuuuuugcagccaucacuuccaugaacucauaaugaaggacgggcgaguccugguggugccaugucgcaaccaggaugaguugaucgguagagcucggauuucucagggagccggcuggucguuaagggaaaccgcaugccuggggaaaucauaugcgcagauguggagccucauguacuuucaccgcagagaccuucggcuggccgcuaaugccaucuguuccgcagucccgagucacuggguucccacgucuaggacaaccuggagcauucaugcuaagcacgaguggaugacuacagaggacaugcuaaccguguggaaccgaguauggauccgugaaaauccuuggauggaggauaaaacuccaguggaauccugggaggaaauacccuaucugggaaagagagaggaccaauggugcggcucacucaucgguuugaccagucgcgccacaugggcaaagaacauucaggccgcgaucaaucagguccggucucugauugggaacgaggaauacacggauuacaugccuagcaugaaaagguucagacgcgaggaagaggaagcuggagugcuuugguga

SEQ ID NO: 14780 - RNA, 9876 nt, Artificial Sequence
  derived and/or modified CDS sequence (opt3) from DENV-2__EU677138__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucagagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccaacagaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaagugggaggaucaggccgaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagcggcugccugguacuugugggaggugaagaaacaaagggcaggugucuuaugggaugugccuuccccacccccuauggggcgagccgaacuggaggacggagcuuaucgcauaaagcagaaaggcauucucggcuacucacagaucggggcaggaguuuacaaggaagguaccuuccacacuauguggcauguaacacggggcgccgugcugaugcacaaggggaaaagaaucgagccgaguugggcggaugucaagaaagaccuuauuagcuauggaggcgguuggaagcuggagggggaauggaaagagggagaagaggugcagguuuuggcucuagaaccaggcaagaaucccagggccgugcaaaccaagccuggccuguuuaaaacgaacacugggaccaucggagcagucucucucgauuucuccccagguacaucaggcagucccauaauugacaagaaagggaaggugguaggacuguacggcaacggugucgugacccguagcggggccuauguuuccgcuaucgcccagacagagaaaucuauugaggauaauccugaaaucgaggacgauauauuucgcaagcggagacuuacuauuauggacuuacacccgggagcaggcaagaccaaaagguaccugcccgcuaucgugcgagaagccaucaagcggggccuccgcacguugauucuggcgccaacaagagucguggccgcagagauggaagaggcucucagggggcugccuauccgguaucagacucccgccauucgagcugagcauaccggaagagaaauaguugaccuuaugugucacgcaacauucaccaugcgccuguugucgccagugagggucccuaacuacaaucuaaucauuauggaugaggcccauuucacugaccccgccagcaucgcugcgcgugguuauaucucaacccggguggaaaugggcgaggcagccgggauuuuuaugacagcuacgccaccgggauccagagauccuuucccccaaaguaacgccccaauaaucgacgaggaaagggagauucccgaacgcucuuggaauagcggccacgaguggguaacugauuuuaaagguaagaccgugugguucguuccuuccaucaaagcagggaacgacauugccgcuugccugcgaaagaauggaaagaaagucauccagcucucaagaaagacauuugauucugaauacgugaaaacccggacuaacgacugggauuucguggucacaaccgacauaagcgagaugggcgcgaauuuuaaggccgagaggguaaucgauccacgccguuguaugaaacccgugauuuuaacggacggcgaagagagaguuauccuggcagggccuaugccggugacucauaguuccgcugcccagcggaggggacgcauuggucgaaacccaaagaaugaaaacgaccaguacaucuauaugggcgagccccuugaaaaugaugaggacugcgcacacuggaaagaggccaagaugcugcucgauaacauaaauacaccugaagggauuauccccagcauguucgagccagaaagagagaaggucgacgcuauugauggagaauaccgguugaggggcgaggcccgcaaaaccuuuguggaccugaugagaaggggugaucucccuguuuggcuggcguauaagguggcagccgaggggaucaacuacgcugaccggcguugguguuucgauggcauaaaaaacaaucaaauccuugaagagaacgucgaaguggagauuuggaccaaggagggagaacgcaaaaagcuaaagccccgauggcuggacgccagaaucuauucugauccauuggcuuuaaaagaguuuaaggaauucgcagccggcaggaaaucacugacucucaaucugauuacagagauggggcggcuuccuaccuucaugacacagaagacucgcgacgcucuggauaaccucgccguauugcacacggcagaagcgggagguagagccuacaaucaugcucuguccgagcuaccggagacccuggaaacacuccuucuguuaacuuugcuggccaccgugacaggcgggaucuuucucuuccugaugaguggaaggggcauagguaaaaugacccuugggaugugcugcauuaucacugcaagcauccugcucugguaugcucagauucagccccacuggaucgccgcaucgauaauuuuggaguuuuuccugaucguuuuacuaauuccagaaccugagaagcaacggacgccccaggacaaccagcugaccuacgucgugaucgccauacucacaguggucgcugcgacuauggccaaugaaaugggcuuucuugagaagaccaaaaaggaccugggauugggcucuaucgcaacacagcaaccagaguccaacauucuggauaucgaccuccgaccugcuagcgccuggacccuguacgccguugcaacuacauucgugacgcccaugcuuagacauucaauugaaaauaguucuguaaacgugucccucaccgcuaucgccaaucaggcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaagccacccgcgaggcgcaaaagagggcugccgcagguaucaugaagaauccaacagucgacgggauuacuguaauagaucucgaccccaucccuuaugauccgaaauuugaaaagcagcugggccaggugaugcuuuuaauucugugcguuacgcaagugcucaugaugcggaccacaugggccuugugugaggcucugacucuagccaccggacccaucaguacacugugggaaggcaacccagggcguuucuggaauaccacuauugcagucagcauggcuaacaucuuuagaggauccuaccucgccggcgcgggucuucuguucucuauaaugaaaaauacgacaaacaccaggcgcgggacuggaaacaugggcgagaccuugggugagaaguggaaaagccggcugaaugcccucggcaaguccgaauuucagaucuauaaaaagucagggauucaggagguggaccgaacacuggcaaaggaaggaaucaaaagaggcgagacugaucaccaugcugucucuagggggagugccaaguuacgcugguucguggagcggaacaugguuaccccugaaggaaaagugguagaccuuggcugcgguagagggggauggucguacuauuguggcggucugaagaaugugcgugaggucaaaggccucacaaaggggggacccggccacgaagagccuauuccaaugagcacguacggguggaaccuaguuaggcugcaguccggaguggaugucuuuuucauccccccugaaaagugcgacaccuugcugugugauauaggcgagucuucaccaaaucccacuguggaggcaggucggacacuccgcguacuuaaccugguggaaaauugguugaacaauaacacccaauucugcauuaaaguucugaauccguacaugccuagcgugaucgagaagauggaagcucuccagcgaaaauaugggggagccuuagucagaaacccacuguccaggaauaguacucaugagauguacugggugucuaacgccagcggcaauaucgucucauccgugaacaugauuagucggaugcuuauaaaccgcuuuacaaugagacacaagaaagcgaccuaugaacccgacguugaccugggcagcgggacgaggaauaucggaauugagucugagaccccuaaccuagauaucauugguaagcgaaucgaaaagauaaaacaggagcaugaaacauccuggcacuacgaccaggaucacccauauaagacuugggcuuaccauggcucauaugagaccaaacaaacagggagcgcaucgucuaugguaaauggagugguccggcuccugacuaagcccugggacguguugccgaccguuacacagauggccaugaccgauacuacgccuuucggccagcagcguguguuuaaagaaaaggucgacacaagaacccaagagcccaaggaggguacuaaaaagcugaugaaaaucaccgcugaauggcucuggaaggagcuugggaaaaagaaaacaccacgcauguguacgagggaagaguucacccggaaggugagaaguaacgccgcacugggagccauuuuuacugaugagaauaaguggaaauccgcucgcgaagcgguagaggacagcagguucugggaauuaguggauaaggagcgaaaccugcacuuggaaggcaaaugcgagacauguguuuacaauaugaugggcaagcgggagaaaaagcucggggaauuuggaaaggccaaagguucaagagcaaucugguacauguggcugggcgcuagguuccuagaguuugaagcccuuggguuccugaacgaggaccauugguuuucccgcgaaaauucucucagcggagucgagggcgagggucugcacaaguugggguauauucugcgugaugugaguaaaaaggaaggaggcgcaauguacgccgacgacaccgcuggcugggauacucggaucacacucgaggaccuuaaaaacgaagagauggugaccaaucacauggaaggggagcauaagaagcuggccgaggcgauuuucaaauuaacauaucagaacaaggucguuagagugcagaggccuacuccccgcggaaccguaauggauauaaucucccgacgggaccaaagagguagcggccagguggggacguacggacugaauaccuuuacaaacauggaagcacaguugauuaggcagauggagggcgaaggugucuucaaaaauauccaacaccucacugccaccgaggagguggcuguucagaacuggcuggcccgcguggggagagaacggcuaucuaggauggcaaucucaggagaugacugcgucgugaagccacuugaugaccguuucgcuaacgcccugacagcucucaaugauaugggcaaaauucgaaaggacauacagcagugggagcccaguaagggcuggaacgauuggacucaaguaccuuuuugcucccaucacuuccaugaacugaucaugaaagacgggcgcguuuugguggucccauguagaaaucaggaugaguuaauuggacgggccaggaucagccagggugcaggcuggucucugcgcgaaaccgcgugccucgggaagucguaugcccagauguggucacuuauguacuuucacagacgggaccugaggcuagcugccaacgcaauuuguagcgcugugccgucccacugggugcccacgagucgaacaaccuggucuauccaugccaaacacgaguggaugacuacagaggacaugcugaccgucuggaaucguguuuggauaagagaaaacccuuggauggaggauaagacuccaguggaaagcugggaggaaauccccuaucucggaaaacgcgaggaccaauggugcggcuccuugauuggucugaccucacgggcaacaugggccaagaauauccagguagcgauuaaccaggugaggagucuuaucgggaaugaggaauacacggauuacaugccuucuaugaagagauuccgccgggaggaagaggaagcuggaguccugugguga

SEQ ID NO: 14781 - RNA, 9876 nt, Artificial Sequence
  derived and/or modified CDS sequence (opt3) from DENV-2__EU677149__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaagcuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggaaagaagguacgugcucgggcggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcgaggugccaagcgcauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucuagaagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuaggucugucacucggcucgagaaucugauguggaagcagaucacacccgaauuaaaccacauucuggcagagaaugaaguuaaacuaaccaucaugacuggcgauauaaaggggaucaugcaagccggaaaacgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucaacacaauuaccggccuggcuaccacacgcagauugcugguccauggcaucugggcaagcuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaagagaaggaagagaaucuggugaacucauuaguuacggcggggcacggacagguggauaauuucagucucggcguacuggguauggcccuuuuucuggaagagauguugaggacccgcgucggcacuaaacaugcuauccuccugguggcagugagcuucgucacacuaauuaccgggaacaugucguuuaaggaccugggacgaguugugguaauggugggcgccacuauggcugaugacaucgggaugggagucacauaucucgcccugcuugcagcguucaaagugcggcccaccuuugccgcuggcuugcuguuacguaagcucacguccaaggagcugaugaugacuaccauugguaucguucuucugucucaaagcacaauaccugaaaccgugcuagagcucacugaugcccuggcauuggggaugaugguccugaaaaucgugagaaauauggaaaaguaccaguuagcuguuacaauuaugaccauccucugcgugcccaacgccgucauucugcagaaugcauggaaaguaucauguacaauccuugccgugguuaguguguccccacuguugcucacuucuagcaggcagaagaccgacuggauaccucuggcucuaacgauuaaaggacugaaccccacagcgaucuuccuuaccacucucucccgcaccaauaagaaacggucauggccacugaacgaggccaucauggcagucggcauggugagcauuuuggcuaguucucuguuaaagaaugacauaccgaugacaggcccucucguagccgggggacugcuuacugugugcuauguccugaccgguagauccgccgauuuggaacucgagagggcuacggacguuaagugggaggaucaagcagaaaucagcggcucgucacccauucugucuaucacaauuagugaggacggguccaugagcaucaaaaacgaagaggaggaacagacccuaacuauacugauccgaacaggacuucucgugauuucuggccuguuuccaaucagcauucccaucaccgccgcggcuugguacuugugggaggugaagaaacagcgcgccggugucuuaugggaugugccuuccccacccccuauggggaaggcagaacuggaggacggagccuaucggauaaaacagaagggcauucucggcuacucacaaaucggggcuggaguuuacaaggaagguacuuuccacacaauguggcauguaaccagaggcgcagugcugaugcacaaagggaagaggaucgagccgaguugggccgaugucaaaaaggaccuuauuagcuauggaggcgguuggaaacuggagggggaauggaaggagggagaagaggugcagguuuuggcgcuagaaccaggcaagaauccccgugcugugcagacgaaaccuggccuguuuaagacuaacaccgggacaaucggagccgucucucucgauuucuccccagguaccucaggcagucccauaauugacaaaaaggggaaagugguaggacuguacggcaacggugucgugacacgcagcggggcauauguuuccgccaucgcucagacugagaagucuauugaggauaauccugaaaucgaggacgauauauuucggaagagaaggcuuaccauuauggacuuacacccgggagccggcaaaacgaagcgauaccugcccgcaaucgugcgggaagcuaucaaacgcggccucagaacauugauucuggccccaacuagggucguggcggccgagauggaagaggcacuccgggggcugccuauccgauaucaaacccccgcuauuagagccgagcauacaggacgcgaaauaguugaccuuaugugucacgcuaccuucacuaugaggcuguugucgccagugcgugucccuaacuacaaucuaaucauuauggaugaggcacauuucaccgaccccgccagcaucgccgcucgggguuauaucucaacaagaguggaaaugggcgaggcggcagggauuuuuaugacggccacuccaccgggauccagggauccuuucccccagaguaacgcuccaauaaucgacgaggaacgcgagauucccgaacgaucuuggaauagcggccacgaguggguaaccgauuuuaaggguaaaacagugugguucguuccuuccaucaaggccgggaacgacauugcagccugccugagaaagaauggaaaaaaggucauccagcucucacggaaaaccuuugauucugaauacgugaagacuaggacaaacgacugggauuucguggucaccacggacauaagcgagaugggcgcuaauuuuaaagcggagcgcguaaucgauccacguagauguaugaagcccgugauuuuaacugacggcgaagagcggguuauccuggccgggccuaugccggugacacauaguuccgcagcucaaaggcgcggacgaauugguagaaacccaaaaaaugaaaacgaccaguacaucuauaugggcgagccccuugaaaaugaugaggacugcgcccacuggaaggaggcaaagaugcugcucgauaacauaaauaccccugaagggauuauccccagcauguucgagccagaacgggagaaagucgacgccauugauggagaauacagguugcgcggcgaggcuagaaagaccuuuguggaccugaugaggcggggugaucucccuguuuggcuggccuauaaaguggcggcagaggggaucaacuacgccgaccgucgcugguguuucgauggcauaaagaacaaucagauccuugaagagaacgucgaaguggagauuuggacuaaagagggagaacgaaagaagcuaaaacccagauggcuggacgcuaggaucuauucugauccauuggccuuaaaggaguuuaaagaauucgcugcaggccggaagucacugacacucaaucugauuaccgagauggggcgccuuccuacauucaugacucagaaaacgagagacgcccuggauaaccucgcuguauugcacaccgccgaagcaggagguagggcguacaaucaugcccuguccgagcuaccggagacacuggaaacucuccuucuguuaaccuugcuggcuacagugaccggcgggaucuuucucuuccugaugaguggacggggcauagguaagaugacucuugggaugugcugcauuaucacggccagcauccugcucugguaugcacaaauucagccccacuggaucgcugccucgauaauuuuggaguuuuuccugaucguuuuacuaauuccagaaccugagaagcagcgaaccccccaggacaaccaacugacauacgucgugaucgcaauacucacuguggucgccgcuaccauggcgaaugaaaugggcuuucuugagaaaacaaagaaagaccugggauugggcucuaucgccacccagcagccagaguccaacauucuggauaucgaccucagaccugcaagcgcuuggacucuguacgccguugccacaacguucgugacccccaugcuucgccauucaauugaaaauaguucuguaaacgugucccucacugcaaucgcuaaucaggccacaguccugaugggguugggaaaggguuggccgcugagcaaaauggauauuggcgugccauuacuagcgaucggguguuauucacaaguuaacccuauaacccugaccgcugcccuccuucuguugguggcacacuacgccauuaucggacccggccugcaggcuaaggcaacaagggaggcccagaagcgggcggcugccgguaucaugaaaaauccaacugucgacgggauuacgguaauagaucucgaccccaucccuuaugauccgaaguuugaaaaacagcugggccaagugaugcuuuuaauucugugcguuacccaggugcucaugaugcguacaacuugggcauugugugaggcccugacccuagcuacaggacccaucaguacccugugggaaggcaacccagggagauucuggaauacuacgauugccgucagcauggcaaacaucuuuaggggauccuaccucgcuggcgccggucuucuguucucuauaaugaagaauacaaccaacacucgccgggggaccggaaacaugggcgagacauugggugagaaauggaagagccgacugaaugcgcucggcaaauccgaauuucagaucuauaagaagucagggauucaagagguggacagaacucuggccaaagaaggaaucaagaggggcgagaccgaucaccaugcagucucucgcgggagugcuaaauuacggugguucguggagagaaacaugguuacaccugaaggaaaggugguagaccuuggcugcggucgugggggauggucguacuauuguggcggucugaaaaaugugagggaggucaagggccucacgaaggggggacccggccacgaagagccuauuccaaugagcaccuacggguggaaccuaguucggcugcaguccggaguggaugucuuuuucauccccccugaaaaaugcgacacuuugcugugugauauaggcgagucuucaccaaaucccacaguggaggccggucgcacccuccgaguacuuaaccugguggaaaauugguugaacaauaacacucaguucugcauuaagguucugaauccguacaugccuagcgugaucgagaaaauggaagcacuccagagaaaguaugggggagcuuuagucaggaacccacugucccggaauaguacacaugagauguacugggugucuaacgccagcggcaauaucgucucauccgugaacaugauuagucgcaugcuuauaaacagauuuaccaugaggcacaaaaaggccacguaugaacccgacguugaccugggcagcgggacccgaaauaucggaauugagucugagaucccuaaccuagauauuaucgguaagcggauagaaaaaaucaagcaagagcaugaaacauccuggcacuacgaccaggaucacccauauaaaacuugggcguaccauggcucauaugagaccaagcagacagggagcgcuucgucuaugguaaauggagugguccgucuccugacuaaacccugggacguguugccgaccguuacacagauggcaaugaccgauacuacgccuuucggccaacagagaguguuuaaggaaaaggucgacacacgcacccaggagcccaaagaggguacuaagaaacugaugaagauuaccgccgaauggcucuggaaagagcuugggaagaaaaagacaccaaggauguguacgcgggaagaguucaccagaaaggugcgcaguaacgcugcccugggagcaaucuuuacugaugagaauaaauggaaguccgccagggaagcuguagaggacagccgauucugggaauuaguggauaaagagcggaaccugcacuuggaaggcaagugcgagacauguguuuacaauaugaugggcaaaagagagaagaagcucggggaauuuggaaaagcgaaggguucaagggccauuugguacauguggcugggcgcacgcuuccuagaguuugaagcucuuggguuccugaacgaggaccauugguuuucccgugaaaauucucucagcggagucgagggcgagggucugcacaaauugggguauauccugcgggaugugaguaagaaagaaggaggcgccauguacgcagacgacaccgccggcugggauacuagaauuacacucgaggaccuuaagaacgaagagauggugaccaaucacauggaaggggagcauaagaaacuggcugaggccauauucaaguuaacauaucagaacaaagucguuagggugcaacgcccuacuccccgaggaaccguaauggauaucauuucccggagagaccagagggguagcggccagguggggacguacggacugaauaccuuuacaaacauggaagcgcaauugauccgccagauggagggcgaaggugucuucaagaauauccagcaccucacugugaccgaggagguugcagugcagaacuggcuggccagagucgggcgggaaaggcuaucucguauggcuauuucaggagaugacugcgugguaaaaccacuugaugaccgauucgccaacgcacugacagcucucaaugauaugggcaagauacgcaaggacauccaacagugggagcccaguaaaggcuggaacgauuggacucagguuccuuuuugcucccaucacuuccaugaacugauuaugaaggacgggagaguguuggucgugccaugucggaaucaggaugaguuaaucggaagggcccgcauuagccaaggugcuggcuggucucugagagaaaccgccugccucgggaaaucguaugcacagauguggucacuuauguacuuucaccggagggaccugcgacuagcggccaacgcuaucuguagcgccgugccgucccacuggguccccacgagucguacaaccuggucuauacaugcaaagcacgaguggaugacuacagaggacaugcugaccguuuggaauaaaguguggaucagagaaaacccuuggauggaggauaagacuccaguagaaagcugggaggaaauucccuaucucggaaagcgcgaggaccaguggugcggcuccuugaucggucugaccucacgggcuacaugggccaaaaauauucaggcagccaucaaccaagugaggagucuuauagggaaugaggaauacacggauuacaugccuucuaugaagagauuccgccgggaggaagaggaagcgggaguccugugguga

SEQ ID NO: 14782 - RNA, 9876 nt, Artificial Sequence
  derived and/or modified CDS sequence (opt3) from DENV-2__FJ024452__SS-prME
agcgccggcaugaucauuaugcugauccccaccgugauggcuuuccaccucacuacucggaacggggagccucauaugaucgucgguauucaagaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcggucaccggcgcgagaagcgaaguguagcccuggugccccaugucgggaugggacuugaaacucguaccgagacauggaugagcuccgaaggcgcguggaaacacgcucagagaaucgagacuuggauacugaggcauccuggcuucaccaucauggccgcaauuuuggccuacacaaucgggaccacgcacuuucagcgggugcucauuuucauccugcugacugcuguugcaccaucuaugacaaugcgcugcauaggaauuucgaacagagauuuuguggagggugucucaggcgggagcuggguggacaucguacucgaacacggaaguuguguuaccacuauggccaagaauaagcccacauuagauuucgagcugauuaaaaccgaagcuaagcagccugccacgcuuaggaaauauugcaucgaggcgaaguugaccaacacaacuaccgaaucccgguguccaacacaaggcgagcccucucugaaagaggaacaggacaagcgcuuuaucugcaagcauagcaugguggaucgagguugggggaauggauguggccuauucggcaaagggggaauugucacuugcgcaauguuuaccugcaagaaaaacauggaggguaagauagugcagccugaaaaucucgaguacacaaucguggucaccccacacuccggcgaagaacaugccguugggaacgacacuggaaaacacggcaaggagauuaaagugacgccgcagucaaguaucacagaagcugagcugaccgguuaugggacuguaaccauggaauguagccccagaacaggccuugauuucaaugagauggugcuguugcaaauggaaaacaaggccuggcucguccacaggcagugguuucuggacuuaccucugccauggcuccccggagcagauaagcaggagucuaauuggauacagaaagagacccuugugacuuucaagaacccucaugcuaaaaagcaagacguugugguccugggcucccaggaaggggccaugcacacagcguugacgggagccaccgagauucagaugucaagcgguaaucuacuguuuacuggccaucucaaaugccggcugcguauggacaaacuucaacugaaggggaugaguuacucuauguguacaggaaaauucaaggugguaaaagaaaucgcagagacccagcacggcacaaucguuauucgcgugcaguaugagggugauggguccccaugcaagauccccuucgaaauuauggacuuggagaaaagauacguccucggcaggcugauaacugugaacccgaucgucaccgaaaaggauagcccugugaacauugaggcugaacccccauuuggagacucguacaucaucauuggcguugagccugggcaguuaaagcugaauugguucaaaaagggaucuuccauaggucaaauguuugagacgaccaugcggggcgccaaacgaauggcuauccuaggggauacagccugggacuucggaucacucggcgguguguuuacaaguauugggaaggcacugcaucagguauucggcgccaucuauggagcugcguuuagcggcgucuccuggaccaugaaaauucuuaucggggugauaaucacauggauuggaaugaacucucgcagcacuucauugaguguuucccuggugcucgucggcaucgugacccuguaccuugguguaauggugcaggcagauagcggguguguugucucuuggaagaauaaggaacugaaaugcggaucaggcauuuucaucacggacaacgugcacacauggaccgagcaguauaaguuucaacccgaaaguccaagcaaauuggccuccgcuauacagaaggcccaggaggaagguauuuguggcaucagaucugugacuaggcucgagaaucugauguggaaacagauuacacccgaguuaaaccacauccuggcagaaaaugaggucaagcuaaccauaaugacuggggauaucaaaggaauuaugcaagccggcaagcggucgcuccgcccucagccaaccgaacugaaguacagcuggaaaacaugggggaaggcuaaaaugcuuuccacggagucauauaaccagaccuucuugaucgacggaccggaaacugccgagugccccaauacaaacagagcauggaauagucuggagguugaagauuacggcuuugguguguucaccacaaacauuuggcucaagcugaaagagaagcaggacgcguuuugugacucuaaguuaaugagcgcugccaucaaagauaauagggcagugcaugccgacaugggguauuggauagaauccgcucugaacgauacuuggaagauugagaaagccucauucaucgagguaaagaauugccacuggccuaaaagccauacccuuuggucuaacggagucuuggaauccgagaugaucauuccaaagaaccucgcaggccccgugagucaacacaauuaccguccugguuaccacacgcagaucgcuggcccauggcaucuggggaagcuagaaauggacuucgauuuuugugacggaacaaccguuauugugacugaggauugcggcaaccgggggcccagccugcgaaccacaacugccucuggaaaacucauaaccgaauggugcuguagauccugcacacugccgccucuuagguaucgcggcgaggacgguuguugguacgggauggagauccggccauugaaggaaaaagaggaaaaucuggucaacucauuagugacggcgggacacggccagguugauaauuucagucucggugugcugggcauggcccuuuuucuggaggaaauguugagaaccaggguagggacuaagcaugcuauucuccuggucgcagugagcuucgugacacuaaucaccggaaacaugucguuuaaagaccugggccgcgucguugugaugguaggggccacuauggcugaugacauuggaaugggcgugacauaucucgcccugcuugcagcguucaagguccgacccaccuuugccgcugguuugcuguuacggaagcucacguccaaagagcugaugaugacuaccaucgggauagugcuucugucucaaagcacaaucccugagaccguucuagaacucacugaugcccuggcauugggaaugauggugcugaagauuguccguaauauggagaaauaccaguuagcugugacaaucauggccauucucugcguucccaacgcagugauccugcagaaugccuggaaggucucauguaccauacuugcuguagugaguguuuccccacuguugcucacaucuagccagcagaagacugacuggauuccucuggcgcuaaccaucaagggccugaaccccacggccaucuuccuuacaacccucuccagaacuaauaaaaagaggucauggccacugaacgaagcaauuauggcugugggcauggucagcauauuggccaguucucuguuaaagaaugacaucccgaugaccgggccucucguggccggaggucugcuuacaguaugcuaugugcugacuggccgcuccgcugauuuggagcucgaacgggcaaccgacgucaaaugggaggaucaggccgagauuagcgggucgucacccauccugucuauuacgaucagugaagacggauccaugagcauaaagaacgaggaagaggagcagacacuaaccauccugauuagaacuggccuucucguuaucucuggucuguuuccaauuagcauccccauaacagcggcugccugguacuugugggaagugaaaaagcagagggcagggguguuaugggaugucccuuccccacccccuaugggaaaagccgagcuggaagacggcgcuuaucgaauuaagcaaaagggcauccucggguacucacagaucggagcaggaguguacaaagagggcaccuuccacacuauguggcauguuacacgcggggccguacugaugcacaagggaaaacggauugaaccgaguugggcggaugugaagaaagaccuuaucagcuauggcgguggguggaagcuggagggagaguggaaggaaggcgaggaaguccagguguuggcucuagagccaggcaaaaaucccagagccguucagaccaagccugggcuguuuaaaacgaacacuggaaccauaggugcagugucucucgauuucuccccaggcacaucagggagucccauuaucgacaagaaaggaaaggucgugggccuguacgguaacgggguagucaccaggagcggagccuauguguccgcuauugcccaaacaggcaagucuaucgaagauaauccugagauagaggacgauauuuuucguaaacgccggcuuacuaucauggacuuacacccgggcgcagggaagaccaaaagauaccugcccgcuaucguuagggaagccauuaagcgaggacuccggacguugauccuggcgccaacacgcguggucgccgcagagauggaagaggcucucagaggucugccuauuagguaucagacucccgccauacgggcugaacauaccggccgagagaucguggaccuuaugugucacgcaacauucaccaugagacuguugucgccaguucgcgugccuaacuacaaucuaauuaucauggaugaggcccauuucacugaccccgccagcaucgcugcgaggggguauauuucaacccgugucgaaaugggagaggcagccggcauauuuaugacagcuacgccaccggguucccgggauccuuucccccagaguaacgccccaaucauugacgaagagagagagauccccgaaaggucuuggaauagcgggcacgagugggugacugauuuuaaaggaaagaccguaugguucgugccuuccauuaaggcaggcaacgacaucgccgcuugccugcgcaaaaauggcaagaaaguuauacaacucucacgaaagacauuugauucugaauacgucaaaaccagaaucaacgacugggauuucguggugacuacagacauuagcgagaugggggcgaauuuuaaggccgaacgggucaucgauccaaggcgcuguaugaaacccguaauuuuaaccgacggagaggagcgugugauccuggcagguccuaugccgguuacgcauaguuccgcugcccagagacggggcaggauagggcgcaacccaaagaaugaaaacgaccaguacauuuauaugggagagccccuugaaaaugaugaggacugcgcacacuggaaggaagccaaaaugcugcucgauaacaucaauacuccugagggcauuauccccagcauguucgagccagaacgagagaagguggacgcuauagauggugaauacagauugagaggggaagccaggaaaacauuugucgaccugaugcgcagaggcgaucucccuguguggcuggcguauaagguugcagccgaaggaaucaacuacgcugacaggcggugguguuucgauggcauuaaaaacaaucagauccuugaggagaacguggaagucgagauuuggaccaaggaaggggagcguaagaaacuaaagccccgcuggcuggacgcccgaaucuauucugauccauuggcuuuaaaagaguuuaaggaguucgcagccggaagaaaaucacugacccucaaucugauaacugagauggguaggcuuccuacauucaugacccaaaagacacgggacgcucuggauaaccucgccguguugcacacugcagaagcgggcgggcgcgccuacaaucaugcucuguccgagcuaccggaaacgcuggagacccuccuucuguuaacauugcuggccacuguaaccggaggcauuuuucucuuccugaugagugguagagggaucggcaagaugacacuuggaaugugcugcaucauuaccgcaagcauccugcucugguaugcucagauacagccccacuggauugccgcaucgaucauuuuggaguuuuuccugaucguguuacuaauaccagaaccugagaaacagaggacuccccaagacaaccagcugacguacguugucaucgccauucucaccgugguggcugcgacaauggccaaugaaaugggcuuucuugagaagacuaaaaaggaccugggguugggaucuaucgcaacccagcagccagaauccaacauucuggauaucgaccuccggccugcuagcgccuggacacuguacgccgucgcaaccacuuucguuacacccaugcuucgacauucaauugagaauaguucugugaacguaucccucacggcuaucgccaaucaagcgaccgugcugauggguuugggcaaaggguggccgcugagcaagauggauauaggagucccauuacuagcuauuggcuguuauucacaggugaacccuaucacucugacagccgcacuccuucuguugguugcccacuacgcuaucauuggucccgggcugcaggcaaaggccaccagagaggcgcagaaacgcgcugccgcaggcauaaugaagaauccaaccguggacggaaucacagucauugaucucgaccccaucccuuaugauccgaaauuugaaaagcaacugggccagguaaugcuuuuaauucugugcgugacucagguucucaugaugaggacgaccugggccuugugugaggcucugacacuagccacugggcccaucaguacccugugggaaggaaacccaggccgguucuggaauacaaccauagcagugagcauggcuaacaucuuucgugguuccuaccucgccggggcgggacuucuguucucuauuaugaaaaauacuacgaacacaagaaggggcaccgguaacaucggcgagacuuugggggaaaaguggaaaagccgccugaaugcccucggaaaguccgaguuucaaauuuauaagaaaucaggcauccaggaggucgaccggacccuggcaaaggaagggauaaaacgaggagagacagaucaccaugcugugucuagaggcagugccaaguuaaggugguucgucgaacgcaacauggugacuccugaggguaaaguuguggaccuugggugcggacggggcgguuggucguacuauuguggcgggcugaagaauguaagagaggugaagggacucaccaaaggcgggcccggacacgaggagccuauuccaaugagcacauacggcuggaaccuaguccgucugcaguccgguguugauguguuuuucauacccccugaaaagugcgacacguugcugugugauaucggggagucuucaccaaaucccaccgucgaagcaggaaggacucuccgggugcuuaaccugguagagaauugguugaacaauaacacacaguucugcauuaaagugcugaauccguacaugccuagcguuauagagaagauggaagcucuccaacgcaaauauggcggcgccuuagugcgaaacccacuguccagaaauaguacccaugagauguacugggucucuaacgccagcgggaauaucgugucauccgucaacaugauuaguaggaugcuuaucaaccgguuuacuaugcgccacaagaaggcgacauaugaacccgacguggaccugggaagcgguaccagaaauauuggcaucgagucugaaauaccuaaccuagauaucauugggaaaaggaucgagaagauuaaacaggagcaugaaacguccuggcacuacgaccaggaucacccauauaagaccugggcuuaccauggaucauaugagacaaaacagacuggcagcgcaucgucuaugguuaaugguguagugcgacuccugaccaagcccugggacgucuugccgacagugacucaaauggccaugaccgauacaaccccuuucgggcagcagcggguuuuuaaggaaaaaguggacacucguacgcaggagcccaaggaaggaacuaaaaagcugaugaaaaucaccgcugaguggcucuggaaggagcuuggcaaaaagaagacuccaagaauguguacccgcgaagaguucacaaggaaaguccggaguaacgccgcacugggcgccauuuuuacggaugaaaauaaguggaaauccgcuagagaggcgguggaggacagccgcuucugggaauuaauagauaaggagaggaaccugcacuuggaagggaaaugcgagaccuguguauacaauaugaugggaaagcgagaaaagaaacucggugaguuuggcaaggccaaagggucacgggcaaucugguacauguggcugggagcuagauuccuagaguuugaagcccuuggcuuccugaacgaggaccauugguuuuccagggaaaauucucucagcgguguggagggggaaggacugcacaaguugggcuauauucugcgcgauguuaguaaaaaggagggcggggcaauguacgccgacgacacugcuggaugggauacacguaucacccucgaggaccuuaagaacgaagagauggucacuaaucacauggaaggugagcauaaaaagcuggccgaagcgaucuucaaauuaacauaucaaaacaagguggugcggguccagagaccuacccccaggggcacaguuauggauauuauaucccgccgagaccagcgggggagcggacaagugggcacuuacggucugaauaccuuuacgaacauggaggcacaguugaucagacagauggagggggaaggaguauucaaaaauauucagcaccucaccgugacagaggaagucgccgugcaaaacuggcuggcuaggguuggccgcgagagacuaucucggauggccaucucaggcgaugacugcguggucaagccacuugaugacagguucgcaaacgcucugacugcccucaaugauauggggaaggugcguaaagacauucagcagugggagcccaguaagggauggaacgauuggacccagguaccuuuuugcucccaucacuuccaugaacugaucaugaaagacggucgaguuuugguggucccaugucgcaaucaagaugaguuaauagcuagagcccggaucagccagggcgcaggguggucucugagggaaacagcgugccucggaaagucguaugcccagauguggucacuuauguacuuucaccgcagagaccugcggcuagcugccaacgcaauuuguagcgcugugccgucccacugggugcccacaaguaggaccacguggucuauccaugccaaacacgaguggaugacaaccgaagacaugcugacugucuggaaucgaguuuggauucgugagaacccuuggauggaggauaagacaccaguggaaagcugggaggaaauccccuaucucggcaagagagaggaccaguggugcgguuccuugauagggcugaccucacgcgcaacuugggccaaaaauauucaagcggcuaucaaccagguacggagucuuauuggaaaugaagaguacaccgauuacaugccuucuaugaagagguucagacgcgaggaagaggaagccggcgugcugugguga

SEQ ID NO: 14783 - RNA, 9876 nt, Artificial Sequence
  derived and/or modified CDS sequence (opt3) from DENV-2__FJ205877__SS-prME
agcgcaggaaugaucauuaugcugauaccaaccgugauggcuuuccaccucacuacuagaaacggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggaaagaagguacgugcucgggcggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcgaggugccaagcgcauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucuagaagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuaggucugucacucggcucgagaaucugauguggaagcagaucacacccgaauuaaaccacauucuggcagagaaugaaguuaaacuaaccaucaugacuggcgauauaaaggggaucaugcaagccggaaaacgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucaacacaauuaccggccuggcuaccacacgcagauugcugguccauggcaucugggcaagcuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaagagaaggaagagaaucuggugaacucauuaguuacggcggggcacggacagguggauaauuucagucucggcguacuggguauggcccuuuuucuggaagagauguugaggacccgcgucggcacuaaacaugcuauccuccugguggcagugagcuucgucacacuaauuaccgggaacaugucguuuaaggaccugggacgaguugugguaauggugggcgccacuauggcugaugacaucgggaugggagucacauaucucgcccugcuugcagcguucaaagugcggcccaccuuugccgcuggcuugcuguuacguaagcucacguccaaggagcugaugaugacuaccauugguaucguucuucugucucaaagcacaauaccugaaaccgugcuagagcucacugaugcccuggcauuggggaugaugguccugaaaaucgugagaaauauggaaaaguaccaguuagcuguuacaauuaugaccauccucugcgugcccaacgccgucauucugcagaaugcauggaaaguaucauguacaauccuugccgugguuaguguguccccacuguugcucacuucuagcaggcagaagaccgacuggauaccucuggcucuaacgauuaaaggacugaaccccacagcgaucuuccuuaccacucucucccgcaccaauaagaaacggucauggccacugaacgaggccaucauggcagucggcauggugagcauuuuggcuaguucucuguuaaagaaugacauaccgaugacaggcccucucguagccgggggacugcuuacugugugcuauguccugaccgguagauccgccgauuuggaacucgagagggcuacggacguuaagugggaggaucaagcagaaaucagcggcucgucacccauucugucuaucacaauuagugaggacggguccaugagcaucaaaaacgaagaggaggaacagacccuaacuauacugauccgaacaggacuucucgugauuucuggccuguuuccaaucagcauucccaucaccgccgcggcuugguacuugugggaggugaagaaacagcgcgccggugucuuaugggaugugccuuccccacccccuauggggaaggcagaacuggaggacggagccuaucggauaaaacagaagggcauucucggcuacucacaaaucggggcuggaguuuacaaggaagguacuuuccacacaauguggcauguaaccagaggcgcagugcugaugcacaaagggaagaggaucgagccgaguugggccgaugucaaaaaggaccuuauuagcuauggaggcgguuggaaacuggagggggaauggaaggagggagaagaggugcagguuuuggcgcuagaaccaggcaagaauccccgugcugugcagacgaaaccuggccuguuuaagacuaacaccgggacaaucggagccgucucucucgauuucuccccagguaccucaggcagucccauaauugacaaaaaggggaaagugguaggacuguacggcaacggugucgugacacgcagcggggcauauguuuccgccaucgcucagacugagaagucuauugaggauaauccugaaaucgaggacgauauauuucggaagagaaggcuuaccauuauggacuuacacccgggagccggcaaaacgaagcgauaccugcccgcaaucgugcgggaagcuaucaaacgcggccucagaacauugauucuggccccaacuagggucguggcggccgagauggaagaggcacuccgggggcugccuauccgauaucaaacccccgcuauuagagccgagcauacaggacgcgaaauaguugaccuuaugugucacgcuaccuucacuaugaggcuguugucgccagugcgugucccuaacuacaaucuaaucauuauggaugaggcacauuucaccgaccccgccagcaucgccgcucgggguuauaucucaacaagaguggaaaugggcgaggcggcagggauuuuuaugacggccacuccaccgggauccagggauccuuucccccagaguaacgcuccaauaaucgacgaggaacgcgagauucccgaacgaucuuggaauagcggccacgaguggguaaccgauuuuaaggguaaaacagugugguucguuccuuccaucaaggccgggaacgacauugcagccugccugagaaagaauggcaaaaaggucauccagcucucacggaaaaccuuugauucugaauacgugaagacuaggacaaacgacugggauuucguggucaccacggacauaagcgagaugggcgcuaauuuuaaagcggagcgcguaaucgauccacguagauguaugaagcccgugauuuuaacugacggcgaagaacggguuauccuggccgggccuaugccggugacacauaguuccgcagcucaaaggcgcggacgaauugguagaaaccccaaaaaugaaaacgaccaguacaucuauaugggcgagccccuugaaaaugaugaggacugcgcccacuggaaggaggcaaagaugcugcucgauaacauaaauaccccugaagggauuauccccagcauguucgagccagaacgggagaaagucgacgccauugauggagaauacagguugcgcggcgaggcuagaaagaccuuuguggaccugaugaggcggggugaucucccuguuuggcuggccuauaaaguggcggcagaggggaucaacuaccccgaccgucgcugguguuucgauggcauaaagaacaaucagauccuugaagagaacgucgaaguggagauuuggccaaaagagggagaacgaaagaagcuaaaaccuagauggcuggacccgaggaucuauucugagccccgggccuugaaggaauuuaaagaguucccaccuggccgcaagucauuaacucugaaucucauuacagaaauggggagacugcccaccuucaugacacagaaaacuagggaugcucuugacaaccuggccggacuccacacggcugaggccgguggacgggcagauaaucaugcuuuguccgagcuggccgaaacccuagagacacugcuccuucugacuuuauuggcaaccgggacaggaggcaucuuucuguuccucaugaguggucgagggauaggcaagaugacccugggaaugugcugcauuaucacugcgagcauccuucugugggacgcccaaauucagccacacuggaucgcugccucgauaauucucgaauuuuucuugaucguacuguuaauuccugagcccgaaaagcagagaacgccgcaggacaaccaacuaaccuacgugguuaucgcaauacugacagucgugggcgcuacuaugccaaaugagaugggguuucucgagaaaaccaagaaagaucuuggacuggguucuaucgccacacagcagccugaauccaacauuuuggacaucgaucugcgccccgcaagcgccuggacccucuaugcuguggcgacuacauucgucacgccaaugcugaggcauucaauugagaauaguucuguuaacgugucccuuaccgccaucgcaaaucaggcuacuguacucaugggccuggggaagggaugggccuuggccaaaauggacauuggcgugccccuguuagguaucggguguuacagccaagucaacccuauaacacuaaccggcgcacugcuccuucugggaggccacuacgcuauuaucgggccgggauugcaggccaaggcgacccgggaagcucagaagcgugccgcacccggcaucaugaaaaauccaacaguggaugguauuacuguuauagaccuggauccuauccccuaugacccuaaguuugagaaacagcucgggcaagugaugcugcuuauuuuaugcgucacgcagguacugaugaugagaaccacaugggcccucugugaggcuuugacucuggcaaccggaccaaucucaacacuaugggagggcaaccccgguagguucuggaauaccacuauugccgugaguauggcgaacaucuuucgcggcagcuaccuggcuggggccggacuccuuuucuccauaaugaagaauacgacaaacacccggcgaggcacugggaacaugggagagacccugggcgaaaaauggaagucuagauugaaugcacuggguaaaagcgaguuucagaucuauaagaaguccgggauucaagaaguugauaggacacucgccaaagagggaaucaagcgcggcgagacugaccaccaugcugugucacgggguucugccaaacugagaugguucgucgaacguaacauggugaccccugagggcaaggucguggauuuagggugcgcaaggggaggcuggaguuacuauugugggggacuuaaaaauguucgggaagugaagggccugacaaagggugggccaggacacgaggaacccauuccgaugucgacguacggcuggaaccucguacgccuacagagcggcguggacgucuuuuucaucccuccagagaaaugcgauacccuguugugugacauaggggaguccucucccaauccuacuguugaagcuggacgaacacugagagugcucaaccuugucgagaauuggcugaacaauaacacccaguucugcauuaagguguugaauccauauaugcccucaguaaucgagaaaauggaggcccugcagaggaaguacgguggcgcgcucgugcggaacccguuaagccgcaauuccacucaugaaauguacuggguuaguaacgccucugggaauaucgugagcucagucaacaugauuuccagaaugcugauaaacagguuuacaaugcgacacaaaaaggcaaccuaugagccugacguggaucuuggaaguggcacgcggaauaucgguauugagagcgaaauccccaaccuggacauuaucgggaagcguauagagaaaaucaagcaagaacaugagaccucuuggcacuacgaucaggaccacccauauaaaacaugggcuuaccauggauccuaugaaacuaagcagaccggcucagccagcucgauggucaauggcgugguuagacuacucacaaaaccuugggauguacugcccacugugacccagauggcaaugacagacaccacuccauucgggcaacagcgcgucuuuaaggagaagguggauacgaggacacaggaccccaaagagggaaccaagaaauugaugaagauuacugcugaauggcuguggaaagagcucgguaagaaaaagaccccucggauguguacaagagaagaguucacgcgcaagguuaggucuaacgccgcccuuggcgcgaucuuuaccgaugagaauaaauggaagagugcucgagaagcaguggaggacucccgguucugggaacuggucgauaaagagagaaacuuacaccuggaagggaagugcgagacuuguguguacaauaugaugggaaaaagggagaagaaguugggcgaauuugguaaagccaaggcuagccgcgccauuugguauauguggcucggggcacguuuccuggaguuugaagcccuaggauuccuuaacgaggaccauugguuuucacgggaaaauucccugucuggcguagagggcgaggggcuccacaaacugggauacaucuugagagacgugagcaagaaagaagguggcgcuauguacgcggaugacacagccgggugggauaccaggauuacucuggaggaccucaagaacgaagagaugguuacaaaucacauggaaggagagcauaagaaacuugcagaggcuauauucaagcugaccuaucagaacaaagucgugcgcgugcaacgaccaacaccgcggggcacugucauggauaucauuaguagaagggaccagcgcgguuccgggcagguugccaccuacggauuaaauacguuuaccaacauggaagcacaacugaucagacagauggagggcgaaggcguguucaagaauauccagcacuugacaguaacugaggagguggccguccagaacuggcucgcucggguggggagggaacgucugccccgaauggccauuagcggagaugacugcguugugaaaccucuagaugcgcgcuucgcaaacgcccuuaccgcucugaaugccauggguaagauaagaaaggacauccaacagugggagccaucuaaaggcuggaacgauuggacacagguccccuuuugcucacaucacuuccaugaacucauuaugaaggacgggcgggugcugguaguuccuuguaggaaucaggaugaguugaucggacgcgcaagaauuagucaaggcgcugguugguccuuacgggaaacugccugccuggggaaaagcuaugcucagauguggucucucauguacuuucacaggcgagaccuucgucuggccgcaaacgcgaucuguucggccgugccaucacacuggguccccaccagcagaacgacaugguccauacaugcuaagcacgaguggaugaccacugaggacaugcuaacaguguggaauaaaguguggauccgcgaaaacccuuggauggaggauaagaccccggucgaaaguugggaggaaauuccauaucugggaaagcgggaggaccaguggugcggcucucucaucggcuugacuagcagggccaccugggccaaaaauauucaggcugccaucaaccaaguuagaucccugauagggaaugaggaauacacagauuauaugcccucaaugaagcgcuuccggagggaggaagaggaagcaggagugcuuugguga

SEQ ID NO: 14784 - RNA, 9876 nt, Artificial Sequence
  derived and/or modified CDS sequence (opt3) from DENV-2__FJ024454__SS-prME
uccgcaggaaugaucauuaugcugauacccaccgugauggcuuuccaccucacaacuagaaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagcggaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuauggucccgugacuauggaguguagcccuagaaccgggcuugauuucaaugaaaugguccuguugcagauggagaacaaagccuggcucgugcacaggcagugguuucuggacuuaccacugcccuggcucccuggcgcagauaagcaggagucuaauuggauccaaaaggaaacacuuguuaccuucaaaaacccacaugcuaagaaacaggacguggucgugcugggaucccaggagggcgccaugcacacugcguugacaggggccacggaaauacaaaugucaagcggaaaucuacuguuuaccggucaucucaagugccggcugcguauggacaaacuucagcugaagggcaugaguuacucuauguguacugggaaguucaaaguaguuaaggagauugcagagacacagcacggaaccaucgugauccgcguccaguaugaaggcgaugguucccccugcaaaauuccguucgagaucauggacuuggaaaagagauacgugcucgggaggcugauuacagucaacccuauagugacugagaaagauagccccguuaacaucgaagcugagccaccuuuuggcgacucguacauuaucaucggaguggagcccggccaauuaaagcugaauugguucaagaaagggucuuccauuggacagauguuugaaaccacgaugcggggugccaagcgaauggcuauacuaggcgauaccgccugggacuucgggucacucggaggcguauuuacaaguaucgguaaagcacugcaucaggucuucggggccauuuauggcgcugcguuuagcggaguguccuggacuaugaagauccuuauuggcguuaucauaaccuggaucgggaugaacucucgcagcacaucauugagugugucccugguccucgugggaauuguaacucuguaccuuggcgugaugguucaggcagauagcgguugugucgugucuuggaaaaauaaggagcugaagugcgggucaggaaucuucauuaccgacaacgugcacacguggacagaacaauauaaauuucagccagagagucccagcaaguuggccuccgcuauccagaaagcccaggaagagggcauaugugguauuagaucugucaccaggcucgagaaucugauguggaagcaaaucacuccugaauuaaaccacauucuggcagagaaugaaguuaaacuaacaaucaugaccggcgauauaaaggggaucaugcaggccggaaaacggucgcuccgcccacagccgacugagcugaaguacagcuggaagaccuggggcaaagcuaagaugcuuuccacagaaucauauaaccagacguucuugauugacgggcccgagaccgccgagugcccuaauacuaacagagcauggaauagucuggaaguggaggauuacggauuuggcguguucacaaccaacaucuggcucaaacugaaggaaaaacaagacgcguuuugugacucuaaguuaaugagcgcugccauuaaggauaauagggcaguacaugccgacauggguuauuggaucgaguccgcucugaacgauacauggaaaauagagaaggccucauucauugaagucaaaaauugccacuggccaaagagccauacucuuuggucuaacgggguguuggaguccgaaaugaucauccccaaaaaccucgcaggaccuguuagucagcacaauuaccguccaggcuaccacacccagauugcuggucccuggcaucugggcaagcuagagauggacuucgauuuuugugacgggacgacagugaucgucaccgaagauugcggaaaccggggcccgagccugcgaacuaccacagccucugggaagcucauuacugaguggugcuguagauccugcacccugccuccacuuagguaucgcggagaggacggcuguugguacgguauggaaauacggcccuugaaagagaaggaagagaaucuggugaacucauuaguuacagcggggcacggacaaguggauaauuucagucucggcguacuggguauggcccuuuuucuggaagagauguugagaacgagggucggcaccaaacaugcuauccuccugguggcagugagcuucgucacucuaauuacagggaacaugucguuuaaggaccugggacgcguugugguaauggugggcgccaccauggcugaugacaucgggaugggagucacuuaucucgcccugcuugcagcguucaaagugcgaccuacauuugccgcuggcuugcuguuacggaagcucaccuccaaggagcugaugaugacgacuauugguaucguucuucugucucagagcaccauacccgaaacagugcuagagcucaccgaugcccuggcauuggggaugaugguccugaaaaucgugcguaauauggaaaaguaccaguuagcuguuacuauuauggccauccucugcgugccaaacgcagucauucugcagaaugccuggaaaguaucauguacaauccuugcugugguuaguguguccccucuguugcucaccucuagccaacagaagacagacuggauaccccuggcgcuaacuauuaaaggacugaacccaaccgccaucuuccuuacgacacucuccagaaccaauaagaaaaggucauggccgcugaacgaggcaaucauggcugucggcauggugagcauuuuggccaguucucuguuaaagaaugacauaccuaugacuggcccccucguagccgggggacugcuuaccgugugcuauguccugacaggucgcuccgcugauuuggaacucgagcgggcaacugacguuaagugggaggaucaggccgaaaucagcggcucgucaccaauucugucuaucaccauuagugaggacggguccaugagcaucaaaaacgaagaggaggaacagacgcuaacaauacugaucagaaccggacuucucgugauuucuggccuguuucccaucagcauuccuaucacugcggcugccugguacuugugggaggugaagaaacaaagggccggugucuuaugggaugugccaucacccccuccgauggggaaggccgaacuggaggacggagcuuaucgaauaaaacagaagggcauucucggcuacagccagaucggggcaggaguuuacaaggaagguacauuccacaccauguggcauguaacucgcggcgccgugcugaugcacaaagggaagcggaucgagccaaguugggcggaugucaaaaaggaccuuauuagcuauggaggcgguuggaaacuggagggggaauggaaggagggagaagaggugcagguuuuggcucuagaacccggcaagaauccuagagccgugcaaacaaaaccaggccuguuuaagaccaacacggggacuaucggagcagucucucucgauuucucccccgguaccucaggcaguccuauaauugacaaaaaggggaaagugguaggacuguacggcaacggugucgugacaaggagcggggccuauguuuccgcuaucgcccagaccgagaagucuauugagaauaacccggaaaucgaggaugacauauuucguaagcgccggcuuacaauuauggauuuacaccccggagcaggcaaaacuaagagauaccugccagcuaucgugagggaagccaucaaacgaggccuccggaccuugauucuggcgccuacgcgcgucguggccgcagagauggaagaggcucucagagggcugcccaucagguaucagacaccagccauucgggcugagcauacuggacgagaaauaguugaccuuaugugucacgcaaccuucacaaugagacuguugucgccugugcgcguccccaauuacaaccuaaucauuauggacgaggcccauuucaccgauccagccagcaucgcugcgagggguuauaucucaacucguguggaaaugggcgaggcagccgggauuuuuaugaccgcuacaccgccuggaucccgggaccccuucccacaaaguaaugcccccauaaucgaugaggaaagagagauuccugaaaggucuuggaacagcggccacgaguggguaacggacuuuaaggguaaaacugugugguucguuccauccaucaaggcagggaaugauauugccgcuugccugcgcaagaacggcaagaaggucauccagcucucacgaaaaaccuuugacucugaauacgugaagacaagaaccaaugauugggacuucguggucacuacagauauaagcgagaugggcgcgaacuuuaaagccgagcggguaaucgaccccaggcgcuguaugaagccugugauuuuaaccgauggcgaggaacguguuauccuggcagggccgaugccagugacgcauaguuccgcugcccagagacggggaaggauuggucgcaaucccaaaaacgaaaaugaccaguacaucuauaugggcgagccucuugaaaacgacgaggauugcgcacacuggaaggaggccaagaugcugcucgacaauauaaacacucccgaagggauuaucccaagcauguucgagccugaacgagagaaagucgaugcuauugacggagaauacagauugcggggcgaggccaggaagacauuuguggaucugaugcgcagaggugaccuccccguuuggcuggcguauaaaguggcagccgaggggaucaacuacgcugauaggcggugguguuucgacggcauaaagaauaaccaaauccuugaagagaaugucgaaguggagauuuggccaaaagagggagaacguaagaagcuaaaaccucgcuggcuggaugcccgaaucuauucugacccguuggcuuuaaaggaguuuaaagaguucgcagccggcagaaagucacugacccucaaccugauuaccgagauggggaggcuucccacuuucaugacacagaaaacccgggaugcucuggacaaucucgccguauugcacacagcagaagcgggaggucgcgccuacaaccaugcucuguccgagcuaccagagacucuggaaacgcuccuucuguuaaccuugcuggccacagugacuggcgggaucuuucucuuccugaugaguggaagaggcauagguaagaugacccuugggaugugcugcauuaucacagcaagcauccugcucugguaugcucagauucagccucacuggaucgccgcaucgauaauuuuggaguuuuuccugaucguuuuacuaauucccgaaccagagaagcaaaggaccccucaggauaaucagcugacuuacgucgugaucgccauacucacgguggucgcugcgaccauggccaacgaaaugggcuuucuugagaaaacaaagaaagaccugggauugggcucuaucgcaacucagcaacccgaguccaauauucuggacaucgaucuccggccggcuagcgccuggacccuguacgccguugcaacaaccuucgugacuccaaugcuucgacauucaauugaaaacaguucuguaaaugugucccucacagcuaucgccaaccaggcgacgguccugaugggguugggaaaggguuggccucugagcaaaauggacauuggcgugcccuuacuagcuaucggguguuauucacagguuaauccaauaacccugacugccgcacuccuucuguugguggcccacuacgcuauuaucggacccggccugcaggcaaaggccacaagagaggcgcaaaagcgcgcugccgcagguaucaugaaaaacccuaccgucgaugggauuaccguaauagaccucgauccgauccccuaugacccaaaguuugaaaaacagcugggccaggugaugcuuuuaauucugugcguuacacaagugcucaugaugaggacuacgugggccuugugugaggcucugacccuagccacaggaccuaucaguacucugugggaaggcaaucccgggcgguucuggaacaccacaauugcagucagcauggcuaauaucuuucguggauccuaccucgccggcgcgggucuucuguucucuauaaugaagaacaccacuaacacgagaagggggacaggaaauaugggcgagaccuugggugagaaauggaaaagccgccugaacgcccucggcaaguccgaauuucagaucuauaagaagucagggauucaggagguggaucggacucuggcaaaagaaggaaucaagcgaggcgagaccgaccaccaugcugucucuagagggagugccaaauuaaggugguucguggagcgcaauaugguuacaccugaaggaaaggugguagaucuuggcugcgguagagggggauggucguacuauuguggcggucugaaaaacgugagagaggucaagggccucacuaaagggggaccaggccacgaagaacccauuccuaugagcaccuacggguggaaucuaguucgucugcaguccggaguggacgucuuuuucaucccacccgaaaaaugcgauacauugcugugugacauaggcgagucuucaccgaacccuacgguggaggcagguaggacccuccggguacuuaaucugguggaaaacugguugaauaacaauacucaauucugcauuaagguucugaacccauacaugcccagcgugaucgagaaaauggaagcucuccagcgcaaguaugggggagccuuaguccgaaauccucuguccagaaacaguacacaugagauguacugggugucuaaugccagcggcaacaucgucucauccgugaacaugauuaguaggaugcuuauaaaucgguuuaccaugcgccacaaaaaggcgacuuaugaaccagauguugaccugggcagcgggacaagaaacaucggaauugagucugagacccccaaucuagacaucauugguaagaggaucgagaaaauaaagcaggagcaugaaacguccuggcacuacgaucaggaccacccguauaaaaccugggcuuaccauggcucauaugagacaaagcaaacugggagcgcaucgucuaugguaaccggagugguccgacuccugacaaaaccuugggauguguugcccacuguuacccagauggccaugacagacaccacuccauucggccagcagcggguguuuaaggaaaaggucgauacgcguacacaagacccuaaagaggcuaccaagaaacugaugaagaucacugccgaguggcucuggaaagaacuugguaagaaaaagacccccagaauguguacacgcgaggaguucacgaggaaggugcggaguaacgcagcccugggggcuauuuuuaccgaugagaauaaauggaaguccgcgagagaggccguagaagacagccgcuucugggaguuaguggauaaagaaaggaaccugcacuuggagggaaagugcgaaacuuguguuuacaauaugaugggcaaacgagagaagaagcucggcgaguuugggaaagcaaagggaucacgggcuaucugguacauguggcugggugccagauuccuagaauuugaggcacuuggcuuccugaacgaagaccauugguuuuccagggaaaauucucucagcggggucgaaggagagggccugcacaaauuggguuauauucugcgcgaugugaguaagaaagaagggggagccauguacgcugacgacacagccggcugggauacccguaucacucucgaagaccuuaagaacgaggaaauggugacaaaucacauggagggcgaacauaagaaacuggcggaggcaauuuucaaguuaaccuaucagaacaaagucguucgggugcagagaccaacacccagggggacuguaauggauauaaucucccgccgagaccaacggggaagcggucaggugggcaccuacgggcugaauacguuuaccaacauggaggcccaguugauuagacagauggaaggagagggcgucuucaagaauauccaacaccucccugugacagaagagguugcugugcagaacuggcuggccagggucggucgcgagagacuaucucggaugccaaucucaggggaugacugcgugguaaaaccgcuugaugcaagguuccccacugcucugaccccucucaacgacaugggaaagauucguaaggauauacaucagugggacccaaguaaaggcuggaaugauuggacacagguucccuuuugcucccaccauuuccacgaacugaucaugaaggacggccgaguguuggucgugccuugucgcaaccaagaugacuuaauugccagagcucggaucagccaggggccaggauggucucugagggagacugccugccucgguaaaucguaugcacagauguggucacuuauguacuuucaccgcagagaccugcggcuagcggccaaugcuauuuguagcgccgugcccucccauugggucccuaccaguaggacgacauggucuauccacgcaaagcaugaauggaugaccacugaggauaugcugacaguuuggaaccgaguguggauacgugaaaauccguggauggaggacaaaaccccaguagagagcugggaagagauccccuaucucggcaagagagaagaucaguggugcggguccuugauuggacugacuucacgcgcuaccugggccaagaacauccaaguggcaauuaaucagguccggagucuuaucggcaacgaggaauacacagacuacaugccuucuaugaaaagguucagacgcgaggaggaagaggccggugugcugugguga

SEQ ID NO: 14785 - RNA, 9876 nt, Artificial Sequence
  derived and/or modified CDS sequence (opt3) from DENV-2__FJ205878__SS-prME
agcgccggcaugaucauuaugcugauacccaccgugacagcuuuccaccucacuacgagaaacggggagccucauaugaucgucggaauucaggaaaaggguaaaucccuucuguuuaagaccgaggacggcguuaauaugugcacauugauggcaauggauuuaggggaacugugugaggacacuaucaccuacaaaugcccacuacucaggcaaaacgaaccggaggauauugacuguuggugcaauucuacaucaaccugggugacuuauggaacauguaccacgacuggcgagcaccggcgcgaaaagcgaaguguagcccuggugccccaugucgguauggggcuugagacccguacagaaacuuggaugagcuccgagggagcguggaaacacgcucagagaaucgagaccuggauacugaggcauccuggcuucacaaucauggccgcaauuuuggccuacaccaucggcacgacucacuuucagcgggugcucauuuucauccugcugacagcuguugcaccaucuaugaccaugcgcugcauagggauuucgaacagagauuuuguggaaggagucucagguggcagcuggguggacaucguacucgagcacgggaguuguguuacuacaauggccaagaauaagcccaccuuagauuucgaacugauuaaaacggaggcuaagcagccugccacccuuaggaaauauugcaucgaagcgaaguugacaaacacuaccacagagucccgguguccaacucaaggagagcccucucugaaagaagagcaggacaagcgcuuugugugcaagcauagcauggucgaucgaggcugggguaauggguguggacuauucggcaaaggcgggaucgugaccugcgcaauguuuacaugcaagaaaaacauggaaggaaagauugugcagccugagaaucucgaauacaccauagucguuacuccacacuccggugaggagcaugccgugggcaacgacacggggaaacacggacaggaaaucaagguaacaccgcaaucaaguauuaccgaggcugaacugacuggcuaugguaccgugacaauggaguguagccccagaaccgggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacucuuguuacauucaaaaacccucaugcuaagaaacaggacguggucgugcugggaucccaggagggcgccaugcacacggcguugaccggggccacugaaauacaaaugucaagcggaaaucuacuguuuacaggucaucucaagugccggcugcguauggacaaacuucagcugaagggcaugaguuacucuauguguaccgggaaguucaaaguaguuaaggagauugcagagacacagcacggaacuaucgugauccgcguccaguaugaaggcgaugguuccccaugcaaaauucccuucgagaucauggacuuggaaaagagauacgugcucgggaggcugauuaccgucaacccgauagugacggagaaagauagcccuguuaacaucgaagcugagcccccauuuggcgacucguacauuaucaucggaguggagccuggccaauuaaagcugaauugguucaagaaagggucuuccauuggacagauguuugaaaccacaaugcggggugccaagcgaauggcuauacuaggcgauacugccugggacuucgggucacucggaggcguauuuaccaguaucgguaaagcacugcaucaggucuucggggccauuuauggcgcugcguuuagcggaguguccuggacaaugaagauccuuauuggcguuaucauaacuuggaucgggaugaacucucgcagcaccucauugagugugucccugguccucgugggaauuguaacgcuguaccuuggcgugaugguucaggcagauagcgguugugucgugucuuggaaaaauaaggagcugaagugcgggucaggaaucuucauuacagacaacgugcacaccuggacugaacaauauaaauuucagcccgagaguccaagcaaguuggccuccgcuauccagaaagcccaggaagagggcauaugugguauuagaucugucacaaggcucgagaaucugauguggaagcaaaucacccccgaauuaaaccacauucuggcagagaaugaaguuaaacuaacuaucaugaccggcgauauaaaggggaucaugcaggccggaaaacggucgcuccgcccucagccaacagagcugaaguacagcuggaagacguggggcaaagcuaagaugcuuuccaccgaaucauauaaccagacuuucuugauugacgggccggagacagccgagugccccaauaccaacagagcauggaauagucuggaaguggaggauuacggauuuggcguguucacaacuaacaucuggcucaaacugaaggaaaaacaagacgcguuuugugacucuaaguuaaugagcgcugccauuaaggauaauagggcaguacaugccgacauggguuauuggaucgaguccgcucugaacgauaccuggaaaauagagaaggccucauucauugaagucaaaaauugccacuggccuaagagccauacgcuuuggucuaacgggguguuggaguccgaaaugaucaucccaaaaaaccucgcaggacccguuagucagcacaauuaccguccuggcuaccacacacagauugcugguccauggcaucugggcaagcuagagauggacuucgauuuuugugacgggaccacugugaucgucaccgaagauugcggaaaccggggccccagccugcgaacaacuaccgccucugggaagcucauuacagaguggugcuguagauccugcacgcugccgccucuuagguaucgcggagaggacggcuguugguacgguauggaaauacggccauugaaagagaaggaagagaaucuggugaacucauuaguuaccgcggggcacggacaaguggauaauuucagucucggcguacuggguauggcccuuuuucuggaagagauguugagaacuagggucggcacaaaacaugcuauccuccugguggcagugagcuucgucacccuaauuacugggaacaugucguuuaaggaccugggacgcguugugguaauggugggcgccacaaugaccgaugacaucgggaugggagucacguaucucgcucugcuugccgcauucaaagugcgacccacuuuugcggccggcuugcuguuacggaagcucaccuccaaggagcugaugaugacaaccauugguaucguucuucugucucagagcacuauaccugaaacagugcuagagcucaccgaugcucuggccuuggggaugaugguccugaaaaucgugcguaauauggaaaaguaccaguuagcaguuacaauuauggcuauccucugcgugcccaacgccgucauucugcagaaugcauggaaaguaucauguacuauccuugccgugguuaguguguccccacuguugcucaccucuagccaacagaagacggacuggauaccucuggcucuaacaauuaaaggacugaaccccaccgcgaucuuccuuacuacccucuccagaacaaauaagaaaaggucauggccacugaacgaggccaucauggcagucggcauggugagcauuuuggcuaguucucuguuaaagaaugacauaccgaugacuggcccucucguagccgggggacugcuuaccgugugcuauguccugacgggucgcuccgccgauuuggaacucgagcgggcuacagacguuaagugggaggaucaggcagaaaucagcggcucgucacccauucugucuaucaccauuagugaggacggguccaugagcaucaaaaacgaagaggaggaacagacucuaacaauacugaucagaaccggacuucucgugauuucuggccuguuuccaaucagcauucccaucacugccgcggcuugguacuugugggaggugaagaaacaaagggccggugucuuaugggaugugccuuccccacccccuauggggaaggcagaacuggaggacggagccuaucgaauaaaacagaagggcauucucggcuacucacagaucggggcuggaguuuaccgcgaagguacauuccacaccauguggcauguaacgcggggcgcagugcugaugcacaaggggaaaagaaucgagccgaguugggccgaugucaagaaagaccuuauuagcuauggaggcgguuggaagcuggagggggaauggaaagagggagaagaggugcagguuuuggcgcuagaaccaggcaagaaucccagggcugugcaaacuaagccuggccuguuuaaaaccaacacagggaccaucggagccgucucucucgauuucuccccagguacaucaggcagucccauaauugacaagaaagggaaggugguaggacuguacggcaacggugucgugacucguagcggggcauauguuuccgccaucgcucagaccgagaaaucuauugaggauaauccugaaaucgaggacgauauauuucgcaagcggagacuuacgauuauggacuuacacccgggagccggcaagacaaaaagguaccugcccgcaaucgugcgagaagcuaucaagcggggccuccgcacuuugauucuggccccaaccagagucguggcggccgagauggaagaggcacucagggggcugccuauccgguaucagacacccgcuauucgagccgagcauaccggaagagaaauaguugaccuuaugugucacgcuacuuucaccaugcgccuguugucgccagugagggucccuaacuacaaucuaaucauuauggaugaggcacauuucacagaccccgccagcaucgccgcucgugguuauaucucaacgcggguggaaaugggcgaggcggcagggauuuuuaugacugccaccccaccgggauccagagauccuuucccccaaaguaacgcuccaauaaucgacgaggaaagggagauucccgaacgcucuuggaauagcggccacgaguggguaacagauuuuaaagguaagaccgugugguucguuccuuccaucaaagccgggaacgacauugcagccugccugcgaaagaauggaaagaaagucauccagcucucaagaaagacuuuugauucugaauacgugaaaacacggaccaacgacugggauuucguggucacgacugacauaagcgagaugggcgcuaauuuuaaggcggagaggguaaucgauccacgccguuguaugaaacccgugauuuuaacagacggcgaagagagaguuauccuggccgggccuaugccggugacccauaguuccgcagcucagcggaggggacgcauuggucgaaacccaaagaaugaaaacgaccaguacaucuauaugggcgagccccuugaaaaugaugaggacugcgcccacuggaaagaggcaaagaugcugcucgauaacauaaauaccccugaagggauuauccccagcauguucgagccagaaagagagaaggucgacgccauugauggagaauaccgguugaggggcgaggcucgcaaaacuuuuguggaccugaugagaaggggugaucucccuguuuggcuggccuauaagguggcggcagaggggaucaacuacgccgaccggcguugguguuucgauggcauaaaaaacaaucaaauccuugaagagaacgucgaaguggagauuuggacaaaggagggagaacgcaaaaagcuaaagccccgauggcuggacgcuagaaucuauucugauccauuggccuuaaaagaguuuaaggaauucgcugcaggcaggaaaucacugacccucaaucugauuacagagauggggcggcuuccuacuuucaugacgcagaagacccgcgacgcccuggauaaccucgcuguauugcacacagccgaagcaggagguagagcguacaaucaugcccuguccgagcuaccggagacucuggaaacccuccuucuguuaacauugcuggcuaccgugacuggcgggaucuuucucuuccugaugaguggaaggggcauagguaaaaugacgcuugggaugugcugcauuaucaccgccagcauccugcucugguaugcacagauucagccccacuggaucgcugccucgauaauuuuggaguuuuuccugaucguuuuacuaauuccagaaccugagaagcaacggacaccccaggacaaccagcugacuuacgucgugaucgcaauacucaccguggucgccgcuacaauggcgaaugaaaugggcuuucuugagaagaccaaaaaggaccugggauugggcucuaucgccacucagcaaccagaguccaacauucuggauaucgaccuccgaccugcaagcgcuuggacacuguacgccguugccacgaccuucgugacucccaugcuuagacauucaauugaaaauaguucuguaaacgugucccucacagcaaucgcuaaucaggccaccguccugaugggguugggaaaagguuggccgcugagcaagauggauauuggcgugccauuacuagcgaucggguguuauucacagguuaacccuauaacccugacagcugcccuccuucuguugguggcacacuacgccauuaucggacccggccugcaggcuaaagcaacucgcgaggcccaaaagagggcggcugccgguaucaugaagaauccaacggucgacgggauuaccguaauagaucucgaccccaucccuuaugauccgaaauuugaaaagcagcugggccaggugaugcuuuuaauucugugcguuacacaagugcucaugaugcggacuaccugggcauugugugaggcccugacacuagcuaccggacccaucaguacucugugggaaggcaacccagggcguuucuggaauacgacaauugccgucagcauggcaaacaucuuuagaggauccuaccucgcuggcgccggucuucuguucucuauaaugaaaaauaccacuaacaccaggcgcgggacaggaaacaugggcgagacuuugggugagaaguggaaaagccggcugaaugcgcucggcaaguccgaauuucagaucuauaaaaagucagggauucaggagguggaccgaacccuggccaaggaaggaaucaaaagaggcgagacagaucaccaugcagucucuagggggagugcuaaguuacgcugguucguggagcggaacaugguuacgccugaaggaaaagugguagaccuuggcugcgguagagggggauggucguacuauuguggcggucugaagaaugugcgugaggucaaaggccucaccaaggggggacccggccacgaagagccuauuccaaugagcacuuacggguggaaccuaguuaggcugcaguccggaguggaugucuuuuucauccccccugaaaagugcgacacauugcugugugauauaggcgagucuucaccaaaucccaccguggaggccggucggacucuccgcguacuuaaccugguggaaaauugguugaacaauaacacacaauucugcauuaaaguucugaauccguacaugccuagcgugaucgagaagauggaagcacuccagcgaaaauaugggggagcuuuagucagaaacccacuguccaggaauaguacccaugagauguacugggugucuaacgccagcggcaauaucgucucauccgugaacaugauuagucggaugcuuauaaaccgcuuuacgaugagacacaagaaagccaccuaugaacccgacguugaccugggcagcgggacaaggaauaucggaacugagucugagauuccuaaccuagauaucauugguaagcgaaucgaaaagauaaaacaggagcaugaaaccuccuggcacuacgaccaggaucacccauauaagacaugggcguaccauggcucauaugagacuaaacaaaccgggagcgcuucgucuaugguaaauggagugguccggcuccugacaaagcccugggacguguugccgaugguuacccagauggcaaugacugauacgacaccuuucggccagcagcguguguuuaaagaaaaggucgacaccagaacucaagagcccaaggaggguaccaaaaagcugaugaaaaucacagccgaauggcucuggaaggagcuugggaaaaagaaaacgccacgcauguguaccagggaagaguucacucggaaggugagaaguaacgcugcccugggagcaauuuuuacagaugagaauaaguggaaauccgcccgcgaagcuguagaggacagcagguucugggaauuaguggauaaggagcgaaaccugcacuuggaaggcaaaugcgagaccuguguuuacaauaugaugggcaagcgggagaaaaagcucggggaauuuggaaaggcgaaagguucaagagccaucugguacauguggcugggcgcaagguuccuagaguuugaagcucuuggguuccugaacgaggaccauugguuuucccgcgaaaauucucucagcggagucgagggcgagggucugcacaaguugggguauauucugcgugaugugaguaaaaaggaaggaggcgccauguacgcagacgacacugccggcugggauacacggaucacccucgaggaccuuaaaaacgaagagauggugacaaaucacauggaaggggagcauaagaagcuggcugaggccauuuucaaauuaacuuaucagaacaaggucguuagagugcagaggccuaccccccgcggaacgguaauggauauaaucucccgacgggaccaaagagguagcggccagguggggaccuacggacugaauacauuuacuaacauggaagcgcaguugauuaggcagauggagggcgaaggugucuucaaaaauauccaacaccucaccgugacagaggagguugcagugaagaacuggcuggcccgcgucgggagagaacggcuaucuaggauggcuaucucaggagaugacugcgugguaaaaccacuugaugaccguuucgccaacgcacugacugcucucaaugauaugggcaagauucgaaaggacauacagcagugggagcccaguaaaggcuggaacgauuggacccagguuccuuuuugcucccaucacuuccaugaacugaucaugaaggacgggcgcguguuggucgugccauguagaaaucaagaugaguuaauuggacgggccaggaucagccagggugcuggcuggucucugcgcgaaacggccugccucgggaaaucguaugcacagauguggucacuuauguacuuucacagacgggaccugaggcuagcggccaacgcuauuuguagcgccgugccgucccacuggguccccacaagucgaaccacuuggucuauccaugcaaagcacgaguggaugacaaccgaggacaugcugacuguuuggaaucguguguggauaagagaaaacccuuggauggaggauaaaaccccaguagaaagcugggaggaaauccccuaucucggaaagcgcgaggaccaguggugcggcuccuugauuggucugacaucacgggcuacgugggccaagaauauccaagcagccauuaaccaggugaggagucuuaucgggaaugaggaauacaccgauuacaugccuucuaugaaaagauuccgccgggaggaagaggaagcgggaguccugugguga

SEQ ID NO: 14786 - RNA, 9876 nt, Artificial Sequence
  derived and/or modified CDS sequence (opt3) from DENV-2__FJ205879__SS-prME
agcgcaggcaugauaauuaugcugauacccaccgugauggcuuuccaccucaccacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuuaucugcaagcauagcaugguggaucgaggcugggguaauggguguggacuauucggcaaaggcgggauugucacuugcgcaauguuuaccugcaagaaaaacauggaaggaaagauagugcagccugagaaucucgaauacacaaucguggucaccccacacuccggugaggagcaugccguuggcaacgacacugggaaacacggaaaggaaauuaaagugacgccgcagucaaguaucacagaggcugaacugaccggcuaugguacuguaaccauggaguguagccccagaacagggcuugauuucaaugaaauggugcuguugcaaauggagaacaaggccuggcucguccacaggcagugguuucuggacuuaccucugccauggcuccccggcgcagauaagcaggagucuaauuggauacagaaagaaacccuugugacuuucaagaacccucaugcuaaaaagcaagacguugugguccugggaucccaggagggcgccaugcacacagcguugacgggggccaccgaaauucagaugucaagcggaaaucuacuguuuacuggucaucucaaaugccggcugcguauggacaaacuucaacugaagggcaugaguuacucuauguguacagggaaauucaaggugguaaaagagaucgcagagacccagcacggaacaaucguuauucgcgugcaguaugaaggcgaugguuccccaugcaagauccccuucgagauuauggacuuggagaagagauacguccucgggaggcugauaacugugaacccgaucgucaccgagaaggauagcccugugaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacaaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggcccaggaagagggcauuugugguaucagaucugugacuaggcucgagaaucugauguggaaacagauuacacccgaauuaaaccacauccuggcagagaaugaagucaagcuaaccauaaugacuggcgauaucaaagggauuaugcaagccggaaagcggucgcuccgcccucagccaaccgagcugaaguacagcuggaaaacauggggcaaggcuaaaaugcuuuccacggaaucauauaaccagaccuucuugaucgacgggccggagacugccgagugccccaauacaaacagagcauggaauagucuggaaguugaggauuacggauuuggcguguucaccacaaacauuuggcucaagcugaaagaaaagcaggacgcguuuugugacucuaaguuaaugagcgcugccaucaaagauaauagggcagugcaugccgacauggguuauuggauagaguccgcucugaacgauacuuggaagauugagaaagccucauucaucgaaguaaagaauugccacuggccuaaaagccauacccuuuggucuaacggggucuuggaguccgaaaugaucauuccaaagaaccucgcaggacccgugagucaacacaauuaccguccuggcuaccacacgcagaucgcugguccauggcaucugggcaagcuagagauggacuucgauuuuugugacgggacaaccguuguggucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaagacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggccggugucuuaugggaugugccuuccccacccccuauggggaaagccgaacuggaggacggagcuuaucgaauaaagcaaaagggcauucucggcuacucacagaucggggcaggaguuuacaaagaagguaccuuccacacuauguggcauguaacacgcggcgccgugcugaugcacaaggggaaacggaucgagccgaguugggcggaugucaagaaagaccuuauuagcuauggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccaggagcggggccuauguuuccgcuaucgcccaaacagagaagucuauugaggauaauccugaaaucgaggacgauauauuucguaaacgccggcuuacuauuauggacuuacacccgggagcaggcaagaccaaaagauaccugcccgcuaucgugagggaagccaucaagcgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaagguaagaccgugugguucguuccuuccaucaaggcagggaacgacauugccgcuugccugcgcaaaaauggaaagaaagucauccaacucucacgaaagacauuugauucugaauacgugaaaaccagaacuaacgacugggauuucguggucacaaccgacauaagcgagaugggcgcgaauuuuaaggccgagcggguaaucgauccaaggcgcuguaugaaacccgugauuuuaacggacggcgaagaacguguuauccuggcagggccuaugccggugacucauaguuccgcugcccagagacggggaaggauuggucgcaacccaaagaaugaaaacgaccaguacaucuauaugggcgagccccuugaaaaugaugaggacugcgcacacuggaaggaggccaaaaugcugcucgauaacauaaauacaccugaagggauuauccccagcauguucgagccagaacgagagaaggucgacgcuauugauggagaauacagauugcggggcgaggccaggaaaaccuuuguggaccugaugcgcagaggugaucucccuguuuggcuggcguauaagguggcagccgaggggaucaacuacgcugacaggcggugguguuucgauggcaucaaaaacaaucagauccuugaagagaacgucgaaguggagauuuggaccaaggagggagaacguaagaaacuaaagccccgcuggcuggacgcccgaaucuauucugauccauuggcuuuaaaagaguuuaaggaguucgcagccggcagaaaaucacugacucucaaucugauuacagagauggggaggcuuccuaccuucaugacacaaaagacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuacuacggcaagcauccugcucugguaugcucagauccagccccacuggauugccgcaucgaucauauuggaguuuuuccugauuguuuuacuaaucccagaaccugagaaacagaggacaccccaagacaaccagcugacauacgucgugauugccauccucacuguggucgcugcgaccauggccaaugaaaugggcuuucuugagaagacuaaaaaggaccugggauugggcucuauagcaacccagcagccagaguccaacauccuggauauugaccuccggccugcuagcgccuggacucuguacgccguugcaacaacguucgugacccccaugcuucgacauucaaucgaaaauaguucuguaaacgugucccucacugcuauugccaaucaagcgacaguccugaugggguugggaaaagguuggccgcugagcaagauggauaucggcgugccauuacuagcuauuggguguuauucacagguuaacccuaucacccugaccgccgcacuccuucuguugguggcccacuacgcuauaauuggacccggccugcaggcaaaggccacaagagaggcgcagaaacgcgcugccgcagguaucaugaagaauccaacugucgacgggaucacgguaauugaucucgaccccauaccuuaugauccgaaauuugaaaagcaacugggccaggugaugcuuuuaauccugugcguuacccaggugcucaugaugaggacaacuugggccuugugugaggcucugacccuagccacaggacccauuaguacccugugggaaggcaacccagggcgguucuggaauacuacgaucgcagucagcauggcuaacauuuuucguggauccuaccucgccggcgcgggucuucuguucucuaucaugaaaaauacaaccaacccuagaagggggacuggaaacaugggcgagaccuugggugagaaguggaaaagccgccugaaugcccucggcaaguccgaauuucaaauauauaagcggucagggauccaggagguggaccgaacacuggcaaaagaaggaauuaagagaggcgagacugaucaccaugcugucucuagggggagugccaaauuacgcugguucguggagcggaacaugguuacccccgaaggaaaggugguagaccuuggcugcgguagagggggauggucguacuauuguggcggucugaaaaaugugcgugaggucaagggccucacaaaagggggaccuggccacgaagaaccaauccccaugagcacguacggguggaaccuaguuaggcugcaguccggaguggaugucuuuuucauuccuccagaaaaaugcgacaccuugcugugugauaucggcgagucuucacccaauccgacuguggaggcaggucggacacuccgcguacuuaaccugguggaaaauugguugaacaauaacacccaguucugcauaaagguucugaauccuuacaugccaagcgugauugagaaaauggaagcucuccaacgaaaguaugggggagccuuagucagaaacccccuguccaggaauaguacucaugagauguacugggugucuaacgccagcggcaauaucgucucauccgugaacaugaucagucggaugcuuauuaaccgcuuuacaaugagacacaaaaaggcgaccuaugaaccugacguugaccugggcagcgggacgaggaauauaggaaucgagucugagauuccaaaccuagauaucauugguaagcgaaucgagaaaauaaagcaggagcaugaaaccuccuggcacuacgaccaggaucaccccuauaaaacaugggcuuaccauggcucauaugagacuaagcagaccgggagcgcaucgucuaugguaaauggagugguccggcuccugacaaaaccgugggacguguugccuacuguuacccaaauggccaugacagauaccacucccuucggccagcagcguguguuuaaggaaaaggucgacacgagaacacaggagccaaaagaggguaccaagaaacugaugaagaucacugcugaauggcucuggaaagagcuugggaagaaaaagaccccucgcauguguacaagggaagaguucacgcggaaggugagaaguaacgccgcacugggagccauuuuuaccgaugagaauaaauggaaguccgcucgcgaagcgguagaggacagcagguucugggaauuaguggauaaagagcgaaaccugcacuuggaaggcaagugcgagacuuguguuuacaauaugaugggcaaacgggagaagaagcucggggaauuuggaaaagccaaggguucaagagcaaucugguacauguggcugggcgcuagguuccuagaguuugaagcccuuggguuccugaacgaggaccauugguuuucccgcgaaaauucucucagcggagucgagggcgagggucugcacaaauugggguauauucugcgugaugugaguaagaaagaaggaggcgcaauguacgccgacgacacagcuggcugggauacccggaucacucucgaggaccuuaagaacgaagagauggugacaaaucacauggaaggggagcauaagaaacuggccgaggcgauuuucaaguuaaccuaucaaaacaaagucguuagagugcagaggcccacaccacgcggaacuguaauggauauaaucucccgacgggaccagagagguagcggccaaguggggaccuacggacugaauacguuuaccaacauggaagcacaguugauuaggcagauggagggcgaaggugucuucaagaauauccagcaccucacagugacugaggagguugccgugcaaaacuggcuggcucgcgucgggagagaacggcuaucuaggauggccaucucaggagaugacugcgugguaaaaccccuugaugaccguuucgcaaacgcucugaccgcccucaaugauaugggcaagauucgaaaggacauacagcagugggagccuaguaaaggcuggaacgauuggacacagguuccauuuugcucccaucacuuccaugaacugaucaugaaggacgggcgcguguuggucgugccguguagaaaucaagaugaguuaauuggacgggcuaggaucagccagggugccggcuggucucugcgcgaaacugcaugccucgggaaaucguaugcgcagauguggucacuuauguacuuucacagacgggaccugaggcuagccgcuaacgccauuuguagcgcagugcccucccacugggucccuaccagucgaacgacauggucuauccaugcuaagcacgaguggaugaccacugaggacaugcugacaguuuggaaucguguguggauaagagaaaacccauggauggaggauaaaacccccguagaaagcugggaggaaaucccuuaucucggaaagcgcgaggaccaguggugcggcuccuugauuggucugacuucacgggccaccugggcaaagaauauccaagccgcgauuaaccaggugaggagucuuaucgggaaugaggaauacacagauuacaugccaucuaugaaaagauuccgccgggaggaagaggaagcuggaguccugugguga

SEQ ID NO: 14787 - RNA, 9876 nt, Artificial Sequence
  derived and/or modified CDS sequence (opt3) from DENV-2__FJ390385__SS-prME
agcgcaggaaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagcuaccgagaaggauagcccugugaacaucgaagccgagcccccauuuggcgacucguacauuaucaucggaguugagccuggccaguuaaagcugaauugguucaaaaaggggucuuccauuggacaaauguuugaaacgaccaugcggggugcuaaacgaauggccauacuaggcgauacagcaugggacuucgggucacucggaggcguguuuacaaguaucgguaaggcccugcaucagguauucggggcuauuuauggcgcggcauuuagcggagucuccuggaccaugaaaauccuuauuggcgugaucauaacauggaucgggaugaacucucgcagcacuucauugaguguuucccuggugcucgucggaauugugacccuguaccuuggcguaauggugcaggccgauagcgguuguguugucucuuggaagaauaaggagcugaaaugcgggucaggaaucuucauuacggacaacgugcacacauggaccgaacaguauaaguuucaacccgagaguccaagcaaauuggcuuccgccauccagaaggcacaggaagagggcauaugugguauuagaucugugacuaggcucgagaaucugauguggaaacagaucacacccgaauuaaaccacauucuggccgagaaugaagucaagcuaaccaucaugacuggcgauauaaaagggaucaugcaagcuggaaagcggucgcuccgcccucagccaaccgagcugaaguacagcuggaaaacauggggcaaggccaaaaugcuuuccacggaaucauauaaccagaccuucuugauugacgggccggagacugcagagugccccaauacaaacagagcguggaauagucuggaaguugaggauuacggauuuggcguguucaccacaaacaucuggcucaagcugaaagaaaagcaggacgcuuuuugugacucuaaguuaaugagcgccgcaauuaaagauaauagggccgugcaugcugacauggguuauuggaucgaguccgcccugaacgauacuuggaagauagagaaagcaucauucauugaaguaaagaauugccacuggccuaaaagccauacccuuuggucuaacggggucuuggaguccgaaaugaucaucccaaagaaccucgcuggacccgugagucaacacaauuaccguccuggcuaccacacgcagauugccgguccauggcaucugggcaagcuagagauggacuucgauuuuugugacgggacaaccguuaucgugacugaagauugcggaaaccggggccccagccugcgaaccacaacugcgucugggaaacucauuaccgaguggugcuguagauccugcacacugccgccucuuagguaucgcggagaggacggcuguugguacgguauggaaauacggccauugaaggagaaagaagagaaucuggucaacucauuagugacggccgggcacggacagguugauaauuucagucucggcgugcuggguauggcucuuuuucuggaagagauguugagaaccaggguaggcacuaagcaugcaauccuccuggucgccgugagcuucgugacacuaauuaccgggaacaugucguuuaaagaccugggacgcgucguugugaugguaggcgcuacuauggccgaugacaucgggaugggagugacauaucucgcacugcuugcggccuucaagguccgacccaccuuugcugccggcuugcuguuacggaagcucacguccaaagagcugaugaugacuaccauugguaucgugcuucugucucaaagcacaauaccugaaaccguucuagagcucacugaugcacuggcuuuggggaugauggugcugaagaucguccguaauauggaaaaauaccaguuagccgugacaauuauggcaauccucugcguucccaacgccgugauucugcagaaugcuuggaaggucggauguaccauccuugcgguagugucaguuaguccacuguugcucacauccucucagcagaaaacugacuggauaccucuggcccuaaccauuaagggccugaaccccacggcaaucuuccuuacaacccucagcagaacuaauaaaaagagguccuggccacugaacgaggcuaucauggccgugggcauggucucaauuuuggccagcagucuguuaaagaaugacauaccgaugaccgggccucucguggcuggaggucugcuuacaguaugcuaugugcugacuggccgcucugcagauuuggaacucgagcgggccaccgacgucaaaugggaggaucaggcggaaaucuccgggagcucgcccauucugucaaucacgauuucugaggacggaaguauguccaucaagaacgaagaggaggaacagacacuaaccauacugaucagaacuggccuucucguuauuagcggucuguuuccaaucucuauucccaucacagcugccgcaugguacuugugggaggugaaaaagcagagggccgggguguuaugggaugucccuagcccacccccuaugggaaaagcugaacuggaggacggcgcauaucgaauaaagcaaaagggcauucucggguacucccagaucggagccgguguguacaaagaaggcaccuuccacacuauguggcauguuacacgcggggcgguacugaugcacaagggaaaacggaucgagccgucaugggcugaugugaagaaagaccuuauuaguuauggcgguggguggaagcuggagggagaauggaaggagggcgaagagguccagguguuggcccuagaaccaggcaaaaaucccagagcaguucagaccaagccugggcuguuuaaaacgaacacuggaaccaucggugccgugagccucgauuucucuccaggcacauccgggucacccauaauugacaagaaaggaaaggucgugggccuguacgguaacgggguagucaccaggaguggagcuuaugugagcgccaucgcacaaacagagaaguccauugaggauaauccugaaaucgaggacgauauauuucguaaacgccggcuuacuauuauggacuuacacccgggcgcuggcaagaccaaaagauaccugcccgccaucguuagggaagcgaucaagcgagggcuccggacguugauucuggccccaacacgcguggucgcagcugagauggaagaggcccucagaggacugccuaucagguaucagacucccgcuauucggucugagcauaccggucgagaaauaguggaccuuaugugucacgcaacauucaccaugagacuguugucgccaguucgcgugccuaacuacaaucuaaucauuauggaugaggcccauuucacugaccccgccagcaucgcugcgaggggcuauaucucaacccgugucgaaaugggggaggcagccggaauuuuuaugacagcuacgccaccgggcucccgggauccuuucccccagaguaacgccccaauaaucgacgaggaaagagagauucccgaaaggucuuggaauagcggucacgagugggugacugauuuuaaagggaagaccguaugguucgugccuuccaucaaggcaggaaacgacauugccgcuugccugcgcaaaaauggcaagaaaguuauccaacucucacgaaagacauuugauucugaauacgucaaaaccagaacuaacgacugggauuucguggugacaaccgacauaagcgagaugggcgcgaauuuuaaggccgagcgggucaucgauccaaggcgcuguaugaaacccguaauuuuaacggacggggaagaacgugugauccuggcaggaccuaugccgguuacucauaguuccgcugcccagagacgggguaggauuggccgcaacccaaagaaugaaaacgaccaguacaucuauaugggggagccccuugaaaaugaugaggacugcgcacacuggaaggaggccaaaaugcugcucgauaacauaaauacaccugaaggaauuauccccagcauguucgagccagaacgagagaagguggacgcuauugauggcgaauacagauugcggggugaggccaggaaaaccuuugucgaccugaugcgcagaggggaucucccuguguggcuggcguauaagguugcagccgagggcaucaacuacgcugacaggcggugguguuucgauggaaucaaaaacaaucagauccuugaagagaacguggaagucgagauuuggaccaaggagggcgaacguaagaaacuaaagccccgcuggcuggacgcccgaaucuauucugauccauuggcuuuaaaagaguuuaaggaguucgcagccgggagaaaaucacugacucucaaucugauuacagagaugggaaggcuuccuaccuucaugacacaaaagacucgggacgcucuggauaaccucgccguguugcacacggcagaagcggguggccgcgccuacaaucaugcucuguccgagcuaccggagacccuggaaacacuccuucuguuaacuuugcuggccaccguaacagggggaaucuuucucuuccugaugaguggcagagguauagggaagaugacccuuggcaugugcugcauuaucacugcaagcauccugcucugguaugcucagauucagccccacuggaucgccgcaucgauaauuuuggaguuuuuccugaucguguuacuaauuccagaaccugagaaacagaggacgccccaagacaaccagcugaccuacguugucaucgccauacucacagugguggcugcgacuauggccaaugaaaugggauuucuugagaagaccaaaaaggaccugggcuuggggucuaucgcaacacagcagccagaguccaacauucuggauaucgaccuccggccugcuagcgccuggacccuguacgccgucgcaacuacauucguuacgcccaugcuucgacauucaauugaaaauaguucugugaacguaucccucaccgcuaucgccaaucaagcgacugugcugaugggauuggguaaaggcuggccgcugagcaagauggauauuggggucccauuacuagcuaucggauguuauucacaggugaacccuauaacacugaccgccgcacuccuucuguugguugcccacuacgcuauuaucggccccggucugcaggcaaaggccaccagagaggcgcagaaacgcgcugccgcagggaucaugaagaauccaacaguggacggcauuacugucauagaucucgaccccaucccuuaugauccgaaauuugaaaagcaacugggacagguaaugcuuuuaauucugugcgugacgcagguucucaugaugaggaccacaugggccuugugugaggcucugacucuagccaccggccccaucaguacacugugggaagggaacccaggacgguucuggaauaccacuauugcagugagcauggcuaacaucuuucguggcuccuaccucgccggugcggggcuucuguucucuauaaugaaaaauacgacaaacaccagaaggggaacuggcaacaugggugagaccuugggcgagaaguggaaaagccgccugaaugcccucgggaaguccgaauuucaaaucuauaagcggucaggcauucaggaggucgaccgaacacuggcaaaagaaggcaucaagagaggggagacugaucaccaugcugugucuaggggaagugccaaauuacgcugguucgucgagcggaacauggugaccccugaaggcaagguuguggaccuugguugcgggagaggaggcuggucguacuauugugguggccugaaaaauguacgugaggugaaggggcucacaaagggaggccccgggcacgaagaaccuauuccaaugagcacguacggauggaaccuagucaggcugcaguccggcguugauguguuuuucauacccccugaaaaaugcgacaccuugcugugugauauaggugagucuucaccaaaucccacugucgaggcagggcggacacuccgcgugcuuaaccugguagaaaauugguugaacaauaacacccaguucugcauuaaggugcugaauccguacaugccuagcguuaucgagaaaauggaagcucuccaacgaaaguauggaggcgccuuagugagaaacccacuguccaggaauaguacucaugagauguacugggucucuaacgccagcggcaauaucgugucauccgucaacaugauuagucggaugcuuauaaaccgcuuuacaaugagacacaaaaaggcgaccuaugaacccgacguggaccuggggagcggaacgaggaauaucgguaccgagucugagauuccuaaccuagauaucauuggcaagcgaaucgagaaaauaaagcaggagcaugaaacauccuggcacuacgaccaggaucacccauauaaaacuugggcuuaccaugggucauaugagaccaagcagacaggaagcgcaucgucuaugguuaauggcguagugcggcuccugacuaaacccugggacgucuugccgaccgugacacaaauggccaugaccgauacuacgccuuucggucagcagcguguuuuuaaggaaaagguggacacaagaacccaggagcccaaagaggggacuaagaaacugaugaagaucaccgcugaauggcucuggaaagagcuuggaaagaaaaagacaccacgcauguguacgagggaagaguucacccggaaggucagaaguaacgccgcacugggcgccauuuuuacugaugagaauaaauggaaguccgcucgcgaagcgguggaggacagcagguucugggaauuaguagauaaagagcgaaaccugcacuuggaaggcaagugcgagacauguguguacaauaugauggggaaacgggagaagaagcucggagaauuugguaaagccaagggcucaagagcaaucugguacauguggcugggggcuagguuccuagaguuugaagcccuuggauuccugaacgaggaccauugguuuucccgcgaaaauucucucagcggcguugagggugaggggcugcacaaauugggauauauucugcgugaugucaguaagaaagaaggcggcgcaauguacgccgacgacaccgcugggugggauacucggaucacacucgaggaccuuaagaacgaagagauggugaccaaucacaugaagggagaacauaaaaagcuggccgaggcgauuuucaaauuaacauaucaaaacaagguggucagaguucagaggccuacuccccgcgguaccgugauggauauaaucucccgacgggaccagagaggcagcgggcaaguaggaacguacggccugaauaccuuuacaaacauggaggcacaguugauuaggcagauggaaggugaggggguguucaaaaauauccagcaccucacugucaccgaagagguggccguucaaaacuggcuggcucgcgugggaagagagcggcuaucuaggauggccaucucaggcgaugacugcgucgugaagccacuugaugaccguuucgcaaacgcucugacagcccucaaugauaugggcaagauucgaaaagacauacagcagugggaacccaguaagggguggaacgauuggacucagguaccuuuuugcucccaucacuuccaugagcugaucaugaaagacggacgcguuuugguggucccauguagaaaucaagaugaauuaauuggucgggcuaggaucagccagggcgccggguggucucugcgcgagaccgcaugccucggaaagucguaugcgcagauguggucacuuauguacuuucacagacgggaccugaggcuagccgcuaacgccauuuguagcgcagugccgucccacugggugcccacgagucgaacaaccuggucuauccaugcuaaacacgaauggaugacuacagaggacaugcugaccgucuggaaucguguuuggauaagagagaacccuuggauggaagauaagacuccaguggagagcugggaagagauccccuaucucggcaagcgcgaagaccaguggugcgguuccuugauugggcugaccucacgggccacaugggccaaaaauauccaagccgcgauuaaccagguaaggagucuuaucggaaaugaggaguacacggauuacaugccuucuaugaagagauuccgccgggaagaggaagaggcuggcgugcugugguga

SEQ ID NO: 14788 - RNA, 9876 nt, Artificial Sequence
  derived and/or modified CDS sequence (opt3) from DENV-2__FJ024458__SS-prME
uccgccggaaugaucauuaugcugauacccaccgugauggcuuuccaccucacuacuagaaacggggaaccucauaugaucgucgggauucaagaaaaggguaaaucccuucuguuuaagacggaagacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggggcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggacggcgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggauuauuggaucgaguccgcucugaacgacacuuggaaaauagagaaggccucauucauugaagucaaaaauugccacugggcaaagagccauacccuuuggucuaacgguguguuggaguccgaaaugaucaucccuaaaaaccucgcugggccaguuagucaacacaauuaccggcugggauaccacacgcagauugccggccccuggcaucuagguaagcuggagauggauuucgacuuuugugauggcacaaccgugaucgucacugaagacugcgggaaccgaggaccuagccucagaaccacaacugcgucuggcaagcugauuaccgaguggugcuguagguccugcacacuuccacccuugcgcuaucggggagaagauggauguugguacggcauggaaauaagaccgcugaaagagaaggaagagaauuuagugaacucacucguuacggccggucacggacagguggacaauuucagucugggaguacuuggcauggcucuguuuuuggaagagaugcucaggacccgcgucgguacuaaacaugcaauccugcuaguggccgugagcuucgucacacugauuaccggcaacaugucguuuaaggaucucgggcgaguugugguaauggugggagcuacuauggccgacgauaucggcaugggggucacauaucuggcacuuuuggcggccuucaaagugcggccuaccuuugcugccggacuguuacuccguaagcugacguccaaggagcuuaugaugacuaccauuggcaucguucugcuaucucaaagcacaauaccagaaaccgugcucgagcugacugacgcauuggcucuggguaugauggucuuaaaaaucgugagaaauauggaaaaguaccagcucgccguuacaauuauggcaauccugugcgugcccaacgccgucauucuucagaaugcuuggaaaguaucauguaccauccuggcggugguuaguguguccccuuugcuccugacaucuagccagcaaaagacugacuggauaccccuagcccugaccauuaaagggcuuaacccaacggcaaucuuccucacaacccuguccaggacuaauaagaaacgcucauggccuuugaacgaggcuaucauggccgucggaauggugagcauucuggccaguucuuuacucaagaaugauauacccaugaccggcccacugguagcuggcgggcuucugacagugugcuaugucuugacuggacgguccgcagaccucgaacuggagagagccaccgauguuaagugggaggaccaggcggaaaucagcgguucgucaccgauucuaucuaucacgauuagugaggauggcuccaugagcaucaaaaacgaagaggaggaacagacacugaccauacuuaucaggacugggcuccuggugauuucuggauuguuuccuaucagcauucccaucacagcugccgcaugguacuuaugggaggugaagaaacagcgagccggcguccugugggacgugccaucacccccuccaauggguaaggcugaacucgaggauggggcauaucgcauaaaacaaaaggggauucugggcuacagccagaucggcgccgggguuuacaaggaaggaaccuuccacacuauguggcauguaacacggggugcggugcuuaugcacaaaggcaagagaaucgagcccaguugggcugacgucaaaaaggaucugauuagcuaugggggaggcuggaaauuggagggugaauggaaggagggggaagaggugcagguucuagcccuggaaccuggaaagaauccgagggcagugcagaccaaaccaggccucuuuaagacgaacacuggcaccaucggggccgucucucuggacuucucccccggaacaucagguaguccuauaauugauaaaaagggcaaagugguagggcuuuacggaaacggcgucgugacccguagcggugcuuauguuuccgccaucgcacaaacagagaagucuauugaggacaauccagaaaucgaggaugacauauuucgcaagcggagauuaacuauuauggaccugcaccccggggcuggaaaaaccaagagguaccucccugccaucgugcgagaagcgaucaaacggggcuugcgcacgcugauucucgccccgacaagagucguggcagcugagauggaagaggcccugaggggccuucccauccgguaucagacuccagcuauucgagcagagcauaccgggagagaaauaguugaucugaugugucacgccacauucaccaugcgcuugcuaucgccugugaggguccccaacuacaaucugaucauuauggacgaggcccauuucacugauccagcuagcaucgcggcacguggauauaucucaacccggguggaaaugggugaggccgcuggcauuuuuaugacagccacgccucccggguccagagacccauucccgcagaguaacgcaccuauaaucgaugaggaaagggagauucccgaacgcucuuggaauagcggacacgaguggguaacugacuuuaagggcaaaaccgugugguucguuccauccaucaaggccgguaacgauauugcugcgugccuccgaaagaaugggaaaaaggucauccaauuaucaagaaaaacauuugacucugaauacgugaagacccggacuaacgauugggacuucguggucacaaccgauauaagcgagaugggagccaauuuuaaagcagagaggguaaucgacccccgccguuguaugaagccugugauucugacggacggcgaagagagaguuauccuugcuggcccaaugcccgugacucauaguuccgccgcacagcggagggggcgcauuggacgaaacccuaaaaaugaaaacgaucaguacaucuauaugggugagccgcuggaaaaugacgaggauugcgcccacuggaaggaggcuaagaugcucuuggacaacauaaauacaccagaaggcauuauccccagcauguucgagccugaaagagagaaagucgaugccauugacggggaauaccggcugaggggagaggcgcgcaagaccuuuguggaucucaugagaaggggcgaccugcccguuuggcuugcauauaaaguggccgcugaggguaucaacuacgccgaucggcguugguguuucgacgggauaaagaacaaucagauccuagaagagaacgucgaaguggagauuuggaccaaagagggcgaacgcaagaagcugaaaccacgaugguuggaugcuagaaucuauucugacccuuuagcacugaaggaguuuaaagaguucgccgcuggaaggaagucacucacucugaaucuuauuacagagaugggccggcugcccaccuucaugacacagaaaacucgcgaugcccucgacaacuuggcaguacugcacacggcggaagccgggggcagagcuuacaaucaugcccuauccgagcugccagagacccucgaaacacuucuguuauugacucugcucgcaaccgugacagguggcaucuuucuguuccuuaugagugggaggggaauaggcaagaugacccuggguaugugcugcauuaucacugcuagcauccucuugugguaugcccagauucagccucacuggaucgcagccucgauaauucuggaguuuuucuuaaucguucuacugauuccggaacccgagaagcagcggacgccacaagacaaccagcucaccuacgucgugaucgcuauacuuacaguggucgcggccacuauggcaaaugaaaugggguuucuggagaaaaccaagaaagauuucggcuugggaucuaucgcuacacagcagccugaguccaacauucuggacaucgaucuccgacccgccagcgccuggacccuguacgcaguugcuacuacauuugugacgccaaugcuuagacauucaauugaaaauaguucuguaaacgugucccucaccgccaucgcgaaucaagcuacuguccugaugggcuuggggaagggauggccucugagcaaaauggacauuggugugcccuuacuagccaucggcuguuauucacagguuaacccgauaacacugaccgcagcccuccuucuguugguggcucacuacgcaauuaucgggccaggacugcaggccaaggcgacccgcgaggcucagaagagggccgcagccggcaucaugaaaaauccuacagucgaugguauuacuguaauagaccucgaucccaucccauaugaccccaaguucgaaaaacaacugggacaggugaugcuuuuaauucugugcguuacacaggugcucaugaugcggaccacaugggcuuugugugaggcccugacucuagcaaccggcccuaucaguacacugugggaaggaaacccgggccguuuuuggaauaccacuauugcugucagcauggccaacaucuucagaggguccuaccucgcgggagccggccuucuguuuucuauaaugaagaauacgacaaacaccaggcgcgguacugggaacaucggagagaccuugggcgagaaauggaaaagccggcugaaugcacucgguaaguccgaguuccaaauuuauaagaagucaggcauccaggagguggaucgaacacuggcuaaagaagggauuaagagaggagagacugaccaccaugccgucucuaggggcagugcaaaauuacgcugguuuguggagcggaacaugguuacccccgaagggaaggugguagaucuuggaugcggcagagguggguggucguacuauuguggaggccugaaaaaugugcgugaggucaagggucucacaaagggcgggccaggacacgaagaaccuauccccaugagcacguacggcuggaaccuaguuaggcugcaguccgggguggacgucuucuucauaccuccagaaaaaugcgauaccuugcugugugacauuggagagucuucacccaauccuacuguggaggcuggccggacacuccgcguacuuaaccugguggaaaauugguugaacaauaacacccaguuuugcaucaagguucugaauccauacaugcccagcgugaucgagaaaauggaagcccuccaacgaaaguaugguggggccuuagucagaaacccgcuguccaggaauaguacucaugagauguacugggugucuaacgcgagcggaaauauugucucauccgugaacaugauaagucggaugcuuaucaaccgcuucacaaugagacacaaaaaggcuaccuaugaaccugacguugaucugggcagcggcacgaggaauauugggaucgagucugagauuccaaaccuagacaucauaggaaagcgaaucgagaaaauuaagcaggagcaugaaaccuccuggcacuacgaucaggaccaccccuauaaaacaugggcauaccaugguucauaugagacuaagcagaccggcagcgccucgucuaugguaaauggggugguccggcuccugacaaaaccuugggauguguugccaacuguuacccaaauggcuaugacagacaccacucccuuuggacagcagcguguguucaaggaaaaggucgauacgagaacacaggagccgaaagagggcaccaagaaacugaugaagaucacugccgaauggcucuggaaagagcuugguaagaaaaagaccccucgcauguguacaagggaagaguuuacgcggaaggugagaaguaacgcagcccugggggcuauuuucaccgacgagaauaaauggaaguccgcgcgcgaagccguagaggauagcagguuuugggaauuaguggacaaagagcgaaaccugcacuuggaaggaaagugcgagacuuguguuuacaauaugaugggcaaacgggagaagaagcucggcgaguucgggaaagcaaagggaucaagagcuaucugguacauguggcugggugccagguuucuagaguucgaagcacuuggcuuucugaacgaggaucauugguucucccgcgaaaauucucucagcggggucgagggagagggccugcacaaauuggguuauauucugcgugacgugaguaagaaagaagggggagccauguacgcugacgauacagccggcugggacacccggauaacucucgaggaucuuaagaacgaagagauggugacaaaucacauggaaggcgagcauaagaaacuggcggaggcaaucuuuaaguuaaccuaucaaaacaaagucguuagagugcagaggcccacaccacgcgggacuguaauggacauuaucucccgacgggaucagagaggaagcggucaagugggcaccuacgggcugaauacguucaccaacauggaagcccaguugaucaggcagauggagggagaaggcgucuucaagaauauucagcaccucacagugacugaggagguugcugugcaaaacuggcuggcccgcgucgguagagaacggcuaucuaggauggcaauaucaggggacgauugcgugguaaaaccucuugacgaucguuuugcuaacgcccugaccgcucucaaugacaugggaaagauccgaaaggauauucagcagugggagcccaguaaaggcuggaacgacuggacacagguuccauucugcucccaucacuuucaugaacugaucaugaaggauggccgcguguuggucgugcccuguagaaaucaagacgaguuaauugggcgggccaggaucagccagggagcagguuggucucugcgcgaaacugcgugccucggcaaaucguaugcccagauguggucacuuauguacuuccacagacgggaccugaggcuagcugccaacgcaauauguagcgcugugccuucccacugggucccaaccagucgaacgacauggucuauccaugccaagcacgaguggaugaccacugaggauaugcugacaguuuggaaucguguguggauuagagaaaacccguggauggaggacaaaacccccguagaaagcugggaggaaaucccuuaucucgggaagcgcgaggaucaguggugcggauccuugauuggccugacuucacgggcaaccugggccaagaauauccaagcggcuauaaaccaggugaggagucuuauugguaaugaggaauacacagacuacaugccaucuaugaaaagauuucgccgggaggaagaggaagccgggguccugugguga

SEQ ID NO: 14789 - RNA, 9876 nt, Artificial Sequence
  derived and/or modified CDS sequence (opt3) from DENV-2__FJ205880__SS-prME
agcgcaggcaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacuaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcgucuugugacagcaaguuaauguccgcugccauuaaggauaauagggcaguacaugccgacauggguuauuggaucgagucagcucugaacgauacuuggaaaauagagaaggccagcuuuauugaagucaaaaauugccacuggccuaagucucauacccuuugguccaacgggguguuggagagugaaaugaucauccccaaaaaucucgcaggacccguuagccagcacaauuaccguccuggcuaccacacgcagauugcugguccauggcaucugggcaagcuagagauggacuucgauuucugugacgggacaaccgugaucgucacugaagauugcggaaaccggggccccucucugcgaaccacaacugccuccgggaagcucauuaccgaguggugcuguagaucaugcacacugccgccucuuagguaucgcggagaggacggcuguugguacgguauggaaauacggccauugaaagagaaggaagagaaucuggugaacaguuuaguuacggcggggcacggacaaguggauaauuuuagccucggcguacuggguauggcccuuuuccuggaagagauguugaaaaccagagucggcacuaagcaugcuauccuccugguggcagugucguuugucacacuaauuaccgggaacauguccuucaaagaccugggaaggguugugguaauggugggcgccacuauggcugaugacaucgggaugggagucacauaucucgcccugcuugcagcguuuaaggugcgccccaccuucgccgcuggcuugcuguuacgaaagcucacgucuaaagagcugaugaugacuaccauugguaucguucuucugagccagucaacaauaccugaaaccgugcuagagcucacugaugcccuggcauuggggaugaugguccugaagaucgugcggaauauggaaaaauaccaguuagcuguuacaauuauggccauccucugcgugcccaacgcagucauucugcagaaugccuggaagguaaguuguaccauccuugcugugguuuccgugucuccacuguugcucacaagcucccaacagaaaacugacuggauaccucuggcgcuaaccauuaagggacugaaccccacggccaucuuucuuacaacccucucacguacuaauaaaaagagaagcuggccacugaacgaggcaaucauggcugucggcauggugaguauuuuggccucuucccuguuaaagaaugacauaccgaugaccggcccucucguagccgggggacugcuuacagugugcuauguccugacugguaggagcgcugauuuggaacucgagcgcgcaaccgacguuaaaugggaggaucaggccgaaaucucgggcucaucucccauucugaguaucacgauuuccgaggacgggagcaugucuaucaagaacgaagaggaggaacagacacuaaccauacugauccggacuggacuucucgugauuagcggccuguucccaaucuccauucccaucacagcggcugccugguacuugugggaggugaaaaagcaaagagccggugucuuaugggaugugccuucaccacccccuauggggaaagccgaacuggaggacggagcuuauaggauaaagcagaagggcauucucggcuacagucagaucggggcaggaguuuacaaagaagguaccuuucacacuauguggcauguaacacgaggcgccgugcugaugcacaaggggaaacgcaucgagccgagcugggcggaugucaagaaagaccuuauuucuuauggaggcgguuggaagcuggagggggaauggaaggagggagaagaggugcagguuuuggcucuagaaccaggcaaaaauccccgggccgugcaaaccaagccuggccuguucaaaacgaacacugggaccaucggagcagucucccucgauuuuucaccagguacaaguggcagccccauaauugacaagaaagggaaggugguaggacuguacggcaacggugucgugaccagauccggggccuauguuucugcuaucgcccagacagagaagucgauugaggauaauccugaaaucgaggacgauauauucaggaaacgucgccuuacuauuauggacuuacacccgggagcaggcaagaccaaacgguaccugcccgcuaucgugagagaagccaucaagaggggccuccgaacguugauucuggcgccaacacgggucguggccgcagagauggaagaggcucuccgcgggcugccuaucagauaucagacucccgccauuagggcugagcauaccggacgggaaauaguugaccuuaugugucacgcaacauuuaccaugcgacuguugagcccagugagagucccuaacuacaaucuaaucauuauggaugaggcccauuucacugaccccgccucaaucgcugcgcgcgguuauaucuccaccaggguggaaaugggcgaggcagccgggauuuucaugacagcuacgccaccgggaagucgugauccuuuuccccaaucuaacgccccaauaaucgacgaggaacgggagauucccgaaagaagcuggaacuccggccacgaguggguaacugauuucaaagguaagaccgugugguuuguuccuucaaucaaggcagggaacgacauugccgcuugccugaggaaaaauggaaagaaagucauccagcucucucgcaagacauucgauagcgaauacgugaaaacccgaacuaacgacugggauuuuguggucacaaccgacauaagugagaugggcgcgaauuucaaggccgagagaguaaucgauccacggagguguaugaaacccgugauuuuaacggacggcgaagaacgcguuauccuggcagggccuaugccggugacucauuccagcgcugcccagcguagaggacggauugguaggaacccaaagaaugaaaacgaccaguacaucuauaugggcgagccccuugaaaaugaugaggacugcgcacacuggaaggaggccaaaaugcugcucgauaacauaaauacaccugaagggauuauccccucuauguuugagccagaacgcgagaaggucgacgcuauugauggagaauaccgauugagaggcgaggcccggaaaaccuucguggaccugaugaggcgcggugaucucccuguuuggcuggcguauaagguggcagccgaggggaucaacuacgcugacagaaggugguguuuugauggcaucaaaaacaaucaaauccuugaagagaacgucgaaguggagauuuggaccaaggagggagaacggaagaaacuaaagccccguuggcuggacgcccgcaucuauucagauccauuggcuuuaaaagaguucaaggaauuugcagccggccgaaaaucccugacucucaaucugauuacagagauggggagacuuccuaccuucaugacacagaagacuagggacgcucuggauaaccucgccguauugcacacggcagaagcgggaggucgggccuacaaucaugcucugagugagcuaccggagacccuggaaacacuccuucuguuaacuuugcuggccaccgugacaggcgggaucuuccucuuucugaugagcggacgcggcauagguaagaugacccuugggaugugcugcauuaucacugcaucgauccugcucugguaugcucagauucagccccacuggaucgccgcaucuauaauuuuggaguucuuucugaucguuuuacuaauuccagaaccugagaaacaaagaacgccccaggacaaccagcugaccuacgucgugaucgccauacucacaguggucgcugcgacuauggccaaugaaaugggcuuccuugagaagaccaaaaaggaccugggauugggcuccaucgcaacacagcaaccagagagcaacauucuggauaucgaccucaggccugcuucagccuggacccuguacgccguugcaacuacauuugugacgcccaugcuucggcauaguauugaaaauucuuccguaaacgugagccucaccgcuaucgccaaucaggcgacuguccugaugggguugggaaaagguuggccgcugucaaagauggauauuggcgugccauuacuagcuaucggguguuauagucagguuaacccuauaacacugaccgccgcacuccuucuguugguggcccacuacgcuauuaucggacccggccugcaggcaaaggccacccgagaggcgcagaaaagagcugccgcagguaucaugaagaauccaacagucgacgggauuacuguaauagaucucgaccccaucccuuaugauccgaaauucgaaaagcagcugggccaggugaugcuuuuaauucugugcguuacgcaagugcucaugaugcgcaccacaugggccuugugugaggcucugacucuagccaccggacccaucagcacacugugggaaggcaacccagggagguuuuggaauaccacuauugcagucuccauggcuaacaucuuccggggaucuuaccucgccggcgcgggucuucuguuuagcauaaugaaaaauacgacaaacacccguagagggacuggaaacaugggcgagaccuugggugagaaguggaaauccaggcugaaugcccucggcaagucagaguuccagaucuauaagaaaucugggauucaggagguggaccgcacacuggcaaaggaaggaaucaaacggggcgagacugaucaccaugcugucagucgagggucggccaaguuaagaugguuuguggagaggaacaugguuaccccugaaggaaaagugguagaccuuggcugcggucgcgggggauggagcuacuauuguggcggucugaagaaugugcgggaggucaagggccucacaaaagggggacccggccacgaggaaccuauuccaauguccacguacggguggaaccuaguuagacugcagucuggaguggaugucuucuuuauaccaccugaaaagugcgacaccuugcugugugauauaggcgagucaagcccaaaucccacuguggaggcaggucguacacucaggguacuuaaccugguggaaaauugguugaacaauaacacccaauucugcauuaaaguucugaauccguacaugccuuccgugaucgagaagauggaagcucuccagcggaaauaugggggagccuuaguccgcaacccacugagucgaaauucuacucaugagauguacugggugagcaacgccucaggcaauaucgucuccagugugaacaugauuagcagaaugcuuauaaacagguucacaaugcggcacaagaaggcgaccuaugaacccgacguugaccugggcucugggacgcgcaauaucggaauugaguccgagaucccuaaccuagauauuaucgguaaaagaauagaaaagaucaaacaggagcaugaaaccucauggcacuacgaccaggaucacccauauaagacaugggcuuaccauggcagcuaugagacuaaacaaaccgggucggcaucuaguaugguaaauggaguggucaggcuccugacaaagcccugggacguguugccgacuguuacccagauggccaugacagauaccacuccuuuuggccagcagcgaguguucaaggaaaaagucgacacgcggacacaagagcccaaggaggguaccaaaaagcugaugaaaauuacugcugaauggcucuggaaggagcuugggaaaaagaagaccccacguauguguacaagagaagaguuuacgcgcaaagugagguccaacgccgcacugggagccaucuucaccgaugagaauaaguggaaaagcgcucgggaagcgguagaggacucaagauuuugggaauuaguggauaaggagcgcaaccugcacuuggaaggcaaaugcgagacuuguguuuacaauaugaugggcaagagggagaagaaacucggggaguucggaaaggccaaagguucccgagcaauuugguacauguggcugggcgcucgguuucuagaguucgaagcccuuggguuucugaacgaggaccauugguucucuagagaaaauagccucaguggagucgagggcgagggucugcacaaguugggguauauccugagggauguguccaaaaaggaaggaggcgcaauguacgccgacgacacagcuggcugggauacccgcauuacucucgaggaccuuaagaacgaagagauggugacaaaucacauggaaggggagcauaaaaagcuggccgaggcgauauuuaaauuaaccuaucagaacaaggucguucgugugcagcggccuacacccagaggaacuguaauggauaucauuagcaggcgcgaccaacgagguucuggccagguggggaccuacggacugaauacguucaccaacauggaagcacaguugauccggcagauggagggcgaaggugucuuuaaaaauauccaacaccucacagugacugaggagguugccgugcagaacuggcuggcuagagucgggagggaacgccuaucaagaauggccauuaguggagaugacugcgugguaaagccacuugaugaccgguucgcaaacgcucugaccgcccucaaugauaugggcaagauaaggaaagacauccagcagugggagcccuccaagggcuggaacgauuggacacaaguuccuuucugcagccaucacuuucaugaacugauuaugaaagacgggcguguguuggucgugccaugucgaaaucaggaugaguuaaucggacgcgcuagaauuucucagggugccggcuggucgcugcgggaaacugcaugccucgggaagucauaugcgcagauguggagccuuauguacuuccacaggcgcgaccugagacuagccgcuaacgccaucuguuccgcagugccgagucacuggguccccaccucucggacgacauggagcauacaugcuaaacacgaguggaugaccacugaggacaugcugacaguuuggaauaggguguggauccgagaaaacccuuggauggaggauaagaccccaguagaauccugggaggaaauucccuaucucggaaagcgugaggaccaauggugcggcucauugaucggucugacaaguagagccaccugggccaaaaauauucaggccgcgaucaaccaggugcgcucucuuauagggaaugaggaauacacagauuacaugccuagcaugaagcgguuuaggagagaggaagaggaagcuggaguccugugguga

SEQ ID NO: 14790 - RNA, 9876 nt, Artificial Sequence
  derived and/or modified CDS sequence (opt3) from DENV-2__FJ390387__SS-prME
agcgccggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaagugcccuucgagauuauggacuuggaaaagagauacguccucgggaggcugaucacugugaacccgauuguuaccgagaaagauagcccugugaacauagaagcugagcccccauuuggcgacucguacaucauuaucggaguagagccuggccaauuaaagcugaauugguucaagaaagggucuuccaucggacagauguuugaaacgaccaugcggggugccaagcgaauggcuauucuaggcgauacagccugggacuucgggucacucggaggcgucuuuacaaguauagguaaagcacugcaucagguguucggggccaucuauggcgcugcguuuagcggaguuuccuggaccaugaagauucuuaucggcgugauuaucacauggauagggaugaacucucgcagcacuucauugagugucucccuggugcucguaggaaucgugacccuguaccuuggcguuaugguccaggcagauagcgguuguguggugucuuggaaaaauaaggagcugaagugcgggucaggaauuuucaucacggacaacguccacacauggaccgaacaauauaaauuucagcccgagaguccaagcaaguuggccuccgcuauucagaaagcccaggaagagggcaucugugguauaagaucuguuacuaggcucgagaaucugauguggaagcaaauuacacccgaauuaaaccacauccuggcagagaaugaagugaaacuaaccauuaugacuggcgauaucaaggggauaaugcaggccggaaaacggucgcuccgcccucagccaaccgagcugaaguacagcuggaagacauggggcaaagcuaagaugcuuuccacggaaucauauaaccagaccuucuugaucgacgggccggagacugccgagugccccaauacaaacagagcauggaauagucuggaaguggaggauuacggauuuggcguauucaccacaaacauuuggcucaaacugaaggaaaaacaagacgcguuuugugacucuaaguuaaugagcgcugccaucaaggauaauagggcaguccaugccgacauggguuauuggauugaguccgcucugaacgauacuuggaaaaucgagaaggccucauucauagaagugaaaaauugccacuggccuaagagccauacccuuuggucuaacgggguuuuggaguccgaaaugauuauccccaagaaccucgcaggacccgugagucagcacaauuaccguccuggcuaccacacgcagaucgcugguccauggcaucugggcaagcuagagauggacuucgauuuuugugacgggacaaccgucauugugacugaagauugcggaaaccggggccccagccugcgaaccacaacugccucugggaagcucaucaccgaguggugcuguagauccugcacacugccgccucuuagguaucgcggagaggacggcuguugguacgguauggaaauucggccauugaaagagaaggaagagaaucugguuaacucauuagugacggcggggcacggacaaguagauaauuucagucucggcguccuggguauggcccuuuuucuggaagagauguugagaaccagggugggcacuaaacaugcuauacuccugguggcagucagcuucguuacacuaaucaccgggaacaugucguuuaaggaccugggacgcgugguagugauggucggcgccacuaugacagaugacauugggaugggagugaccuaucucgcucugcuugccgcauucaaaguucgacccacguuugcggccggcuugcuguuacggaagcucacuuccaaggagcugaugaugaccacaaucgguauugugcuucugucucagagcaccaucccugaaacuguccuagagcucacagaugcucuggccuuggggaugauggugcugaaaauaguucguaauauggaaaaguaccaguuagcagugaccaucauggcuauucucugcguccccaacgccguaauccugcagaaugcauggaaagugucauguacaauucuugccguugugagugucuccccacuguugcucacuucuagccaacagaagaccgacuggaucccucuggcucuaacgauaaaaggacugaaccccacagcgauuuuccuuaccacucucuccagaaccaauaagaaaaggucauggccacugaacgaggccaucauggcagugggcaugguaagcaucuuggcuaguucucuguuaaagaaugacauuccgaugacaggcccucucguggccgggggacugcuuacugucugcuauguucugaccggucgcuccgccgauuuggaacucgagcgggcuacggacgugaagugggaggaucaggcagaaauaagcggcucgucacccauccugucuauuacaaucagugaggacggguccaugagcauuaaaaacgaagaggaggaacagacccuaacuauccugauaagaacaggacuucucgugaucucuggccuguuuccaauuagcauccccauuaccgccgcggcuugguacuugugggaggucaagaaacaaagggccgguguguuaugggauguuccuuccccacccccuauggggaaggcagaacuggaggacggagccuaucgaaucaaacagaagggcauacucggcuacucacagauuggggcuggaguauacaaggaagguacuuuccacacaauguggcaugugacccgcggcgcaguccugaugcacaaagggaagcggaucgagccgaguugggccgaugugaaaaaggaccuuaucagcuauggaggcgguuggaaacuggagggggaauggaaggagggagaagagguucagguguuggcgcuagaaccaggcaagaaucccagagcuguccaaacgaaaccuggccuguuuaagacuaacaccgggacaauuggagccgugucucucgauuucuccccagguaccucaggcagucccaucauagacaaaaaggggaaaguagucggacuguacggcaacggugugguuacaaggagcggggcauauguguccgccauugcucagacugagaagucuaucgaggauaauccugaaauugaggacgauaucuuucguaagcgccggcuuaccauaauggacuuacacccgggagccggcaaaacgaagagauaccugcccgcaauugucagggaagcuaucaaacgaggccuccggacauugauccuggccccaacucgcgugguugcggccgagauggaagaggcacucagagggcugccuauuagguaucagacccccgcuauccgggccgagcauacaggacgagaaauuguggaccuuaugugucacgcuaccuucacuaugagacuguugucgccaguccgcgugccuaacuacaaucuaauaaucauggaugaggcacauuucaccgaccccgccagcauugccgcuagggguuauaucucaacacguguagaaaugggcgaggcggcagggaucuuuaugacggccacuccaccgggaucccgggauccuuucccccaaaguaacgcuccaauuauagacgaggaaagagagauccccgaaaggucuuggaauagcggccacgagugggugaccgauuuuaaggguaaaacaguuugguucgucccuuccauuaaggccgggaacgacaucgcagccugccugcgcaagaauggcaagaaggugauucagcucucacgaaaaaccuuugauucugaauacgugaagacuagaacaaacgacugggauuucgucguaaccacggacaucagcgagaugggcgcuaauuuuaaagcggagcgggugauagauccaaggcgcuguaugaagcccguuaucuuaacugacggcgaagaacgugugauucuggccgggccuaugccggucacacauaguuccgcagcucagagacggggaaggaucggucgcaaccccaaaaaugaaaacgaccaguacauuuauaugggcgagccccuugaaaaugaugaggacugcgcccacuggaaggaggcaaagaugcugcucgauaacaucaauaccccugaagggauaauucccagcauguucgagccagaacgagagaaaguggacgccaucgauggagaauacagauugcggggcgaggcuaggaagaccuuuguugaccugaugcgcagaggugaucucccuguguggcuggccuauaaagucgcggcagaggggauuaacuacgccgacaggcggugguguuucgauggcaucaagaacaaucaaauacuugaagagaacguggaaguagagaucuggacuaaagagggagaacguaagaagcuaaaaccccgcuggcuggacgcucgaauuuauucugauccauuggccuuaaaggaguuuaaagaguucgcugcaggcagaaagucacugacacucaaucugaucaccgagauggggaggcuuccuacauucaugacucagaaaacgcgggacgcccuggauaaccucgcuguguugcacaccgccgaagcaggaggucgcgcguacaaucaugcccuguccgagcuaccggagacacuggaaacucuccuucuguuaaccuugcuggcuacaguuaccggcgggauuuuucucuuccugaugaguggaagaggcaucgguaagaugacucuugggaugugcugcauaauuacggccagcauccugcucugguaugcacagauccagccccacuggauugcugccucgaucauauuggaguuuuuccugauugucuuacuaaucccagaaccugagaagcaaaggaccccacaggacaaccagcugacauacguggugauugcaauccucacugucguugccgcuaccauggcgaaugaaaugggcuuucuugagaaaacaaagaaagaccugggauugggcucuauagccacccagcaaccagaguccaacauccuggauauugaccuccggccugcaagcgcuuggacucuguacgccguggccacaacguucguaacccccaugcuucgacauucaaucgaaaauaguucugugaacgucucccucacugcaauugcuaaucaggccacagugcugaugggguugggaaaggguuggccgcugagcaaaauggauaucggcguuccauuacuagcgauuggguguuauucacaggugaacccuaucacccugaccgcugcccuccuucuguuggucgcacacuacgccauaauuggacccggccugcaggcuaaggcaacaagagaggcccaaaagcgcgcggcugccgguaucaugaaaaauccaacuguagacgggaucacggugauugaucucgaccccauaccuuaugauccgaaguuugaaaaacagcugggccagguuaugcuuuuaauccugugcgugacccaaguccucaugaugaggacaacuugggcauugugugaggcccugacccuagcuacaggacccauuaguacccugugggaaggcaacccagggcgguucuggaauacuacgaucgccgugagcauggcaaacauuuuucguggauccuaccucgcuggcgccggucuucuguucucuaucaugaagaauacaaccaacacuagaagggggaccggaaacaugggcgagacauugggugagaaauggaaaagccgccugaaugcgcucggcaaauccgaauuucagauauauaagaagucagggauccaggaggucgaccggacucuggccaaagaaggaauuaagcgaggcgagaccgaucaccaugcagugucuagagggagugcuaaauuaaggugguucguugagcgcaacauggugacaccugaaggaaagguaguggaccuuggcugcgguagagggggauggucguacuauuguggcggucugaaaaaugucagagagguuaagggccucacgaaagggggacccggccacgaggaaccuaucccaaugagcaccuacggguggaaccuagugcgucugcaguccggagucgauguguuuuucauucccccugaaaaaugcgacacuuugcugugugauaucggcgagucuucaccaaaucccacaguagaggccgguaggacccuccgggugcuuaaccugguugaaaauugguugaacaauaacacucaauucugcauaaaggugcugaauccguacaugccuagcgucauugagaaaauggaagcacuccagcgcaaguaugggggagcuuuagugcgaaacccacuguccagaaauaguacacaugagauguacugggucucuaacgccagcggcaauaucgugucauccguuaacaugaucaguaggaugcuuauuaaccgguuuaccaugcgccacaaaaaggccacguaugaacccgacguagaccugggcagcgggaccagaaauauaggaaucgagucugagauuccuaaccuagauaucauugguaagaggaucgagaaaauaaagcaggagcaugaaacauccuggcacuacgaccaggaucacccauauaaaacuugggcguaccauggcucauaugagaccaagcaaacagggagcgcuucgucuauggugaauggagucgugcgacuccugacuaaacccugggacguuuugccgaccgugacacagauggcaaugaccgauacuacgccuuucggccagcagcgggucuuuaaggaaaagguggacacacguacccaagagcccaaagaggguacuaagaaacugaugaagaucaccgccgaauggcucuggaaagagcuugggaagaaaaagacaccaagaauguguacgcgcgaagaguucaccaggaagguacggaguaacgcugcccugggagcaauuuuuacugaugagaauaaauggaaguccgccagagaagcuguggaggacagccgcuucugggaauuaguugauaaagagaggaaccugcacuuggaaggcaagugcgagacaugugucuacaauaugaugggcaaacgagagaagaagcucggggaauuuggaaaagcgaaggguucacgggccaucugguacauguggcugggcgcaagauuccuagaguuugaagcucuuggguuccugaacgaggaccauugguuuuccagggaaaauucucucagcggaguggagggcgagggucugcacaaauugggguauauucugcgcgaugugaguaagaaagaaggaggcgccauguacgcagacgacaccgccggcugggauacucguaucacacucgaggaccuuaagaacgaagagauggucaccaaucacauggaaggggagcauaagaaacuggcugaggccauuuucaaguuaacauaucagaacaaaguugugcggguacagagaccuacucccaggggaaccgugauggauauaaucucccgccgagaccaacgggguagcggccaggucgggacguacggacugaauaccuuuacaaacauggaagcgcaguugauuagacagauggagggcgaagguguguucaagaauauccaacaccucacuguuaccgaggagguggcagucaaaaacuggcuggccaggguggggcgcgaaagacuaucucggauggcuaucucaggagaugacugcguaguuaagccacuugaugacagguucgccaacgcacugacagcucucaaugauaugggcaagauucguaaagacauacagcagugggagcccaguaagggcuggaacgauuggacucaggugccuuuuugcucccaucacuuccaugaacugaucaugaaagacgggcgagucuugguggugccaugucgcaaucaagaugaguuagucgguagagcccggauuagccagggagcuggcuggucucugagggaaaccgccugccucgggaagucguaugcacagauguggucacuuauguacuuucaccgcagagaccugcggcuagcggccaacgcuaucuguagcgccguuccgucccacugggugcccacgaguaggacaaccuggucuauucaugcaaaacacgaguggaugacuacagaggacaugcugaccguauggaaucgaguguggauccgugaaaacccuuggauggaggauaagacuccagucgaaagcugggaggaaauacccuaucucggaaagagagaggaccaguggugcggcuccuugaucggucugaccucacgcgcuacaugggccaaaaauauucaagcagccaucaaccaggugcggagucuuauugggaaugaggaauacacggauuacaugccuucuaugaagagguucagacgcgaggaagaggaagcgggaguucugugguga

SEQ ID NO: 14791 - RNA, 9876 nt, Artificial Sequence
  derived and/or modified CDS sequence (opt3) from DENV-2__FJ024461__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaagcuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggaaaaaagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacuaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccgucugggcuaccacacgcagauugcugguccuuggcaucuaggcaagcuggagauggacuucgauuuuugugacgggacaaccgugaucgucacugaagauugcggaaaccggggcccaagccuccgaaccacaacugccucugggaaacugauuaccgaguggugcuguagauccugcacacuucccccguugagguaucgcggagaggacggcuguugguacgguauggaaauacggccucugaaggagaaagaagagaauuuagugaacucacucguuacggcggggcacggacagguggauaauuucagucugggcguacuugguauggcccuguuuuuggaagagaugcucagaaccagggucggcacuaagcaugcuauccugcuaguggcagugagcuucgucacacugauuaccgggaacaugucguuuaaagaccucggacgcguugugguaauggugggcgccacuauggcugaugacaucgggaugggagucacauaucuggcccuuuuggcagcguucaaggugcgaccaaccuuugccgcuggccuguuacuccggaagcugacguccaaagagcuuaugaugacuaccauugguaucguucugcuaucucaaagcacaauacccgaaaccgugcucgagcugacugaugccuuggcacuggggaugauggucuuaaagaucgugcguaauauggaaaaauaccagcucgcuguuacaauuauggccauccugugcgugccuaacgcagucauucuucagaaugccuggaagguaucauguaccauccuggcugugguuagugugucccccuugcuccugacaucuagccagcaaaaaacugacuggauaccacuagcgcugaccauuaagggacuuaacccuacggccaucuuccucacaacccuguccagaacuaauaaaaagaggucauggcccuugaacgaggcaaucauggcugucggcauggugagcauucuggccaguucuuuacucaagaaugacauaccaaugaccggcccgcugguagccgggggacuucugacagugugcuaugucuugacuggucgcuccgcugaucucgaacuggagcgggcaaccgacguuaaaugggaggaucaggccgaaaucagcggcucgucaccuauucuaucuaucacgauuagugaggacggguccaugagcaucaagaacgaagaggaggaacagacacugaccauacuuaucagaacuggacuccuggugauuucuggcuuguuucccaucagcauuccaaucacagcggcugccugguacuuaugggaggugaaaaagcagagggcagguguccugugggaugugcccuccccuccacccauggggaaagccgaacucgaggacggagcuuaucgaauaaagcaaaagggcauucugggcuacucacagaucggggcaggaguuuacaaagaagguaccuuccacacuauguggcauguaacacgcggcgccgugcuuaugcacaaggggaaacggaucgagccuaguugggcggaugucaagaaagaccugauuagcuauggaggcgguuggaaguuggagggggaauggaaggagggagaagaggugcagguucuagcucuggaaccgggcaaaaauccaagagccgugcagaccaagcccggccucuuuaaaacgaacacugggaccaucggagcagucucucuggauuucuccccugguacaucaggcaguccaauaauugacaagaaagggaaggugguaggacuuuacggcaacggugucgugaccaggagcggggccuauguuuccgcuaucgcccaaacagagaagggaauugaggauaaucccgaaaucgaggacgauauauuucguaaacgccgguuaacuauuauggaccugcacccuggcgcaggcaagaccaaaagauaccucccggcuaucgugagggaagccaucaagcgaggguugcggacgcugauucucgcgcccacacgcgucguggccgcagagauggaagaggcucugagaggacuuccaaucagguaucagacuccugccauucgggcugagcauaccggucgagaaauaguugaccugaugugucacgcaacauucaccaugagauugcuaucucccgugcgcgucccaaacuacaaucugaucauuauggaugaggcccauuucacugacccugccucgaucgcugcgaggggcuauaucagcacccguguggaaaugggggaggcagccggaauuuuuaugacagcuacgcccccaggcucacgggauccguucccucaguccaacgcccccauaaucgacgaggaaagagagauuccagaaaggaguuggaauucuggucacgaguggguaacugauuuuaaagggaagaccgugugguucguucccagcaucaaggcaggaaacgacauugccgcuugccuccgcaaaaauggcaagaaagucauccaauuaucccgaaagacauuugauucagaauacgugaaaaccagaacuaacgacugggauuucguggucacaaccgacauaucugagaugggcgcgaauuuuaaggccgagcggguaaucgauccuaggcgcuguaugaaaccagugauucugacggacggggaagagcguguuauccuugcaggacccaugccugugacucauagcagugcugcccagagacgggguaggauuggccgcaacccgaagaaugaaaacgaccaguacaucuauaugggggagccacuggaaaaugaugaggacugcgcacacuggaaggaggccaaaaugcucuuggauaacauaaauacacccgaaggaauuaucccuuccauguucgagcccgaacgagagaaggucgacgcuauugauggcgaauacagacugcggggugaggccaggaaaaccuuuguggaccucaugcgcagaggggaucugccaguuuggcuugcguauaagguggcagccgagggcaucaacuacgcugacaggcggugguguuucgauggaauaaaaaacaaucagauccuagaagagaacgucgaaguggagauuuggaccaaggagggcgaacguaagaaacugaagccucgcugguuggacgcccgaaucuauagcgaucccuuagcucugaaagaguuuaaggaauucgcagccgggagaaaaucucucacucugaaucuuauuacagagaugggaaggcugccaaccuucaugacacaaaagacucgggacgcucucgauaacuuggccguacugcacacggcagaagcggguggccgcgccuacaaucaugcucuaucagagcugccugagacccucgaaacacuucuguuauugacucugcucgccaccgugacagggggaaucuuucuguuccuuauguccggcagagguauagggaagaugacccugggcaugugcugcauuaucacugcaaguauccucuugugguaugcucagauucagccgcacuggaucgccgcaagcauaauucuggaguuuuucuuaaucguucuacugauucccgaaccagagaaacagaggacgccucaagacaaccagcucaccuacgucgugaucgccauacuuacaguggucgcugcgacuauggccaaugaaaugggauuucuggagaagaccaaaaaggacuucggcuuggggucgaucgcaacacagcagcccgagucuaacauucuggauaucgaccuccggccagcuuccgccuggacccuguacgccguugcaacuacauuugugacgccuaugcuucgacauagcauugaaaauucaaguguaaacgugucucucaccgcuaucgccaaucaagcgacuguccugaugggauuggguaaaggcuggccccuguccaagauggauauuggggugccguuacuagcuaucggauguuauagccagguuaacccaauaacacugaccgccgcacuccuucuguugguggcccacuacgcuauuaucggcccuggucugcaggcaaaggccaccagagaggcgcagaaacgcgcugccgcagggaucaugaagaaucccacagucgacggcauuacuguaauagaucucgacccaauccccuaugauccuaaauucgaaaagcaacugggacaggugaugcuuuuaauucugugcguuacgcaggugcucaugaugaggaccacaugggccuugugugaggcucugacucuagccaccggcccgaucucaacacugugggaagggaaccccggacgguuuuggaauaccacuauugcagucaguauggcuaacaucuuccguggcagcuaccucgccggugcggggcuucuguuuuccauaaugaaaaauacgacaaacaccagaaggggaacuggcaacaucggugagaccuugggcgagaaguggaaaucucgccugaaugcccucgggaagagcgaauuccaaauuuauaagaaauccggaauccaggagguggaccggacacuggcaaaggaaggcauuaaacgaggggagacugaucaccaugcugucucaagaggaucugccaaguuaaggugguuuguggagcgcaacaugguuaccccagaaggcaaagugguagaccuugguugcgggcggggaggcuggaguuacuauugugguggccugaagaaugugagagaggucaaggggcucacaaaaggaggcccugggcacgaagagcccaucccuaugucgacguacggauggaaccuaguucgucugcagagcggcguggaugucuucuucauaccacccgaaaagugcgacaccuugcugugugauauuggugaguccucuccuaauccaacuguggaggcagggaggacacuccggguacuuaaccugguggaaaauugguugaacaauaacacccaguuuugcaucaaaguucugaaucccuacaugccgucagugaucgagaagauggaagcucuccaacgcaaauauggaggcgccuuaguccgaaacccucugagcagaaauuccacucaugagauguacugggugaguaacgccucuggcaauauugucagcucagugaacaugauauccaggaugcuuaucaaccgguucacaaugcgccacaagaaggcgaccuaugaaccagacguugaccuggggaguggaacgagaaauauugguaucgagagcgagauucccaaccuagauaucauaggcaaaaggaucgaaaagauuaaacaggagcaugaaaccucuuggcacuacgaccaggaucacccuuauaagacaugggcuuaccauggguccuaugagacuaaacagaccggaucagcaagcucgaugguaaauggcgugguccgacuccugacaaagccaugggacguguugcccacuguuacccaaauggccaugacagauaccacuccguuuggucagcagcggguguucaaggaaaaagucgacacgcguacacaggagccuaaggaggggaccaaaaagcugaugaaaaucacugcugaauggcucuggaaggagcuuggaaaaaagaagacccccagaauguguacacgcgaagaguuuacgaggaaagugcggucuaacgccgcacugggcgccauuuucaccgaugagaauaaguggaaaagugcuagagaagcgguagaggacucccgcuuuugggaauuaguggauaaggagaggaaccugcacuuggaaggcaaaugcgagacuuguguuuacaauaugauggggaagcgagagaagaaacucggagaauucgguaaggccaaaggcagccgggcaaucugguacauguggcugggggcuagauuucuagaguucgaagcccuuggauuucugaacgaggaccauugguucucaagggaaaauucccucucuggcgucgagggugaggggcugcacaaguugggauauauucugcgcgaugugagcaaaaaggaaggcggcgcaauguacgccgacgacacagcugggugggauacccguauaacucucgaggaccuuaagaacgaagagauggugacaaaucacauggaaggagagcauaaaaagcuggccgaggcgaucuuuaaauuaaccuaucaaaacaaggucguucgggugcagagaccaacaccuagggguacuguaauggauauuaucagucgccgagaccagcggggcuccgggcaagugggaaccuacggccugaauacguucaccaacauggaagcacaguugaucagacagauggagggugaaggggucuucaaaaauauucagcaccucacagugacugaggagguugccgugcaaaacuggcuggcuagggucggacgcgaaagacuaagccggauggccauaucuggcgaugacugcgugguaaagccccuugaugacagguuugcaaacgcucugaccgcccucaaugauaugggcaagauccguaaagacauucagcagugggagccaucaaagggguggaacgauuggacacagguucccuucugcagucaucacuuucaugaacugaucaugaaagacggacgaguguuggucgugccuugucgcaaucaagaugaguuaauugguagagcucggaucucccagggcgccggguggagccugagggaaacugcaugccucggaaagucuuaugcgcagauguggucgcuuauguacuuccaccgcagagaccugcggcuagccgcuaacgccauauguucagcagugccaagccacugggucccgaccuccaggacgacauggaguauccaugcuaaacacgaguggaugaccacugaggacaugcugacaguuuggaaucgaguguggauucgugaaaaccccuggauggaggauaagaccccuguagaaucuugggaggaaaucccauaucucggcaagagagaggaccaguggugcgguagcuugauugggcugacuucccgcgccaccugggcaaaaaauauccaagccgcgauaaaccaggugcggucacuuauuggaaaugaggaauacacagauuacaugcccaguaugaagagguuuagacgcgaggaagaggaagcuggcguccugugguga

SEQ ID NO: 14792 - RNA, 9876 nt, Artificial Sequence
  derived and/or modified CDS sequence (opt3) from DENV-2__FJ373299__SS-prME
agcgcaggaaugaucauuaugcugauacccaccgugauggcuuuccaccucacuacuagaaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccauuacucaggcaaaacgaaccggaggauauugacuguuggugcaauucuaccucaacaugggugaccuauggaacuuguacaaccacgggagagcaccggcgcgaaaagcgaaguguagcccuggugccccaugucgguauggggcuugagacucguaccgaaacauggaugagcuccgagggggcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuagguuaaugagcgcugccauuaaggauaaucgugcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucagcacaauuaccggccuggcuaccacacgcagauugcugguccauggcaucugggcaaacuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaggagaaagaagagaaucuggugaacucauuaguuacggcggggcacggacaaguggauaauuucagucucggcguacuggguauggcccuuuuucuggaagagauguugaggacccgcgucggcacuaagcaugcuauccuccugguggcagugagcuucgucacacuaauuaccgggaacaugucguuuaaagaccugggacgaguugugguaauggugggcgccacuauggcugaugacaucgggaugggagucacauaucucgcccugcuugcagcguucaaggugcggcccaccuuugccgcuggcuugcuguuacguaaacucacguccaaggagcugaugaugacuaccauugguaucguucuucugucucagagcacaauaccugaaaccgugcuagagcucacugaugcccuggcauuggggaugaugguccugaagaucgugagaaauauggaaaaauaccaguuagcuguuacaauuauggccauccucugcgugcccaacgcagucauucugcagaaugccuggaagguaucauguaccauccuugcugugguuaguguguccccacuguugcucacaucuagccaacagaaaacugacuggauaccucuggcgcuaaccauuaagggacugaaccccacggccaucuuccuuacaacccucuccaggacuaauaaaaagcgcucauggccacugaacgaggcaaucauggcugucggcauggugagcauuuuggccaguucucugcucaaaaaugacauaccgaugaccggcccucuaguagccgggggacugcuuacagugugcuauguccugacuggucgguccgcugauuuggaacucgagagagcaaccgacguuaagugggaggaucaggccgaaaucagcggcucgucacccauucugucuaucacgauuagugaggacggguccaugagcaucaagaacgaagaggaggaacagacacuaaccauacugaucaggacuggacuucucgugauuucuggccuguuuccaaucagcauucccaucacagcggcugccugguacuugugggaggugaaaaagcaacgagccggugucuuaugggaugugccuuccccacccccuauggggaaagccgaacuggaggacggagcuuaucgcauaaagcagaaaggcauucucggcuacucacagaucggggcaggaguuuacaaggaagguaccuuccacacuauguggcauguaacacggggcgccgugcugaugcacaaggggaaaagaaucgagccgaguugggcggaugucaagaaagaccuuauuagcuauggaggcgguuggaagcuggagggggaauggaaagagggagaagaggugcagguuuuggcucuagaaccaggcaagaaucccagggccgugcaaaccaagccuggccuguuuaaaacgaacacugggaccaucggagcagucucucucgauuucuccccagguacaucaggcagucccauaauugacaagaaagggaaggugguaggacuguacggcaacggugucgugacccguagcggggccuauguuuccgcuaucgcccagacagagaaaucuauugaggauaauccugaaaucgaggacgauauauuucgcaagcggagacuuacuauuauggacuuacacccgggagcaggcaagaccaaaagguaccugcccgcuaucgugcgagaagccaucaagcggggccuccgcacguugauucuggcgccaacaagagucguggccgcagagauggaagaggcucucagggggcugccuauccgguaucagacucccgccauucgagcugagcauaccggaagagaaauaguugaccuuaugugucacgcaacauucaccaugcgccuguugucgccagugagggucccuaacuacaaucuaaucauuauggaugaggcccauuucacugaccccgccagcaucgcugcgcgugguuauaucucaacccggguggaaaugggcgaggcagccgggauuuuuaugacagcuacgccaccgggauccagagauccuuucccccaaaguaacgccccaauaaucgacgaggaaagggagauucccgaacgcucuuggaauagcggccacgaguggguaacugauuuuaaagguaagaccgugugguucguuccuuccaucaaagcagggaacgacauugccgcuugccugcgaaagaauggaaagaaagucauccagcucucaagaaagacauuugauucugaauacgugaaaacccggacuaacgacugggauuucguggucacaaccgacauaagcgagaugggcgcgaauuuuaaggccgagaggguaaucgauccacgccguuguaugaaacccgugauuuuaacggacggcgaagagagaguuauccuggcagggccuaugccggugacucauaguuccgcugcccagcggaggggacgcauuggucgaaacccaaagaaugaaaacgaccaguacaucuauaugggcgagccccuugaaaaugaugaggacugcgcacacuggaaagaggccaagaugcugcucgauaacauaaauacaccugaagggauuauccccagcauguucgagccagaaagagagaaggucgacgcuauugauggagaauaccgguugaggggcgaggcccgcaaaaccuuuguggaccugaugagaaggggugaucucccuguuuggcuggcguauaagguggcagccgggggcaucaacuacgcugaccggcguugguguuucgauggaaucaaaaacaaucaaauccuugaggaaaacgucgagguggaaauuuggaccaaggagggcgagcgcaaaaagcuaaagccccgauggcuggacgccagaaucuauucugauccauuggcuuuaaaagaauuuaaggaguucgcagccgggaggaaaucacugacucucaaucugauuacagaaaugggacggcuuccuaccuucaugacacagaagacucgcgacgcucuggauaaccucgccguauugcacacggcagaggcggguggcagagccuacaaucaugcucuguccgaacuaccggagacccuggagacacuccuucuguuaacuuugcuggccaccgugacagggggaaucuuucucuuccugaugaguggcagggguauagggaaaaugacccuuggcaugugcugcauuaucacugcaagcauccugcucugguaugcucagauucagccccacuggaucgccgcaucgauaauuuuggaauuuuuccugaucguuuuacuaauuccagagccugaaaagcaacggacgccccaggacaaccagcugaccuacgucgugaucgccauacucacaguggucgcugcgacuauggccaaugagaugggauuucuugaaaagaccaaaaaggaccugggcuuggggucuaucgcaacacagcaaccagaguccaacauucuggauaucgaccuccgaccugcuagcgccuggacccuguacgccguugcaacuacauucgugacgcccaugcuuagacauucaauugagaauaguucuguaaacgugucccucaccgcuaucgccaaucaggcgacuguccugaugggauuggguaaaggcuggccgcugagcaagauggauauuggggugccauuacuagcuaucggauguuauucacagguuaacccuauaacacugaccgccgcacuccuucuguugguggcccacuacgcuauuaucggccccggucugcaggcaaaagccacccgcgaagcgcaaaagagggcugccgcagggaucaugaagaauccaacagucgacggcauuacuguaauagaucucgaccccaucccuuaugauccgaaauuugagaagcagcugggacaggugaugcuuuuaauucugugcguuacgcaagugcucaugaugcggaccacaugggccuugugugaagcucugacucuagccaccggccccaucaguacacugugggaggggaacccaggacguuucuggaauaccacuauugcagucagcauggcuaacaucuuuagaggcuccuaccucgccggugcggggcuucuguucucuauaaugaaaaauacgacaaacaccaggcgcggaacuggcaacaugggugaaaccuugggcgagaaguggaaaagccggcugaaugcccucgggaaguccgaguuucagaucuauaaaaagucaggcauucaggaaguggaccgaacacuggcaaaggagggcaucaaaagaggggaaacugaucaccaugcugucucuaggggaagugccaaguuacgcugguucguggagcggaacaugguuaccccugagggcaaagugguagaccuugguugcgggagaggaggcuggucguacuauugugguggccugaagaaugugcgugaagucaaagggcucacaaagggaggccccgggcacgaggaaccuauuccaaugagcacguacggauggaaccuaguuaggcugcaguccggcguggaugucuuuuucauacccccugagaagugcgacaccuugcugugugauauaggugaaucuucaccaaaucccacuguggaggcagggcggacacuccgcguacuuaaccugguggagaauugguugaacaauaacacccaauucugcauuaaaguucugaauccguacaugccuagcgugaucgaaaagauggaggcucuccagcgaaaauauggaggcgccuuagucagaaacccacuguccaggaauaguacucaugaaauguacugggugucuaacgccagcggcaauaucgucucauccgugaacaugauuagucggaugcuuauaaaccgcuuuacaaugagacacaagaaagcgaccuaugagcccgacguugaccuggggagcggaacgaggaauaucgguauugaaucugagaccccuaaccuagauaucauuggcaagcgaaucgagaagauaaaacaggaacaugagacauccuggcacuacgaccaggaucacccauauaagacuugggcuuaccaugggucauaugaaaccaaacaaacaggaagcgcaucgucuaugguaaauggcgugguccggcuccugacuaagcccugggacguguugccgaccguuacacagauggccaugaccgauacuacgccuuucggucagcagcguguguuuaaagagaaggucgacacaagaacccaagaacccaaggaggggacuaaaaagcugaugaaaaucaccgcugaguggcucuggaaggaacuuggcaaaaagaaaacaccacgcauguguacgagggaggaguucacccggaaggugagaaguaacgccgcacugggcgccauuuuuacugaugagaauaaguggaaauccgcucgcgaggcgguagaagacagcagguucugggaguuaguggauaaggaacgaaaccugcacuuggagggcaaaugcgaaacauguguuuacaauaugauggggaagcgggagaaaaagcucggagaguuugguaaggccaaaggcucaagagcaaucugguacauguggcugggggcuagguuccuagaauuugaggcccuuggauuccugaacgaagaccauugguuuucccgcgaaaauucucucagcggcgucgaaggugaggggcugcacaaguugggauauauucugcgugaugugaguaaaaaggagggcggcgcaauguacgccgacgacaccgcugggugggauacucggaucacacucgaagaccuuaaaaacgaggaaauggugaccaaucacauggagggagaacauaagaagcuggccgaggcgauuuucaaauuaacauaucagaacaaggucguuagagugcagaggccuacuccccgcgguaccguaauggauauaaucucccgacgggaccaaagaggcagcggacaggugggaacguacggccugaauaccuuuacaaacauggaggcacaguugauuaggcagauggaaggugagggggucuucaaaaauauccaacaccucacugugaccgaagagguugccgugcagaacuggcuggcucgcgucggaagagagcggcuaucuaggauggccaucucaggcgaugacugcgugguaaagccacuugaugaccguuucgcaaacgcucugacagcccucaaugauaugggcaaaauucgaaaggacauacagcagugggaacccaguaagggguggaacgauuggacucaaguuccuuuuugcucccaucacuuccaugagcugaucaugaaagacggacgcguguuggucgugccauguagaaaucaggaugaauuaauuggucgggcuaggaucagccagggcgccggguggucucugcgcgagaccgcaugccucggaaagucguaugcgcagauguggucacuuauguacuuucacagacgggaccugaggcuagccgcuaacgccauuuguagcgcagugccgucccacuggguccccacgagucgaacaaccuggucuauccaugcuaaacacgaauggaugacuacagaggacaugcugaccguuuggaaucguguguggauaagagagaacccuuggauggaagauaagacuccaguagagagcugggaagagauccccuaucucggcaaacgcgaagaccaauggugcgguuccuugauugggcugaccucacgggccacaugggcaaagaauauccagguggccauuaaccaggucaggagucuuaucggaaaugaggaguacacggauuacaugccuucuaugaagagauuccgccgggaagaggaagaggcgggcgugcugugguga

SEQ ID NO: 14793 - RNA, 9876 nt, Artificial Sequence
  derived and/or modified CDS sequence (opt3) from DENV-2__FJ410193__SS-prME
agcgcaggcaugaucauuaugcugauccccaccgugauggcuuuccaccucaccacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuuaucugcaagcauagcaugguggaucgaggcugggguaauggguguggacuauucggcaaaggcgggauugucacuugcgcaauguuuaccugcaagaaaaacauggaaggaaagauagugcagccugagaaucucgaauacacaaucguggucaccccacacuccggugaggagcaugccguuggcaacgacacugggaaacacggaaaggaaauuaaagugacgccgcagucaaguaucacagaggcugaacugaccggcuaugguacuguaaccauggaguguagccccagaacagggcuugauuucaaugaaauggugcuguugcaaauggagaacaaggccuggcucguccacaggcagugguuucuggacuuaccucugccauggcuccccggcgcagauaagcaggagucuaauuggauacagaaagaaacccuugugacuuucaagaacccucaugcuaaaaagcaagacguugugguccugggaucccaggagggcgccaugcacacagcguugacgggggccaccgaaauucagaugucaagcggaaaucuacuguuuacuggucaucucaaaugccggcugcguauggacaaacuucaacugaagggcaugaguuacucuauguguacagggaaauucaaggugguaaaagagaucgcagagacccagcacggaacaaucguuauucgcgugcaguaugaaggcgaugguuccccaugcaagauccccuucgagauuauggacuuggagaagagauacguccucgggaggcugauaacugugaacccgaucgucaccgagaaggauagcccugugaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacaaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggcccaggaagagggcauuugugguaucagaucugugacuaggcucgagaaucugauguggaaacagauuacacccgaauuaaaccacauccuggcagagaaugaagucaagcuaaccauaaugacuggcgauaucaaagggauuaugcaagccggaaagcggucgcuccgcccucagccaaccgagcugaaguacagcuggaaaacauggggcaaggcuaaaaugcuuuccacggaaucauauaaccagaccuucuugaucgacgggccggagacugccgagugccccaauacaaacagagcauggaauagucuggaaguugaggauuacggauuuggcguguucaccacaaacauuuggcucaagcugaaagaaaagcaggacgcguuuugugacucuaaguuaaugagcgcugccaucaaagauaauagggcagugcaugccgacauggguuauuggauagaguccgcucugaacgauacuuggaagauugagaaagccucauucaucgaaguaaagaauugccacuggccuaaaagccauacccuuuggucuaacggggucuuggaguccgaaaugaucauuccaaagaaccucgcaggacccgugagucaacacaauuaccguccuggcuaccacacgcagaucgcugguccauggcaucugggcaagcuagagauggacuucgauuuuugugacgggacaaccguuauugugacugaagauugcggaaaccggggccccagccugcgaaccacaacugccucugggaaacucauaaccgaguggugcuguagauccugcacacugccgccucuuagguaucgcggagaggacggcuguugguacgguauggaaauccggccauugaaggagaaagaagagaaucuggucaacucauuagugacggcggggcacggacagguugauaauuucagucucggcgugcuggguauggcccuuuuucuggaagagauguugagaaccaggguaggcacuaagcaugcuauucuccuggucgcagugagcuucgugacacuaaucaccgggaacaugucguuuaaagaccugggacgcgucguugugaugguaggcgccacuauggcugaugacauugggaugggagugacauaucucgcccugcuugcagcguucaagguccgacccaccuuugccgcuggcuugcuguuacggaagcucacguccaaagagcugaugaugacuaccaucgguauagugcuucugucucaaagcacaaucccugaaaccguucuagagcucacugaugcccuggcauuggggaugauggugcugaagauuguccguaauauggaaaaauaccaguuagcugugacaaucauggccauucucugcguucccaacgcagugauccugcagaaugccuggaaggucucauguaccauacuugcuguagugaguguuuccccacuguugcucacaucuagccagcagaagacugacuggauuccucuggcgcuaaccaucaagggacugaaccccacggccaucuuccuuacaacccucuccagaacuaauaaaaagaggucauggccacugaacgaggcaauuauggcugugggcauggucagcauauuggccaguucucuguuaaagaaugacaucccgaugaccggcccucucguggccgggggacugcuuacaguaugcuaugugcugacuggucgcuccgcugauuuggaacucgagcgggcaaccgacgucaaaugggaggaucaggccgaaauuagcggcucgucacccauccugucuauuacgaucagugaggacggguccaugagcauaaagaacgaagaggaggaacagacacuaaccauccugauuagaacuggacuucucguuaucucuggccuguuuccaauuagcauccccauaacagcggcugccugguacuugugggaggugaaaaagcagagggccgguguguuaugggaugucccuuccccacccccuauggggaaagccgaacuggaggacggagcuuaucgaauuaagcaaaagggcauccucggcuacucacagaucggggcaggaguguacaaagaagguaccuuccacacuauguggcauguuacacgcggcgccguacugaugcacaaggggaaacggauugagccgaguugggcggaugugaagaaagaccuuaucagcuauggaggcgguuggaagcuggagggggaauggaaggagggagaagagguccagguguuggcucuagaaccaggcaaaaaucccagagccguucagaccaagccuggccuguuuaaaacgaacacugggaccauaggagcagugucucucgauuucuccccagguacaucaggcagucccauuaucgacaagaaagggaaggucgugggacuguacggcaacgguguagucaccaggagcggggccuauguguccgcuauugcccaaacagagaagucuaucgaggauaauccugaaauagaggacgauauuuuucguaaacgccggcuuacuaucauggacuuacacccgggagcaggcaagaccaaaagauaccugcccgcuaucguuagggaagccauuaagcgaggccuccggacguugauccuggcgccaacacgcguggucgccgcagagauggaagaggcucucagagggcugccuauuagguaucagacucccgccauacgggcugagcauaccggacgagaaaucguggaccuuaugugucacgcaacauucaccaugagacuguugucgccaguucgcgugccuaacuacaaucuaauuaucauggaugaggcccauuucacugaccccgccagcaucgcugcgagggguuauauuucaacccgugucgaaaugggcgaggcagccgggauauuuaugacagcuacgccaccgggaucccgggauccuuucccccagaguaacgccccaaucauugacgaggaaagagagauccccgaaaggucuuggaauagcggccacgagugggugacugauuuuaaagguaagaccguaugguucgugccuuccauuaaggcagggaacgacaucgccgcuugccugcgcaaaaauggaaagaaaguuauacaacucucacgaaagacauuugauucugaauacgucaaaaccagaacuaacgacugggauuucguggugacaaccgacaucagcgagaugggcgcgaauuuuaaggccgagcgggucauugauccaaggcgcuguaugaaacccguaaucuuaacggacggcgaagaacgugugauucuggcagggccuaugccgguuacucauaguuccgcugcccagagacggggaaggaucggucgcaacccaaagaaugaaaacgaccaguacauauauaugggcgagccccuugaaaaugaugaggacugcgcacacuggaaggaggccaaaaugcugcucgauaacauuaauacaccugaagggaucauucccagcauguucgagccagaacgagagaagguggacgcuaucgauggagaauacagauugcggggcgaggccaggaaaaccuuugucgaccugaugcgcagaggugaucucccuguguggcuggcguauaagguugcagccgaggggauaaacuacgcugacaggcggugguguuucgauggcaucaaaaacaaucagauucuugaagagaacguggaagucgagaucuggaccaaggagggagaacguaagaaacuaaagccccgcuggcuggacgcccgaauuuauucugauccauuggcuuuaaaagaguuuaaggaguucgcagccggcagaaaaucacugacucucaaucugaucacagagauggggaggcuuccuaccuucaugacacaaaagacucgggacgcucuggauaaccucgccguguugcacacggcagaagcgggaggucgcgccuacaaucaugcucuguccgagcuaccggagacccuggaaacacuccuucuguuaacuuugcuggccaccguaacaggcgggauauuucucuuccugaugaguggaagaggcauugguaagaugacccuugggaugugcugcaucacuacggcaagcauccugcucugguaugcucagauucagccccacuggaucgccgcaucgauaauuuuggaguuuuuccugaucguguuacuaauuccagaaccugagaaacagaggacaccccaagacaaccagcugacauacguugucaucgccauacucacugugguggcugcgaccauggccaaugaaaugggcuuucuugagaagacuaaaaaggaccugggauugggcucuaucgcaacccagcagccagaguccaacauucuggauaucgaccuccggccugcuagcgccuggacucuguacgccgucgcaacaacguucguuacccccaugcuucgacauucaauugaaaauaguucugugaacguaucccucacugcuaucgccaaucaagcgacagugcugaugggguugggaaaagguuggccgcugagcaagauggauauuggcgucccauuacuagcuaucggguguuauucacaggugaacccuauaacccugaccgccgcacuccuucuguugguugcccacuacgcuauuaucggacccggccugcaggcaaaggccacaagagaggcgcagaaacgcgcugccgcagguaucaugaagaauccaacuguggacgggauuacggucauagaucucgaccccaucccuuaugauccgaaauuugaaaagcaacugggccagguaaugcuuuuaauucugugcgugacccagguucucaugaugaggacaacuugggccuugugugaggcucugacccuagccacaggacccaucaguacccugugggaaggcaacccagggcgguucuggaauacuacgauugcagugagcauggcuaacaucuuucguggauccuaccucgccggcgcgggucuucuguucucuauaaugaaaaauacaaccaacacuagaagggggaccggaaacaugggcgagacauugggugagaaguggaaaagccgccugaaugcccucggcaaguccgaauuucaaaucuauaagcggucagggauucaggaggucgaccgaacucuggcaaaagaaggaaucaagagaggcgagaccgaucaccaugcugugucuagggggagugccaaauuacgcugguucgucgagcggaacauggugacaccugaaggaaagguuguggaccuuggcugcgguagagggggauggucguacuauuguggcggucugaaaaauguacgugaggugaagggccucacgaaagggggacccggccacgaagaaccuauuccaaugagcaccuacggguggaaccuagucaggcugcaguccggaguugauguguuuuucauacccccugaaaaaugcgacacuuugcugugugauauaggcgagucuucaccaaaucccacagucgaggcaggucggacccuccgcgugcuuaaccugguagaaaauugguugaacaauaacacucaguucugcauuaaggugcugaauccguacaugccuagcguuaucgagaaaauggaagcucuccaacgaaaguaugggggagccuuagugagaaacccacuguccaggaauaguacacaugagauguacugggucucuaacgccagcggcaauaucgugucauccgucaacaugauuagucggaugcuuauaaaccgcuuuaccaugagacacaaaaaggcgacguaugaacccgacguggaccugggcagcgggaccaggaauaucggaauugagucugagaucccuaaccuagauauuaucgguaagcgaauagagaaaaucaagcaggagcaugaaacauccuggcacuacgaccaggaucacccauauaaaacuugggcuuaccauggcucauaugagaccaagcagacagggagcgcaucgucuaugguuaauggaguagugcggcuccugacuaaacccugggacgucuugccgaccgugacacaaauggccaugaccgauacuacgccuuucggccagcagcguguuuuuaaggaaaagguggacacaagaacccaggagcccaaagaggguacuaagaaacugaugaagauuaccgcugaauggcucuggaaagagcuugggaagaaaaagacaccacgcauguguacgagggaagaguucacccggaaggucagaaguaacgccgcacugggagccaucuuuacugaugagaauaaauggaaguccgcucgcgaagcgguggaggacagcagguucugggaauuaguagauaaagagcgaaaccugcacuuggaaggcaagugcgagacauguguguacaauaugaugggcaaacgggagaagaagcucggggaauuuggaaaagccaaggguucaagagcaauuugguacauguggcugggcgcuagguuccuagaguuugaagcccuuggguuccugaacgaggaccauugguuuucccgcgaaaauucucucagcggaguugagggcgagggucugcacaaauugggguauauccugcgugaugucaguaagaaagaaggaggcgcaauguacgccgacgacaccgcuggcugggauacucggauuacacucgaggaccuuaagaacgaagagauggugaccaaucacauggaaggggagcauaagaaacuggccgaggcgauauucaaguuaacauaucaaaacaaaguggucagaguucagaggccugcaccccgcggaacugugauggauaucauuucccgacgggaccagagagguagcggccaaguagggaccuacggacugaauacguuuaccaacauggaagcccaguugaucaggcagauggagggcgaagguguguucaagaauauccagcaccucacagucacugaggagguggcuguucaaaacuggcuggcccgcguggggagagaacggcuaucuaggauggcaauuucaggagaugacugcgucgugaaaccacuugaugaccguuucgcuaacgcccugaccgcucucaaugauaugggcaagauacgaaaggacauccagcagugggagcccaguaaaggcuggaacgauuggacacagguaccuuuuugcucccaucacuuccaugaacugauuaugaaggacgggcgcguuuugguggucccauguagaaaucaagaugaguuaaucggacgggccaggauuagccagggugcaggcuggucucugcgcgaaacugcgugccucgggaaaucguaugcccagauguggucacuuauguacuuucacagacgggaccugaggcuagcugccaacgcaaucuguagcgcugugccgucccacugggugcccaccagucgaacgacauggucuauacaugccaagcacgaguggaugaccacugaggacaugcugacagucuggaaucguguuuggaucagagaaaacccuuggauggaggauaaaaccccaguggaaagcugggaggaaauucccuaucucggaaagcgcgaggaccaguggugcggcuccuugaucggucugacuucacgggcaaccugggccaagaauauucaagcggcuaucaaccagguaaggagucuuauagggaaugaggaauacacagauuacaugccuucuaugaaaagauuccgccgggaggaagaggaagccggagugcugugguga

SEQ ID NO: 14794 - RNA, 9876 nt, Artificial Sequence
  derived and/or modified CDS sequence (opt3) from DENV-2__FJ410195__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaagcuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggaaaaaagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacuaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaaucgugggcgccacuauggcugaugacauugggaugggagucacauaucucgcccugcuugcagcguucaaggugcgacccaccuuugccgcuggcuugcuguuacggaagcucacguccaaagagcugaugaugacuaccaucgguauaguucuucugucucaaagcacaaucccugaaaccgugcuagagcucacugaugcccuggcauuggggaugaugguccugaagauugugcguaauauggaaaaauaccaguuagcuguuacaaucaugaccauucucugcgugcccaacgccgucauccugcagaaugcauggaagguaucauguacaauacuugccgugguuaguguguccccacuguugcucacuucuagcagacagaaaaccgacuggauuccucuggcucuaacgaucaagggacugaaccccacagcgaucuuccuuaccacucucuccaggaccaauaaaaagcgcucauggccacugaacgaggccauuauggcagucggcauggugagcauauuggcuaguucucuguuaaagaaugacaucccgaugacaggcccucucguagccgggggacugcuuacugugugcuauguccugaccggucgguccgccgauuuggaacucgagagagcuacggacguuaaaugggaggaucaagcagaaauuagcggcucgucacccauccugucuauuacaaucagugaggacggguccaugagcauaaagaacgaagaggaggaacagacccuaacuauccugauuaggacaggacuucucgugaucucuggccuguugccaauuagcauccccauaaccgccgcggcuugguacuuaugggaggugaaaaagcagcgagccgguguccugugggaugugccuuccccacccccuauggggaaagcagaacucgaggacggagccuaucgcauuaagcagaagggcauccugggcuacucacaaaucggggcuggaguuuacaaagaagguacuuuucacacaauguggcauguaacccggggcgcagugcuuaugcacaaggggaaaagaauugagccgaguugggccgaugucaagaaagaccugaucagcuauggaggcgguuggaaguuggagggggaauggaaggagggagaagaggugcagguucuagcgcuggaaccaggcaaaaaucccagggcugugcagacgaagccuggccucuucaaaacuaacaccgggacaauaggagccgucucucuggauuuuuccccagguaccucaggcagucccauuaucgacaagaaagggaaggugguaggacuuuacggcaacggugucgugacacguagcggggcauauguuuccgccauugcucagacugagaagucuaucgaggauaauccugaaauagaggacgauauuuuccgcaaacggagauuaaccaucauggaccugcacccgggagccggcaagacgaaaagguaccuccccgcaaucgugcgagaagcuauuaagcggggcuugcgcacacugauccucgccccaacuagagucguggcggccgagauggaagaggcacugagggggcuuccuauucgguaucaaacccccgcuauacgagccgagcauacaggaagagaaaucguugaccugaugugucacgcuaccuuuacuaugcgcuugcuaucgccagugagggucccuaacuacaaucugauuaucauggaugaggcacauuucaccgaccccgccagcaucgccgcucgugguuauauuucaacacggguggaaaugggcgaggcggcagggauauucaugacggccacuccaccgggauccagagauccuuuuccccagaguaacgcuccaaucauugacgaggaaagggagauccccgaacgcucuuggaauagcggccacgaguggguaaccgauuucaaagguaagacagugugguuuguuccuuccauuaaggccgggaacgacaucgcagccugccuccgaaaaaauggaaagaaagucauacaguuaucaagaaagaccuucgauucugaauacgugaaaacucggacaaacgacugggauuuuguggucaccacggacaucagcgagaugggcgcuaauuucaaggcggagaggguaauugauccacgccguuguaugaaacccgugauccugacugacggcgaagagagaguuauucuugccgggccuaugccggugacacauaguuccgcagcucaacggaggggacgcaucggucgaaacccaaagaaugaaaacgaccaguacauauauaugggcgagccccuggaaaaugaugaggacugcgcccacuggaaggaggcaaaaaugcucuuggauaacauuaauaccccugaagggaucauucccagcauguuugagccagaaagagagaaggucgacgccaucgauggagaauaccggcugaggggcgaggcucgcaaaaccuucguggaccucaugagaaggggugaucugccuguuuggcuugccuauaagguggcggcagaggggauaaacuacgccgaccggcguugguguuuugauggcaucaaaaacaaucagauucuagaagagaacgucgaaguggagaucuggacuaaggagggagaacgcaagaaacugaagccccgaugguuggacgcuagaauuuauucugauccauuagcccugaaagaguucaaggaauuugcugcaggcaggaaaucacucacacugaaucuuaucaccgagauggggcggcugccuacauucaugacucagaagacgcgcgacgcccucgauaacuuggcuguacugcacaccgccgaagcaggagguagagcguacaaucaugcccuauccgagcugccggagacacucgaaacucuucuguuauugacccugcucgcuacagugaccggcgggauauuccuguuucuuaugaguggaaggggcauugguaagaugacucuggggaugugcugcaucaucacggccagcauucucuugugguaugcacaaauccagccccacuggauagcugccucgauuauccuggaguucuuuuuaauuguucuacugaucccagaaccugagaaacagcggaccccccaggacaaccaacucacauacgucgugauagcaauccuuacuguggucgccgcuaccauggcgaaugaaaugggcuuccuggagaagacaaaaaaggacuugggacugggcucuauugccacccagcagccagaguccaacauccucgauauugaccugcgaccugcaagcgcuuggacucuuuacgccguugccacaacguuugugacccccaugcucagacauucaaucgaaaauaguucuguaaacgugucccugacugcaauugcuaaucaggccacagucuugauggggcugggaaaagguuggccguuaagcaagauggauaucggcgugccacuacuggcgauaggguguuauucacaaguuaacccuauuacccucaccgcugcccuucuguugcugguggcacacuacgccaucaucggacccggccuccaggcuaaggcaacacgcgaggcccagaaaagggcggcugccgguauuaugaagaauccaacugucgacgggauaacgguaaucgaucuggaccccauuccuuaugauccgaaauucgaaaagcagcuuggccaagugauguuacugauccucugcguuacccagguguugaugaugcggacaacuugggcacugugugaggcccuaacccuggcuacaggacccauuaguacccucugggaaggcaacccagggcguuuuuggaauacuacgaucgccgucagcauggcaaacauauucagaggauccuaccuugcuggcgccggucuguuguuuucuaucaugaaaaauacaaccaacacuaggcgcgggaccggaaacaugggcgagacacugggugagaaguggaaaagccggcucaaugcgcugggcaagaacgaauuccagauuuauaagaaauccgggauccaagagguggaccgaacuuuagccaaggaaggaauuaaaagaggcgagaccgaucaccaugcagucucaagggggucugcuaagcuucgcugguuuguggagcggaauaugguuacaccugaaggaaaagugguagaccugggcugcgguagagggggauggaguuacuauuguggcggucucaagaacgugcgugaggucaagggccuaacgaaagggggacccggccacgaagagccuaucccaaugucgaccuacggguggaaucugguuagguugcagagcggaguggaugucuucuuuauacccccugaaaagugcgacacucugcucugugauauuggcgaguccucuccaaaccccacaguggaggccggucggacccuucgcguacugaauuugguggaaaacuggcugaauaacaauacucaguucugcaucaaaguucucaacccguacaugccuucagugaucgagaagauggaagcauuacagcgaaaauaugggggagcucuggucagaaauccacuuagcaggaacuccacacaugagauguacugggugaguaaugccucuggcaacauugucagcucagugaacaugauaucccggaugcugaucaaucgcuucaccaugagacacaagaaggccacguaugaacccgacguugaccuaggcagugggaccaggaacauuggaaucgagagcgagauuccuaaucucgauaucauagguaaacgaaucgaaaagauuaaacaagagcaugaaacaucuuggcacuacgaccaggaucacccauauaagacuugggcguaccauggcuccuaugagaccaaacagacagggucagcuagcucgaugguaaacggagugguccggcuguugacuaagcccugggacgugcugccgaccguuacacagauggcaaugaccgauacuacgccuuuuggccaacagcguguguucaaggaaaaagucgacacaagaacccaggagcccaaggaggguacuaaaaagcucaugaaaaucaccgccgaauggcuuuggaaggagcuggggaaaaagaagacaccacgcauguguacgagggaagaguuuacccggaaagugagaucuaaugcugccuuaggagcaauuuucacugaugagaacaaguggaaaagugcccgcgaagcuguagaggacuccagguuuugggaacugguggauaaggagcgaaauuugcaccucgaaggcaaaugcgagacauguguuuacaacaugaugggcaagcgggagaagaaacugggggaauucggaaaggcgaaagguagcagagccaucugguacauguggcuaggcgcaagguuucuugaguucgaagcucugggguuucucaaugaggaccauugguucucacgcgaaaacucccugucuggagucgagggcgaggguuugcacaagcugggguauauucuccgugaugugagcaaaaaggaaggaggcgccauguacgcagacgacaccgccggcugggauacucggauaacacuugaggaccugaagaaugaagagauggugaccaaccacauggaaggggagcauaaaaaguuagcugaggccaucuuuaaacugacauaucagaauaaggucguuagagugcaaaggccuacuccccgcggaaccguaauggauauuaucagucgacgggaccagagagguuccggccagguggggacguacggauugaacaccuucacaaauauggaagcgcaacucaucaggcagauggagggcgaaggugucuuuaaaaacauucagcaccugacugugaccgaggagguugcagugcagaacuggcuagcccgcgucgggagagaacggcuuagcaggauggcuauaucuggagaugacugcgugguaaagccacuggaugaccguuucgccaaugcacucacagcucugaacgauaugggcaagauccgaaaagacauucaacagugggagcccucaaagggcuggaaugauuggacucagguuccuuucugcagucaucacuuucaugaauugaucaugaaagacgggcgcguguuagucgugccauguagaaaccaggaugagcugauuggacgggccaggaucucccaaggugcuggcuggagccuccgcgaaaccgccugccuugggaagucuuaugcacagauguggucgcugauguacuuccacagacgggaccuaaggcuggcggccaaugcuauauguucagccgugccgagccacuggguccccacgucccgaacaaccuggaguauccaugcaaaacacgaguggaugacuacagaggacaugcucaccguuuggaaccguguguggauuagagaaaauccuuggauggaggauaagacuccaguagaaucuugggaggaaauccccuauuugggaaagcgcgaggaccaguggugcggcagccugauuggucuuaccucccgggcuacaugggccaaaaacauccaggcagccauaaaucaagugaggucacugauugggaacgaggaauacacggauuacaugccuaguaugaagagauuucgccgggaggaagaggaagcgggaguccucugguga

SEQ ID NO: 14795 - RNA, 9876 nt, Artificial Sequence
  derived and/or modified CDS sequence (opt3) from DENV-2__FJ432726__SS-prME
agcgccggcaugauaauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccauuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauacgggggaucaugcaagccggaaagcgcucgcucagaccucagccaaccgagcugaaauacagcuggaagacauggggcaaggcuaaaaugcuuuccacggaaucauauaaccagaccuucuugauugacgggccggagacugccgagugccccaauacaaacagggcauggaauagucuggaaguggaggauuacggauuuggcguguucaccacaaacaucuggcucaagcugaaagaaaagcaggacgcguuuugugacucuaaauuaaugagcgcugccauuaaggauaaucgugcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccgcuagucaacacaauuaccggccuggcuaccacacgcagauugccgguccauggcaucugggcaaacuagagauggacuucgauuuuugugacgggacaaccguuaucgugacugaagauugcggaaaccgaggccccagccugagaaccacaacugcgucugggaagcucauuaccgaguggugcuguagguccugcacacugccgccucuucgcuaucggggagaggacggcuguugguacgguauggaaauaagaccauugaaggagaaagaagagaaucuggucaacucauuagugacggccgggcacggacagguugauaauuucagucucggcgugcuggguauggcucuuuuucuggaagagauguugaggacccgcguaggcacuaagcaugcaauccuccuggucgccgugagcuucgugacacuaauuaccgggaacaugucguuuaaagaccugggacgagucguugugaugguaggcgcuacuauggccgaugacaucgggaugggagugacauaucucgcacugcuugcggccuucaagguccggcccaccuuugcugccggcuugcuguuacguaaacucacguccaaggagcugaugaugacuaccauugguaucgugcuucugucucaaagcacaauaccugaaaccguucuagagcucacugaugcacuggcuuuggggaugauggugcugaagaucgucagaaauauggaaaaauaccaguuagccgugacaauuauggcaauccucugcguucccaacgccgugauucugcagaaugcuuggaaggucucauguaccauccuugcgguagugaguguuuccccacuguugcucacaucuagccagcagaagacugacuggauaccucuggcccuaaccauuaagggacugaaccccacggcaaucuuccuuacaacccucuccaggacuaauaaaaagcgcucauggccacugaacgaggcuaucauggccgugggcauggucagcauuuuggccaguucucugcucaaaaaugacauaccgaugaccggcccucuaguggcugggggacugcuuacaguaugcuaugugcugacuggucgguccgcagauuuggaacucgagagagccaccgacgucaagugggaggaucaggcggaaaucagcggcucgucacccauucugucuaucacgauuagugaggacggguccaugagcaucaagaacgaagaggaggaacagacacuaaccauacugaucaggacuggacuucucguuauuucuggccuguuuccaaucagcauucccaucacagcugccgcaugguacuugugggaggugaaaaagcagcgagccgguguguuaugggaugucccuuccccacccccuauggggaaagcugaacuggaggacggagcauaucgcauaaagcaaaaaggcauucucggcuacucacagaucggggccggaguguacaaggaagguaccuuccacacuauguggcauguuacacggggcgcgguacugaugcacaaggggaaaagaaucgagccgaguugggcugaugugaagaaagaccuuauuagcuauggaggcgguuggaagcuggagggggaauggaaagagggagaagagguccagguguuggcccuagaaccaggcaagaaucccagggcaguucagaccaagccuggccuguuuaaaacgaacacugggaccaucggagccgugucucucgauuucuccccagguacaucaggcagucccauaauugacaagaaagggaaggucgugggacuguacggcaacgguguagucacccguagcggggcuuauguguccgccaucgcacaaacagagaaaucuauugaggauaauccugaaaucgaggacgauauauuucgcaagcggagacuuacuauuauggacuuacacccgggagcuggcaagaccaaaagguaccugcccgccaucguucgagaagcgaucaagcggggccuccgcacguugauucuggccccaacaagaguggucgcagcugagauggaagaggcccucagggggcugccuauccgguaucagacucccgcuauucgagcagagcauaccggaagagaaauaguggaccuuaugugucacgccacauucaccaugcgccuguugucgccaguuagggugccuaacuacaaucuaaucauuauggaugaggcccauuucacugaccccgcuagcaucgcggcacgugguuauaucucaacccgggucgaaaugggcgaggccgcugggauuuuuaugacagccacgccaccgggauccagagauccuuucccccagaguaacgcaccaauaaucgacgaggaaagggagauucccgaacgcucuuggaauagcggccacgagugggugacugauuuuaaagguaagaccguaugguucgugccuuccaucaaagccgggaacgacauugcugcgugccugcgaaagaauggaaagaaaguuauccaacucucaagaaagacauuugauucugaauacgucaaaacccggacuaacgacugggauuucguggugacaaccgacauaagcgagaugggcgccaauuuuaaggcagagagggucaucgauccacgccguuguaugaaacccguaauuuuaacggacggcgaagagagagugauccuggcugggccuaugccgguuacucauaguuccgccgcacagcggaggggacgcauuggucgaaacccaaagaaugaaaacgaccaguacaucuauaugggcgagccccuugaaaaugaugaggacugcgcccacuggaaagaggcuaagaugcugcucgauaacauaaauacaccugaagggauuauccccagcauguucgagccagaaagagagaagguggacgccauugauggagaauaccgguugaggggcgaggcgcgcaaaaccuuugucgaccugaugagaaggggugaucucccuguguggcuggcauauaagguugccgcugaggggaucaacuacgccgaccggcguugguguuucgauggcaucaaaaacaaucagauccuugaagagaacguggaagucgagauuuggaccaaggagggagaacgcaaaaagcuaaagccccgauggcuggacgcuagaaucuauucugauccauuggcauuaaaagaguuuaaggaguucgccgcuggcaggaaaucacugacucucaaucugauuacagagauggggcggcuuccuaccuucaugacacaaaagacucgcgacgcccuggauaaccucgcaguguugcacacggcggaagccggagguagagcuuacaaucaugcccuguccgagcuaccggagacccuggaaacacuccuucuguuaacuuugcuggcaaccguaacaggcgggaucuuucucuuccugaugaguggaaggggcauagguaaaaugacccuugggaugugcugcauuaucacugcuagcauccugcucugguaugcccagauucagccccacuggaucgcagccucgauaauuuuggaguuuuuccugaucguguuacuaauuccagaaccugagaagcagcggacgccccaagacaaccagcugaccuacguugucaucgcuauacucacagugguggcggccacuauggcaaaugaaaugggcuuucuugagaagaccaaaaaggaccugggauugggcucuaucgcuacacagcagccagaguccaacauucuggauaucgaccuccgaccugccagcgccuggacccuguacgcagucgcuacuacauucguuacgcccaugcuuagacauucaauugaaaauaguucugugaacguaucccucaccgccaucgcgaaucaagcuacugugcugaugggguugggaaaagguuggccgcugagcaagauggauauuggcgucccauuacuagccaucggguguuauucacaggugaacccuauaacacugaccgcagcccuccuucuguugguugcucacuacgcaauuaucggacccggccugcaggccaaagcgacccgcgaggcucagaagagggccgcagccgguaucaugaagaauccaacaguggacgggauuacugucauagaucucgaccccaucccuuaugauccgaaauuugaaaagcaacugggccagguaaugcuuuuaauucugugcgugacgcagguucucaugaugcggaccacaugggcuuugugugaggcccugacucuagcaaccggacccaucaguacacugugggaaggcaacccagggcguuucuggaauaccacuauugcugugagcauggccaacaucuuuagaggauccuaccucgcgggcgccggucuucuguucucuauaaugaaaaauacgacaaacaccaggcgcgggacuggaaacaucggcgagaccuugggugagaaguggaaaagccggcugaaugcacucggcaaguccgaauuucaaauuuauaaaaagucagggauccaggaggucgaccgaacacuggcuaaggaaggaauuaaaagaggcgagacugaucaccaugccgugucuagggggagugcaaaguuacgcugguucgucgagcggaacauggugaccccugaaggaaaaguuguggaccuuggcugcgguagagggggauggucguacuauuguggcggucugaagaauguacgugaggugaaaggccucacaaaagggggacccggccacgaggaaccuaucccaaugagcacguacggguggaaccuagucaggcugcaguccggaguugauguguuuuucauacccccugaaaagugcgacaccuugcugugugauauuggcgagucuucaccaaaucccacugucgaggcuggucggacacuccgcgugcuuaaccugguagaaaauugguugaacaauaacacccaguucugcaucaaagugcugaauccguacaugccuagcguuaucgagaagauggaagcccuccaacgaaaauaugggggagccuuagugagaaacccacuguccaggaauaguacucaugagauguacugggucucuaacgcgagcggcaauauugugucauccgucaacaugauaagucggaugcuuaucaaccgcuuuacaaugagacacaagaaagcuaccuaugaacccgacguggaccugggcagcgggacgaggaauauuggaaucgagucugagauuccuaaccuagauaucauagguaagcgaaucgaaaagauuaaacaggagcaugaaaccuccuggcacuacgaccaggaucacccauauaagacaugggcauaccauggcucauaugagacuaaacagaccgggagcgccucgucuaugguuaauggaguagugcggcuccugacaaagcccugggacgucuugccgacugugacccaaauggcuaugacagauaccacuccuuucggccagcagcguguuuuuaaagaaaagguggacacgagaacacaggagcccaaggaggguaccaaaaagcugaugaaaaucacugccgaauggcucuggaaggagcuugggaaaaagaaaaccccacgcauguguacaagggaagaguucacgcggaaggucagaaguaacgcagcccugggagcuauuuuuaccgaugagaauaaguggaaauccgcgcgcgaagccguggaggacagcagguucugggaauuaguagauaaggagcgaaaccugcacuuggaaggcaaaugcgagacuuguguguacaauaugaugggcaagcgggagaaaaagcucggggaauuuggaaaggcaaaagguucaagagcuaucugguacauguggcugggcgccagguuccuagaguuugaagcacuuggguuccugaacgaggaccauugguuuucccgcgaaaauucucucagcggaguugagggcgagggucugcacaaguugggguauauucugcgugaugucaguaaaaaggaaggaggcgccauguacgcugacgacacagccggcugggauacccggauaacucucgaggaccuuaaaaacgaagagauggugacaaaucacauggaaggggagcauaagaagcuggcggaggcaaucuucaaauuaaccuaucaaaacaagguggucagaguucagaggccuacaccccgcggaacugugauggauauuaucucccgacgggaccagagagguagcggccaaguagggaccuacggacugaauacguuuaccaacauggaagcccaguugaucaggcagauggagggcgaagguguguucaaaaauauucagcaccucacagucacugaggagguggcuguucauaacuggcuggcccgcguggggagagaacggcuaucuaggauggcaauaucaggagaugacugcgucgugaagccacuugaugaccguuucgcuaacgcccugaccgcucucaaugauaugggcaaaauccgaaaggacauucaacagugggagcccaguaagggcuggaacgauuggacacagguaccuuuuugcucccaccauuuccacgaacugaucaugaaagacgggcgcauuuugguugugccauguagaaaucaggaugaguuaaucggacgggccaggauaagccaaggugcaggcuggucucugcgcgaaacugcgugccucgggaagucguaugcccagauguggucacuuauguacuuucacagacgggaccugaggcuagcugccaacgcaaucuguagcgcugucccgucccauugggugcccaccagucgaacgacauggucuauucacgccaaacaugaguggaugaccacugaggacaugcugacaguguggaaucgugucuggaucagagaaaacccuuggauggaggauaagaccccaguugaaagcugggaggaaauucccuaucucggaaaacgcgaggaccaguggugcggcuccuugaucggucugacuucacgggcaaccugggccaagaauauacaggcggcuauuaaccaagugaggagucuuaucgggaaugaggaauacacagauuacaugccuucuaugaagagauuccgccgggaggaagaggaagccggaguacugugguga

SEQ ID NO: 14796 - RNA, 9876 nt, Artificial Sequence
  derived and/or modified CDS sequence (opt3) from DENV-2__JF730049__SS-prME
agcgccggaaugaucauuaugcugauacccaccgugauggcuuuccaccucacuacucggaacggggaaccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugugguaggcaacgacacugggaaacacggacaggaaaucaaggugacgccgcaaucaaguauuacagaggccgaacugaccggcuaugguacugucaccauggaguguagccccagaacagggcuugauuucaaugaaauggugcuguugcagauggagaacaaggcuuggcucguucacaggcagugguuucuggacuuaccucugccauggcuccccggcgccgauaagcaggagucuaauuggauccaaaaggaaacccuugugacuuucaaaaacccucaugcaaagaaacaggacgucgugguacugggaucccaggagggcgcuaugcacacagccuugacgggggcgaccgaaauacaaaugucaagcggaaaucuacuguuuacuggucaucucaagugccggcugcguauggacaaacuucagcugaagggcaugaguuacucuauguguacagggaaguucaaaguugugaaggagauugccgagacccagcacggaacaaucgucauccgcgugcaguaugaaggcgaugguuccccaugcaaaauucccuucgagaucauggacuuggaaaagagauacguccucgggaggcugauuacugugaacccgauaguuaccgagaaagauagcccugugaacaucgaagcagagcccccauuuggcgacucguacauuaucaucggaguagagccuggccaauuaaagcugaauugguucaagaaagggucuuccauuggacagauguuugaaacgaccaugcggggugcuaagcgaauggccauacuaggcgauacagcuugggacuucgggucacucggaggcgucuuuacaaguaucgguaaagcccugcaucagguguucggggcaauuuauggcgccgcuuuuagcggaguuuccuggaccaugaagauccuuauuggcgugaucauaacauggaucgggaugaacucucgcagcacuucauugagugucucccuggugcucguaggaauugugacccuguaccuuggcguuaugguccaggcggauagcgguuguguggugucuuggaaaaauaaggagcugaagugcgggucaggaaucuucauuacggacaacguccacacauggaccgaacaauauaaauuucagcccgagaguccaagcaaguuggcauccgccauccagaaagcucaggaagagggcauaugugguauuagaucuguuacuaggcucgagaaucugauguggaagcaaaucacacccgaauuaaaccacauucugaccgagaaugaagugaaacuaacuaucaugaccggcgauauaaaggggaucaugcaggccggaaaacggucgcuccgcccucagccaacagagcugaaguacagcuggaagacguggggcaaagcaaagauguucuccaccgaaucauauaaccagacuuuucuuauugacgggccggagacagccgagugccccaauaccaacagagcuuggaauaguuuggaaguggaggauuacggauucggcguauuuacaacuaacaucuggcugaaacucaaggaaaaacaagacgccuucugugacucuaagcugaugagcgcagcgauuaaggauaauagggcuguccaugccgacauggguuauuggaucgaguccgcauuaaacgauaccuggaaaauagagaaggccucauucauugaagugaaaaauugccacuggccuaagagccauacgcuguggucuaacgggguucuugaguccgaaaugaucauccccaagaacuuggcuggacccgugagucagcacaauuaccguccuggcuaccacacacagauugccgguccauggcaucucggcaagcuggagauggacuuugauuucugugacgggaccacugucaucgugaccgaagauugcggaaaccggggccccagccuacgaacaacuaccgcaucugggaagcugauuacagaguggugcuguagauccugcacgcucccgccucugagguaucgcggagaggacggcuguugguacgguauggaaauacggccacuuaaagagaaggaagagaauuugguuaacucacuggugaccgcugggcacggacaaguagauaauuuuaguuuaggcguccucgguauggcccuguuccuugaagagaugcugaaaacuagagugggcacaaagcaugcgaucuugcucguggccgucagcuuuguuacccugauuacugggaacaugucguucaaagaccuaggaagggugguagugauggucggcgcuacaauggcagaugacaucgggaugggagugaccuaucuggcccuccuggcugccuuuaagguucgccccacguucgcagcgggccuuuugcugcgaaaguuaacuuccaaagagcucaugaugaccacaauugguaucgugcugcuuucucagagcaccauaccugaaacuguccuggagcuaacagaugcccucgcucuggggaugaugguguugcggaucguucguaauauggaaaaguaccagcuggccgugaccauuauggcaaucuuaugcguccccaacgcuguaauucuccagaaugccuggaaagugucauguacaauccuggcaguugugagugucuccccacuucuguugacuucuagccaacagaagaccgacuggauaccucucgcccugacgauuaaaggacuaaaccccacagcuaucuuucugaccacucuuuccagaaccaauaagaaaaggucauggccacucaacgaggcgaucauggccgugggcaugguaagcauucuggcaaguucuuugcugaagaaugacauaccgaugacaggcccuuuaguggcugggggacuccugacugucugcuauguucuuaccggucgcuccgccgaucuggaauuggagcgggccacggacgugaagugggaggaucaggcugaaaucagcggcucgucacccauucucucuaucacaauuagugaggacggguccaugagcaucaaaaacgaagaggaggaacagacccugacuauacuaaucagaacaggacugcuugugauuucuggccucuucccaaucagcauucccaucaccgcagccgcgugguaccugugggaggucaagaaacaaagggcugguguguugugggauguuccuuccccacccccuauggggaaggccgaauuagaggacggagcauaucgaauaaaacagaagggcauucugggcuacucacagaucggggccggaguauacaaggaagguacuuuucacacaauguggcaugugacccgcggcgcuguccucaugcacaaagggaagcggaucgagccgaguugggcagaugugaaaaaggaccugauuagcuauggaggcgguuggaaacuugagggggaauggaaggagggagaagagguucaggugcuggccuuggaaccaggcaagaaucccagagcgguccaaacgaaaccuggccuauucaagacuucuaccgggacaaucggagcugugucccuggauuuuucaccagguaccaguggcagccccauaauugacaaaaaggggaaaguagucggacucuacggcaacggugugguuacaagguccggggccuaugugucugcaaucgcccagacugagaagucgauugaggauaacccugaaaucgaggacgauauauuccguaagcgccggcugaccauuauggaccuucacccgggagcuggcaaaacgaagagauacuuacccgccaucgucagggaagcaaucaaacgaggccugcggacacucauuuuggcuccaacucgcgugguugccgcggagauggaagaggcccugagagggcucccuaucagguaucagacccccgcaauucgggcugagcauacaggacgagaaauaguggaccugaugugucacgccaccuucacuaugagacuucugagcccaguccgcgugccuaauuacaacuugaucauuauggaugaggcucauuuuaccgaccccgcaucaaucgccgccagggguuauaucuccacacguguagaaaugggcgaggcugcggggauuuucaugacggcaacuccaccgggaagucgggauccuuuuccccaaucuaaugccccaauaaucgacgaggaaagagagauucccgaaaggagcuggaacuccggccacgagugggugaccgauuucaaggguaaaacaguuugguuugucccuucaaucaaggcugggaaugacauugccgcaugccuacgcaagaacggcaagaaggugauccagcugucucgaaaaaccuucgauagcgaauacgugaagacuagaacaaaugacugggauuuugucguaaccacggacauaagugagaugggcgccaacuucaaagcugagcgggugaucgauccaaggcgcuguaugaagcccguuauucucacugacggcgaagaacgugugaucuuagcggggccuaugccggucacacauuccagcgccgcacagagacggggaaggauuggucgcaaucccaaaaacgaaaaugaccaguacaucuauaugggcgagccccuggaaaacgaugaggacugcgcucacuggaaggaggccaagaugcuucuggauaauauaaacaccccugaagggauuauccccucuauguuugagccagaacgagagaaaguggacgcaauugauggagaauacagacuccggggcgaggccaggaagaccuucguugacuugaugcgcagaggugaucugccuguguggcucgcuuauaaagucgccgcggaggggaucaauuacgcagacaggcggugguguuuugauggcauaaagaacaaccaaauccuggaagagaauguggaaguagagauuuggacuaaagagggagaacguaagaaacuuaaaccccgcuggcuagacgcccgaaucuauucagauccacuggcuuugaaggaguucaaagaguucgccgcuggcagaaaguccuuaacacugaaccucauuaccgagauggggaggcugccuacauuuaugacucagaaaacgcgggacgcacuugauaaucuggccgugcuccacaccgcugaagccggaggucgcgcauacaaccaugcguugagugagcugccggagacacuagaaacucugcuccuucugaccuuauuggccacaguuaccggcgggaucuuccuguuucucaugagcggaagaggcauagguaagaugacucuggggaugugcugcauuaucacggcuucgauccuucugugguaugcccagauucagccccacuggaucgcagcuucuauaauucucgaguucuuuuugaucguccuguuaauuccagaaccugagaagcaaaggaccccacaggacaaucagcuaacauacguggugaucgccauacugacugucguugcagccaccauggcuaacgaaaugggcuuccucgagaaaacaaagaaagaccuuggacugggcuccaucgcgacccagcaaccagagagcaauauuuuggauaucgaccugcggccugccucagcauggacucucuacgcuguggccacaacguuuguaacccccaugcugcgacauaguauugaaaacucuuccgugaaugucagccuuacugccaucgcaaaccaggcuacagugcucauggggcugggaaaggguuggccguugucaaaaauggauauuggcguuccacuguuagccaucggguguuauagucaggugaauccuauaacccuaaccgcggcucugcuccuucuggucgcccacuacgcaauuaucggacccggcuugcaggccaaggcuacaagagaggcacaaaagcgcgccgcggcugguaucaugaaaaacccaacuguagacgggauuacggugauagaucuggaccccaucccuuaugauccgaaguucgaaaaacagcucggccagguuaugcugcuuauuuuaugcgugacccaaguccugaugaugaggacaacuugggcccucugugaggcauugacccuggccacaggacccaucagcacccuaugggaaggcaauccagggcgguuuuggaacacuacgauugcuguguccauggccaauaucuuccguggaucuuaccuggcaggcgcuggucuccuuuuuagcauaaugaagaacacaaccaauacuagaagggggaccggaaacaugggcgagacacugggugagaaauggaagucccgcuugaacgcccugggcaaaucagaguuccagaucuauaagaagucugggauucaggaggucgaccggacucucgcgaaagaaggaaucaagcgaggcgagaccgaucaccaugccgugaguagagggucggcaaaacugaggugguuuguugagcgcaauauggugacaccugaaggaaagguaguggacuuaggcugcgguagagggggauggagcuacuauuguggcggucuuaaaaacgucagagagguuaagggccugacgaaagggggacccggccacgaagaaccuauuccaauguccaccuacggguggaaucucgugcgucuacagucuggagucgauguguucuucaucccaccugaaaaaugcgacacucuguugugugauauaggcgagucaagcccaaaccccacaguagaggcugguaggacccugcgggugcucaaucuuguugaaaacuggcugaauaacaauacucaauuuugcauuaagguguugaacccguacaugccuuccgucaucgagaaaauggaagcccugcagcgcaaguaugggggagcacucgugcgaaauccauuaaguagaaacucuacacaugagauguacugggucagcaaugcuucaggcaacaucguguccaguguuaauaugauuagcaggaugcugauaaaccgguucaccaugcgccacaaaaaggccacguaugaacccgacguagaccuuggcucugggaccagaaacaucggaauugaguccgagaucccuaaucuggauauuaucgguaagaggauagagaaaaucaagcaggagcaugaaacaucauggcacuacgaccaggaucacccauauaaaacuugggccuaccauggcagcuaugagaccaagcaaacagggucggcgucuaguauggugaacggagucgugcgacuacucacuaaacccugggacguucugccgaccgugacacagauggcuaugaccgauacuacgccuuuuggccagcagcgggucuucaaggaaaagguggacacacguacccaagagcccaaagaggguacuaagaaauugaugaagauuaccgcagaauggcuguggaaagagcucgggaagaaaaagacaccaagaauguguacgcgcgaagaguuuaccaggaagguacgguccaaugccgcucuuggagccaucuucacugaugagaacaaauggaaaagcgcaagagaagccguggaggacucacgcuuuugggaacugguugauaaagagaggaauuuacaccuggaaggcaagugcgagacaugugucuacaacaugaugggcaaacgagagaagaaguugggggaguucggaaaagcuaaggguucccgggcgauuugguacauguggcucggcgccagauuucuggaguucgaagcacuaggguuucuuaaugaggaccauugguucucuagggaaaacagccugaguggaguggagggcgagggucuccacaaacugggguauaucuugcgcgauguguccaagaaagaaggaggcgcuauguacgccgacgacaccgcaggcugggauacucguauuacacuggaggaccucaagaaugaagagauggucaccaaccacauggaaggggagcauaagaaacuugccgaggcuauauuuaagcugacauaucagaauaaaguugugcggguacagagaccuacucccaggggaaccgugauggauaucauuagccgccgagaccaacgggguucuggccaggucgggacguacggauuaaacaccuucacaaauauggaagcccagcugaucagacagauggagggcgaagguguguucaagaacauccaacacuugacuguuaccgaggagguggcgguccagaauuggcucgcaaggguggggcgcgaaagacugucacggauggccauuaguggagaugacugcguaguuaaaccacuagaugacagguuugcuaacgcccuuacagcacugaacgauaugggcaagauacguaaggacauccagcagugggagcccuccaaaggcuggaaugauuggacucaagugccuuucugcagccaucacuuucaugaacucauuaugaaggacgggcgaguccugguggugccaugucgcaaccaggaugaguugaucgguagagcucggauuucucagggagccggcuggucguuaagggaaaccgcuugccuggggaaaucauaugcccagauguggagccucauguacuuccaccgcagagaccuucggcuggcagcgaaugccaucuguuccgcugucccgagucacuggguucccacgucuaggacaaccuggagcauacaugccaagcacgaguggaugacuacagaggacaugcuaaccguguggaaccgaguauggauccgugaaaauccuuggauggaggauaaaacuccaguggaauccugggaggaaauucccuaucugggaaagagagaggaccaauggugcggcucacucaucgguuugaccagucgcgcaacaugggcuaagaacauucaggccgcaaucaaucagguccggucucugauagggauugaggaauacacggauuacaugccuagcaugaaaagguuuagacgcgaggaagaggaagccggagugcuuugguga

SEQ ID NO: 14797 - RNA, 9876 nt, Artificial Sequence
  derived and/or modified CDS sequence (opt3) from DENV-2__FJ562098__SS-prME
agcgccggaaugaucauuaugcugauacccaccgugauggcuuuccaccucacuacuagaaacggggaaccucauaugaucguaggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagcuaccgagaaggauagcccugugaacaucgaagccgagcccccauuuggcgacucguacauuaucaucggaguugagccuggccaguuaaagcugaauugguucaaaaaggggucuuccauuggacaaauguuugaaacgaccaugcggggugcuaaacgaauggccauacuaggcgauacagcaugggacuucgggucacucggaggcguguuuacaaguaucgguaaggcccugcaucagguauucggggcuauuuauggcgcggcauuuagcggagucuccuggaccaugaaaauccuuauuggcgugaucauaacauggaucgggaugaacucucgcagcacuucauugaguguuucccuggugcucgucggaauugugacccuguaccuuggcguaauggugcaggccgauagcgguuguguugucucuuggaagaauaaggagcugaaaugcgggucaggaaucuucauuacggacaacgugcacacauggaccgaacaguauaaguuucaacccgagaguccaagcaaauuggcuuccgccauccagaaggcacaggaagagggcauaugugguauuagaucugugacuaggcucgagaaucugauguggaaacagaucacacccgaauuaaaccacauucuggccgagaaugaagucaagcuaaccaucaugacuggcgauauaaaagggaucaugcaagcuggaaagcggucgcuccgcccucagccaauugagcugaaguacagcuggaaaaccuggggcaaggccaaaaugcuuuccacagaaucacauaaccagacguucuugaucgacgggccggagaccgcagagugccccaauacuaacagagcguggaauagucuggaaguugaggauuauggauuuggcguguucacaaccaacauuuggcucaggcugaaggaaaaacaggacgcuuuuugugacucuaaguuaaugagcgccgcaaucaaggauaaucgugccgugcacgcugacauggguuacuggauagaguccgcccugaacgauacauggaaaauugagaaggcaucauucaucgaagucaagaauugccauuggccuaagagccacacucuuuggucuaacggggucuuggaguccgaaauggugauccccaagaaccucgcuggacccguuagucaacacaauuaucggccuggcuaccauacccagauugccgguccauggcaccugggcaagcuagagauggacuucgauuuuugugacgggacgacagugaucgucaccgaagauugcggaaaccgaggccccagccugagaacuaccacagcgucugggaagcucauuacugaguggugcuguagguccugcacccugccgccucuucgcuaccggggagaggacggcuguugguaugguauggaaauaagaccauugaaagagaaggaagagaaucuggugaacucauuaguuacagccgggcauggacagguggauaauuucagucucggcguacuggguauggcucuuuuucuggaagagauguugaggacgcgcgucggcaccaaacacgcaauccuccugguggccgugagcuucgucacucuaauuacagggaacaugucguuuaaggaccugggacgaguugugguaauggugggcgcuaccauggccgaugacaucgggaugggagucacuuaccucgcacugcuugcggccuucaaagugcggcccacauuugcugccggcuugcuguuacguaagcucaccuccaaggagcugaugaugacgacuauugguaucguucuucugucucaaagcaccauaccugaaacagugcuagagcucaccgaugcacuggcuuuggggaugaugguccugaaaaucgugagaaauauggaaaaguaucaguuagccguuacuauuauggcaauccucugcgugcccaacgccgucauucugcagaaugcuuggaaaguaucauguacaauccuugcggugguuaguguguccccacuguugcucaccucuagccagcaaaagacagacuggauaccucuggcccuaacuauuaaaggacugaaccccaccgcaaucuuccuuacgacacucuccaggaccaauaagaaacgcucauggccacugaacgaggcuaucauggccgucggcauggugagcauuuuggccaguucucuguuaaagaaugacauaccgaugacuggcccucucguagcugggggacugcuuaccgugugcuacguccugacaggucgguccgcagauuuggaacucgagagagccacugacguuaagugggaggaucaggcggaaaucagcggcucgucacccauucugucuaucaccauuagugaggacggguccaugagcaucaaaaacgaagaggaggaacagacgcuaacaauacugaucaggaccggacuucucgugauuucuggccuguuuccaaucagcauucccaucacugcugccgcaugguauuugugggaggugaagaaacagcgagccggugucuuaugggaugugccuuccccacccccuauggggaaggcugaacuggaggacggagcauaccgcauaaaacaaaagggcauucucggcuauucacagaucggggccggaguuuacaaggaagguacauuccauaccauguggcacguaacucggggcgcggugcugaugcacaaagggaagagaaucgagccgaguugggcugaugucaaaaaggaccuuauuagcuacggaggcgguuggaaacuggagggggaauggaaggagggagaagaggugcagguuuuggcccuagaaccaggcaagaaucccagggcagugcagacaaaaccuggccuguuuaagaccaacacggggacuaucggagccgucucucucgauuucuccccagguaccucaggcagucccauaauugacaaaaaggggaaagugguaggacuguauggcaacggugucgugacacguagcggggcuuacguuuccgccaucgcacaaaccgagaagucuauugaggauaauccugaaaucgaggacgauauauuucgcaagcggagacuuacaauuauggacuuacauccgggagcuggcaaaacuaagagguaucugcccgccaucgugcgagaagcgaucaaacggggccuccgcaccuugauucuggccccaacgagagucguggcagcugagauggaagaggcccucagggggcugccuauccgguaccagacacccgcuauucgagcagagcacacuggaagagaaauaguugaccuuaugugucaugccaccuucacaaugcgccuguugucgccagugagggucccuaacuauaaucuaaucauuauggaugaggcccacuucaccgaccccgcuagcaucgcggcacgugguuacaucucaacucggguggaaaugggcgaggccgcugggauuuuuaugaccgccacaccaccgggauccagagauccuuucccccagaguaacgcaccaauaaucgacgaggaaagggagauucccgaacgcucuuggaauagcggccaugaguggguaacggauuuuaaggguaaaacugugugguucguuccuuccaucaaggccgggaacgacauugcugcgugccugcgaaagaauggcaaaaaggucauccaacucucaagaaaaaccuuugauucugaauaugugaagacacggaccaacgacugggauuucguggucacuacagacauaagcgagaugggcgccaauuuuaaagcagagaggguaaucgauccacgccguuguaugaagcccgugauuuuaaccgacggcgaagagagaguuauccuggcugggccuaugccggugacgcacaguuccgccgcacagcggaggggacgcauuggucgaaaccccaaaaaugaaaacgaccaguacaucuacaugggcgagccccuugaaaaugaugaggacugcgcccacuggaaggaggcuaagaugcugcucgauaacauaaauacuccugaagggauuauccccagcauguucgagccagaaagagagaaagucgacgccauugauggagaauaucgguugaggggcgaggcgcgcaagacauuuguggaccugaugagaaggggugaucucccuguuuggcuggcauacaaaguggccgcugaggggaucaacuaugccgaccggcguugguguuucgauggcauaaagaacaaucagauccuugaagagaacgucgaaguggagauuuggaccaaagagggagaacgcaagaagcuaaaaccccgauggcuggacgcuagaaucuacucugauccauuggcauuaaaggaguuuaaagaguucgccgcuggcaggaagucacugacccucaaucugauuacugagauggggcggcuuccuacauucaugacccagaaaacucgcgacgcccuggauaaccucgcaguauugcauacugcggaagccggagguagagcuuauaaucacgcccuguccgagcuaccggagacgcuggaaacccuccuucuguuaacauugcuggcaacugugaccggcgggaucuuucucuuccugaugaguggaaggggcauagguaagaugacacuugggaugugcugcauuaucaccgcuagcauccugcucugguacgcccaaauucagccccauuggaucgcagccucgauaauuuuggaguuuuuccugaucguuuuacuaauuccagaaccugagaagcagcggacuccccaagacaaccagcugacguaugucgugaucgcuauacucaccguggucgcggccacaauggcaaaugaaaugggcuuucuugagaaaacuaagaaagaccugggauugggcucuaucgcuacccagcagccagaguccaacauucuggauaucgaccuccgaccugccagcgccuggacacuguacgcaguugcuaccacuuucgugacacccaugcuuagacacucaauugaaaauaguucuguaaacgugucccucacggccaucgcgaaucaagcuaccguccugaugggguugggaaaggguuggccgcugagcaaaauggauauuggcgugccauuacuagccaucggguguuacucacagguuaacccuauaacucugacagcagcccuccuucuguugguggcucacuaugcaauuaucggacccggccugcaggccaaggcgacccgcgaggcucagaagagggccgcagccgguaucaugaaaaauccaaccgucgacgggauuacaguaauagaucucgaccccaucccuuacgauccgaaguuugaaaaacaacugggccaggugaugcuuuuaauucugugcguuacucaggugcucaugaugcggacgaccugggcuuugugugaggcccugacacuagcaacuggacccaucaguacccugugggaaggcaacccagggcguuucuggaauacaaccauugcugucagcauggccaacaucuuuagaggauccuaucucgcgggcgccggucuucuguucucuauaaugaagaauacuacgaacacaaggcgcgggaccggaaacaugggcgagacuuugggugagaaauggaaaagccggcugaaugcacucggcaaauccgaauuucaaaucuacaagaagucagggauucaggagguggaccgaacccuggcuaaagaaggaaucaagagaggcgagacagaucaucacgccgucucuagggggagugcaaaauuacgcugguucguggagcggaacaugguuacuccugaaggaaaggugguagaccuuggcugcgguagagggggauggucguauuacuguggcggucugaaaaaugugcgugaggucaagggccucaccaaagggggacccggccaugaagaaccuauuccaaugagcacauauggguggaaccuaguuaggcugcaguccggaguggaugucuuuuucaucccaccugaaaaaugcgacacguugcugugugauauaggcgagucuucaccaaaucccaccguggaggcuggucggacucuccgcguacuuaaccugguggaaaauugguugaacaauaacacacaguucugcauuaagguucugaauccguacaugccuagcgugaucgagaaaauggaagcccuccaacgaaaguacgggggagccuuagucagaaacccacuguccaggaauaguacccacgagauguauugggugucuaacgcgagcggcaauaucgucucauccgugaacaugauuagucggaugcuuauaaaccgcuuuacuaugagacauaaaaaggcuacauacgaacccgacguugaccugggcagcgggaccaggaauaucggaauugagucugagaucccuaaccuagauauuaucgguaagcgaauagagaaaaucaagcaggagcacgaaacguccuggcacuaugaccaggaucauccauacaaaaccugggcauaucacggcucauacgagacaaagcagacugggagcgccucgucuaugguaaauggagugguccggcuccugaccaaacccugggacguguugccgacaguuacucaaauggcuaugaccgauacaaccccuuucggccagcagcguguguuuaaggaaaaggucgacacuagaacgcaggagcccaaagaggguacaaagaaacugaugaagauuaccgccgaauggcucuggaaagagcuugggaagaaaaagacuccacgcauguguaccagggaagaguucacacggaaggugagaaguaacgcagcccugggagcuaucuuuacggaugagaauaaauggaaguccgcgcgcgaagccguagaggacagcagguucugggaauuaguggauaaagagcgaaaccugcauuuggaaggcaagugcgagaccuguguuuauaauaugaugggcaaacgggagaagaagcucggggaauuuggaaaagcaaaggguucaagagcuauuugguacauguggcugggcgccagguuccuagaguuugaagcacuuggguuccugaacgaggaccacugguuuucccgcgaaaauucucucagcggagucgagggcgagggucugcacaaauugggguacauccugcgugaugugaguaagaaagaaggaggcgccauguaugcugacgacacugccggcugggauacacggauuacccucgaggaccuuaagaacgaagagauggugacuaaucauauggaaggggagcacaagaaacuggcggaggcaauauucaaguuaacauaccaaaacaaagucguuagagugcagaggccuaccccacgcggaacaguaauggauaucauuucccgacgggaccagagagguagcggccaaguggggacuuauggacugaauaccuuuacgaacauggaagcccaguugaucaggcagauggagggcgaaggugucuucaagaauauccagcaucucaccgugacagaggagguugcugugcaaaacuggcuggcccgcgucgggagagaacggcuaucuaggauggcaauuucaggagaugacugcgugguaaaaccacuugaugaccguuucgcuaacgcccugacugcucucaaugauaugggcaagauacgaaaggacauccagcagugggagcccaguaaaggcuggaacgauuggacccagguuccuuuuugcucccaccauuuccacgaacugauuaugaaggacgggcgcguguuggucgugccauguagaaaucaagaugaguuaaucggacgggccaggauuagccagggugcaggcuggucucugcgcgaaacagcgugccucgggaaaucguacgcccagauguggucacuuauguauuuucacagacgggaccugaggcuagcugccaacgcaaucuguagcgcugugccgucccauuggguccccacaagucgaaccacguggucuauacacgccaagcaugaguggaugacaaccgaggacaugcugacuguuuggaaucguguguggaucagagaaaacccuuggauggaggauaaaacaccaguagaaagcugggaggaaauucccuaccucggaaagcgcgaggaccaguggugcggcuccuugaucggucugaccucacgggcaacuugggccaagaauauucaagcggcuaucaaccaggugaggagucuuauagggaaugaggaauauaccgauuacaugccuucuaugaaaagauuccgccgggaggaagaggaagccggaguccugugguga

SEQ ID NO: 14798 - RNA, 9876 nt, Artificial Sequence
  derived and/or modified CDS sequence (opt3) from DENV-2__FJ859028__SS-prME
agcgcaggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaagaauaacagggcaguacaugccgauauggguuauuggaucgaguccgcucugaaugacacuuggaaaauagagaaggccucauucauugaagucaaaaacugccacuggccuaagagccauacccuuuggucuaacgggguguuggaguccgaaaugaucauccccaagaaucucgcaggacccguuagucagcacaacuaccguccuggcuaccacacgcagauugcugguccauggcaucugggcaagcuagagauggauuucgacuuuugugaugggacaaccguggucgugacugaagacugcggaaaucggggccccagccugcgaaccacaacugccucugggaagcucaucaccgaguggugcuguagauccugcacacugccgccucuuagguaucgcggagaggauggcuguugguacgguauggaaauucggccauugaaagagaaggaagagaaccugguuaauucauuagugacggcggggcacggacaaguagacaacuucagucucggcguccuggguauggcccuuuuucuggaagagauguugagaaccagggugggcacuaaacaugcuauacuccugguggcagucagcuucguuacacuaaucaccgggaauaugucguuuaaggaucugggacgcgugguagugauggucggcgccacuauggcugacgauauugggaugggagugacauaucucgcccugcuugcagcguucaaaguucgacccaccuuugccgcuggcuugcuguuacggaagcucacguccaaggagcugaugaugacuaccaucgguauugugcuucugucucagagcacaaucccugaaaccguccuagagcucacugacgcccuggcauuggggaugauggugcugaaaauaguucguaacauggaaaaguaccaguuagcugugacaaucauggccauucucugcguccccaaugcaguaauccugcagaacgccuggaaagugucauguaccauucuugcuguugugagugucuccccacuguugcucacaucuagccaacagaagacugauuggaucccucuggcgcuaaccauaaaaggacugaaucccacggccauuuuccuuacaacccucuccagaacuaacaagaaaaggucauggccacugaaugaggcaaucauggcugugggcaugguaagcaucuuggccaguucucuguuaaagaacgacauuccgaugaccggcccucucguggccgggggacugcuuacagucugcuauguucugacuggucgcuccgcugacuuggaacucgagcgggcaaccgaugugaagugggaggaccaggccgaaauaagcggcucgucacccauccugucuauuacgaucagugaggauggguccaugagcauuaaaaaugaagaggaggaacagacacuaaccauccugauaagaacuggacuucucgugaucucuggccuguuuccaauuagcauccccauuacagcggcugccugguacuugugggaggucaagaaacaaagggccgguguguuaugggacguuccuuccccacccccuauggggaaggccgaacuggaggauggagcuuaucgaaucaaacagaagggcauacucggcuacucacagauuggggcaggaguauacaaggaagguaccuuccacacuauguggcaugugacacgcggcgccguccugaugcacaaagggaagcggaucgagccgaguugggcggacgugaaaaaggaucuuaucagcuauggaggcgguuggaaacuggagggggaauggaaggagggagaagagguucagguguuggcucuagaaccaggcaagaaccccagagccguccaaaccaaaccuggccuguuuaagacgaacacugggaccauuggagcagugucucucgacuucuccccagguacaucaggcagucccaucauagauaaaaaggggaaaguagucggacuguacggcaauggugugguuaccaggagcggggccuauguguccgcuauugcccagacagagaagucuaucgaggacaacccugaaauugaggaugacaucuuucguaagcgccggcuuacuauaauggauuuacacccgggagcaggcaaaaccaagagauaccugcccgcuauugucagggaagccaucaaacgaggccuccggacguugauccuggcgccaacacgcgugguugccgcagagauggaagaggcucucagagggcugccuauuagguaucagacucccgccauccgggcugagcauaccggacgagaaauuguggaccuuaugugucacgcaacauucaccaugagacuguugucgccaguccgcgugccuaauuacaaccuaauaaucauggacgaggcccauuucacugaucccgccagcauugcugcgagggguuauaucucaacccguguagaaaugggcgaggcagccgggaucuuuaugacagcuacgccaccgggaucccgggacccuuucccccaaaguaaugccccaauuauagaugaggaaagagagauccccgaaaggucuuggaacagcggccacgagugggugacugacuuuaaggguaaaaccguuugguucgucccuuccauuaaggcagggaaugauaucgccgcuugccugcgcaagaacggcaagaaggugauucagcucucacgaaaaacauuugacucugaauacgugaagaccagaacuaaugauugggacuucgucguaacaaccgauaucagcgagaugggcgcgaacuuuaaagccgagcgggugauagacccaaggcgcuguaugaagcccguuaucuuaacggauggcgaagaacgugugauucuggcagggccuaugccggucacucauaguuccgcugcccagagacggggaaggaucggucgcaaucccaaaaacgaaaaugaccaguacauuuauaugggcgagccccuugaaaacgacgaggauugcgcacacuggaaggaggccaagaugcugcucgacaauaucaacacaccugaagggauaauucccagcauguucgagccagaacgagagaaaguggaugcuaucgacggagaauacagauugcggggcgaggccaggaagaccuuuguugaucugaugcgcagaggugaccucccuguguggcuggcguauaaagucgcagccgaggggauuaacuacgcugauaggcggugguguuucgacggcaucaagaauaaccaaauacuugaagagaauguggaaguagagaucuggaccaaagagggagaacguaagaagcuaaaaccccgcuggcuggaugcccgaauuuauucugacccauuggcuuuaaaggaguuuaaagaguucgcagccggcagaaagucacugacucucaaccugaucacagagauggggaggcuuccuaccuucaugacacagaaaacucgggaugcucuggacaaucucgccguguugcacacggcagaagcgggaggucgcgccuacaaccaugcucuguccgagcuaccggagacccuggaaacacuccuucuguuaacuuugcuggccaccguuacaggcgggauuuuucucuuccugaugaguggaagaggcaucgguaagaugacccuugggaugugcugcauaauuacugcaagcauccugcucugguaugcucagauccagccccacuggauugccgcaucgaucauauuggaguuuuuccugauugucuuacuaaucccagaaccugagaagcaaaggacgccccaggauaaucagcugaccuacguggugauugccauccucacagucguugcugcgacuauggccaacgaaaugggcuuucuugagaaaaccaagaaagaccugggauugggcucuauagcaacacagcaaccagaguccaauauccuggacauugaucuccggccugcuagcgccuggacccuguacgccguggcaacuacauucguaacgcccaugcuucgacauucaaucgaaaacaguucugugaaugucucccucaccgcuauugccaaccaggcgacugugcugaugggguugggaaaggguuggccgcugagcaaaauggacaucggcguuccauuacuagcuauuggguguuauucacaggugaauccuaucacacugaccgccgcacuccuucuguuggucgcccacuacgcuauaauuggacccggccugcaggcaaaggccaccagagaggcgcaaaagcgcgcugccgcagguaucaugaaaaacccaacaguagaugggaucacugugauugaccucgaucccauaccuuaugacccgaaguuugaaaaacagcugggccagguuaugcuuuuaauccugugcgugacgcaaguccucaugaugaggaccacaugggccuugugugaggcucugacucuagccaccggacccauuaguacacugugggaaggcaauccagggcgguucuggaacaccacuaucgcagugagcauggcuaauauuuuucguggauccuaccucgccggcgcgggucuucuguucucuaucaugaagaacacgacaaacaccagaagggggacuggaaauaugggcgagaccuugggugagaaauggaaaagccgccugaacgcccucggcaaauccgaauuucagauauauaagaagucagggauccaggaggucgaucggacacuggcaaaagaaggaauuaagcgaggcgagacugaccaccaugcugugucuagagggagugccaaauuaaggugguucguugagcgcaauauggugaccccugaaggaaagguaguggaucuuggcugcgguagagggggauggucguacuauuguggcggucugaaaaacgucagagagguuaagggccucacaaaagggggacccggccacgaggaaccuaucccaaugagcacguacggguggaaucuagugcgucugcaguccggagucgacguguuuuucauucccccugaaaaaugcgauaccuugcugugugacaucggcgagucuucaccaaaccccacuguagaggcagguaggacacuccgggugcuuaaucugguugaaaacugguugaauaacaauacccaauucugcauaaaggugcugaacccguacaugccuagcgucauugagaaaauggaagcucuccagcgcaaguaugggggagccuuagugcgaaauccacuguccagaaacaguacucaugagauguacugggucucuaaugccagcggcaacaucgugucauccguuaacaugaucaguaggaugcuuauuaaucgguuuacaaugcgccacaaaaaggcgaccuaugaacccgauguagaccugggcagcgggacgagaaacauaggaaucgagucugagauuccuaaucuagacaucauugguaagaggaucgagaaaauaaagcaggagcaugaaaccuccuggcacuacgaucaggaccacccauauaaaacaugggcuuaccauggcucauaugagacuaagcaaaccgggagcgcaucgucuauggugaacggagucgugcgacuccugacaaaacccugggauguuuugccgacugugacccagauggccaugacagacaccacuccuuucggccagcagcgggucuuuaaggaaaagguggauacgcguacacaagagcccaaagaggguaccaagaaacugaugaagaucacugcugaauggcucuggaaagagcuugggaagaaaaagaccccaagaauguguacacgcgaagaguucacgaggaagguacggaguaaugccgcacugggagccauuuuuaccgacgagaacaaauggaaguccgcuagagaagcgguggaggauagccgcuucugggaauuaguugacaaagagaggaaucugcacuuggaaggcaagugcgagacuugugucuacaacaugaugggcaaacgagagaagaagcucggggaauuuggaaaagccaaggguucacgggcaaucugguacauguggcugggcgcuagauuccuagaguuugaagcccuuggguuccugaaugaggaucauugguuuuccagggaaaacucucucagcggaguggagggcgagggucugcacaaauugggguauauucugcgcgacgugaguaagaaagaaggaggcgcaauguacgccgaugacacagcuggcugggacacccguaucacucucgaggaucuuaagaaugaagagauggucacaaaccacauggaaggggagcauaagaaacuggccgaggcgauuuucaaguuaaccuaucagaauaaaguugugcggguacagagaccuacacccaggggaacugugauggacauaaucucccgccgagaucaacgggguagcggccaggucgggaccuacggacugaacacguuuaccaauauggaagcacaguugauuagacagauggagggcgaagguguguucaagaacauccaacaccucacaguuacugaggagguggccguccagaacuggcuggcuaggguggggcgcgaaagacuaucucggauggccaucucaggagacgauugcguaguuaaaccacuugacgauagguucgcaaaugcucugaccgcccucaacgacaugggcaagauucguaaggauauacagcagugggagcccaguaaaggcuggaaugacuggacacaagugccuuuuugcucccaucacuuccaugaacugaucaugaaggaugggcgagucuugguggugccaugucgcaaccaggacgaguuaauugguagagcucggaucagccagggagccggcuggucucugagggaaacugcaugccucgggaaaucguaugcgcagauguggucacuuauguacuuucaccgcagagaucugcggcuagccgcuaaugccauuuguagcgcagucccgucccacuggguucccaccaguaggacgacauggucuauccaugcuaagcacgaguggaugaccacugaggacaugcugacaguguggaaccgaguauggauacgugaaaauccuuggauggaggacaaaaccccaguggaaagcugggaggaaauccccuaucucggaaagagagaggaucaauggugcggcuccuugauuggucugacuucacgcgccaccugggcaaagaacauccaggucgccauuaaucaggugcggagucuuaucgggaacgaggaauacacagacuacaugccuucuaugaaaagguucagacgcgaggaagaggaagcgggaguucugugguga

SEQ ID NO: 14799 - RNA, 9876 nt, Artificial Sequence
  derived and/or modified CDS sequence (opt3) from DENV-2__FJ410200__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucagcacaauuaccguccuggcuaccacacgcagauugcugguccauggcaucugggcaagcuagagauggacuucaacuuuugugaugggacaaccgugaucgucacugaagacugcggaaaucggggccccagccugcgaaccacaacugccucugggaagcucauuaccgaguggugcuguagauccugcacacugccgccucuuagguaucgcggagaggauggcuguugguacgguauggaaauacggccauugaaagagaaggaagagaaccuggugaauucauuaguuacggcggggcacggacaaguggacaacuucagucucggcguacuggguauggcccuuuuucuggaagagauguugagaaccagggucggcacuaaacaugcuauccuccugguggcagugagcuucgucacacuaauuaccgggaauaugucguuuaaggaucugggacgcguugugguaauggugggcgccacuaugacagacgauaucgggaugggagucaccuaucucgcucugcuugccgcauucaaagugcgacccacguuugcggccggcuugcuguuacggaagcucacuuccaaggagcugaugaugaccacaauugguaucguucuucugucucagagcaccauaccugaaacugugcuagagcucacagacgcucuggccuuggggaugaugguccugaaaaucgugcguaacauggaaaaguaccaguuagcaguuaccauuauggcuauccucugcgugcccaaugccgucauucugcagaacgcauggaaaguaucauguacaauccuugccgugguuaguguguccccacuguugcucacuucuagccaacagaagaccgauuggauaccucuggcucuaacgauuaaaggacugaaucccacagcgaucuuccuuaccacucucuccagaaccaacaagaaaaggucauggccacugaaugaggccaucauggcagucggcauggugagcauuuuggcuaguucucuguuaaagaacgacauaccgaugacaggcccucucguagccgggggacugcuuacugugugcuauguccugaccggucgcuccgccgacuuggaacucgagcgggcuacggauguuaagugggaggaccaggcagaaaucagcggcucgucacccauucugucuaucacaauuagugaggauggguccaugagcaucaaaaaugaagaggaggaacagacccuaacuauacugaucagaacaggacuucucgugauuucuggccuguuuccaaucagcauucccaucaccgccgcggcuugguacuugugggaggugaagaaacaaagggccggugucuuaugggacgugccuuccccacccccuauggggaaggcagaacuggaggauggagccuaucgaauaaaacagaagggcauucucggcuacucacagaucggggcuggaguuuacaaggaagguacuuuccacacaauguggcauguaacccgcggcgcagugcugaugcacaaagggaagcggaucgagccgaguugggccgacgucaaaaaggaucuuauuagcuauggaggcgguuggaaacuggagggggaauggaaggagggagaagaggugcagguuuuggcgcuagaaccaggcaagaaccccagagcugugcaaacgaaaccuggccuguuuaagacuaacaccgggacaaucggagccgucucucucgacuucuccccagguaccucaggcagucccauaauugauaaaaaggggaaagugguaggacuguacggcaauggugucgugacaaggagcggggcauauguuuccgccaucgcucagacugagaagucuauugagaacaauccugaaaucgaggacgauauauuucguaagcgccggcuuaccauuauggacuuacacccgggagccggcaaaacgaagagauaccugcccgcaaucgugagggaagcuaucaaacgaggccuccggacauugauucuggccccaacucgcgucguggcggccgagauggaagaggcacucagagggcugccuaucagguaucagacccccgcuauucgggccgagcauacaggacgagaaauaguugaucuuaugugucacgcuaccuucacuaugagacuguugucgccagugcgcgucccuaacuacaaucuaaucauuauggacgaggcacauuucaccgaccccgccagcaucgccgcuagggguuauaucucaacacguguggaaaugggcgaggcggcagggauuuuuaugacggccacuccaccgggaucccgggauccuuucccccaaaguaacgcuccaauaaucgacgaggaaagagagauucccgaaaggucuuggaauagcggccacgaguggguaaccgauuuuaaggguaaaacagugugguucguuccuuccaucaaggccgggaacgacauugcagccugccugcgcaagaauggaaaaaaggucauccagcucucacgaaaaaccuuugauucugaauacgugaagacuagaacaaacgacugggauuucguggucaccacggacauaagcgagaugggcgcuaauuuuaaagcggagcggguaaucgauccaaggcgcuguaugaagcccgugauuuuaacugacggcgaagagcguguuauccuggccgggccuaugccggugacacauaguuccgcagcucagagacggggaaggauuggucgcaacccaaaaaaugaaaacgaucaguacaucuauaugggcgagccccuugaaaaugacgaggacugcgcccacuggaaggaggcaaagaugcugcucgauaacauaaacaccccugaagggauuauccccagcauguucgagccagaacgagagaaagucgacgccauugauggagaauacagauugcggggcgaggcuaggaagaccuuuguggaccugaugcgcagaggugaucucccuguuuggcuggccuauaaaguggcggcagaggggaucaauuacgccgacaggcggugguguuucgauggcauaaagaacaaucaaauccuugaagagaacauggaagucgagauuuggacuaaagagggagaacguaagaagcuaaaaccccgcuggcuggacgcucgaaucuauucugauccauuggccuuaaaggaguuuaaagaauucgcugcaggcagaaagucacugacacucaaucugauuaccgagauggggaggcuuccuacauucaugacucagaaaacgcgggacgcccuggauaaccucgcuguguugcacaccgccgaagcaggaggucgcgcguacaaucaugcccuguccgagcuaccggagacacuggaaacucuccuucuguuaaccuugcuggcuacaguaaccggcgggaucuuucucuuccugaugaguggaagaggcauagguaagaugacucuugggaugugcugcauuaucacggccagcauccugcucugguaugcacagauucagccccacuggaucgcugccucgauaauuuuggaguuuuuccugaucguguuacuaauuccagaaccugagaagcaaaggaccccccaggacaaccagcugacauacguugucaucgcaauacucacugugguggccgcuaccauggcgaaugaaaugggcuuucuugagaaaacaaagaaagaucugggauugggcucuaucgccacccggcagccagaguccaacauucuggacaucgaccuccgaccugcaagcgcuuggacucuguacgccgucgccacaacguucguuacccccaugcuuagacauucaauugaaaauaguucugugaacguaucccucacugcaaucgcuaaucaagccacagugcugaugggguugggaaaggguuggccgcugagcaaaauggauauuggcgucccauuacuagcgaucggguguuauucacaggugaacccuauaacccugaccgcugcccuccuucuguugguugcacacuacgccauuaucggacccggccugcaggcuaaggcaacacgcgaggcccagaagagggcggcugccgguaucaugaaaaauccaacuguggacgggauuacggucauagaucucgaccccaucccuuaugauccgaaguuugaaaaacaacugggccagguaaugcuuuuagugcugugcguuacccaggugcucaugaugcggacaacuugggcauugugugaggcccugacccuagcuacaggacccauuaguacccugugggaaggcaacccagggcguuucuggaauacuacgaucgccgucagcauggcaaacauuuuuagaggauccuaccucgcuggcgccggucuucuguucucuaucaugaagaacacaaccaauacuaggcgcgggaccggaaacaugggcgagacauugggugagaaauggaagagccggcugaaugcgcucggcaaauccgaauuucaaauauauaagaagucagggauccaggagguggaccgaacucuggccaaagaaggaauuaagagaggcgagaccgaucaccaugcagucucuagggggagugcuaaauuacgcugguucguggagcggaacaugguuacaccugaaggaaaggugguagaccuuggcugcgguagagggggauggucguacuauuguggcggucugaaaaaugugcgugaggucaagggccucacgaaggggggacccggccacgaagagccuaucccaaugagcaccuacggguggaaccuaguuaggcugcaguccggaguggaugucuuuuucauucccccugaaaaaugcgacacuuugcugugugauaucggcgagucuucaccaaaucccacaguggaggccggucggacccuccgcguacuuaaccugguggaaaauugguugaacaauaacacucaguucugcauaaagguucugaauccguacaugccuagcgugauugagaaaauggaagcacuccaacgaaaguaugggggagcuuuagucagaaacccacuguccaggaauaguacacaugagauguacugggugucuaacgccagcggcaacaucgucucauccgugaauaugaucagucggaugcuuauuaaccgcuuuaccaugagacacaaaaaggccacguaugaacccgacguugaucugggcagcgggaccaggaauauaggaaucgagucugagauuccuaaccuagacaucauugguaagcgaaucgaaaaaauaaagcaggagcaugaaacauccuggcacuacgaccaggaucacccauauaaaacuugggcguaccauggcucauaugagaccaagcagacagggagcgcuucgucuaugguaaauggagugguccggcuccugacuaaacccugggacguguugccgaccguuacacaaauggcaaugaccgauacuacgccuuucggccagcagcguguguuuaaggaaaaggucgacacaagaacccaggagcccaaagaggguacuaagaaacugaugaagaucaccgccgaauggcucuggaaagagcuugggaagaaaaagacaccacgcagguguacgcgggaagaguucaccagaaaggugcgcaguaacgcugcccugggagcaauuuuuacugaugagaauaaauggaaguccgccagggaagcuguagaggacagccgauucugggaauuaguggauaaagagcggaaccugcacuuggaaggcaagugcgagacauguguuuacaauaugaugggcaaaagagagaagaagcucggggaauuuggaaaagcgaaggguucaagggccaucugguacauguggcugggcgcacgcuuccuagaguuugaagcucuuggguuccugaacgaggaccauugguuuucccgugaaaauucucucagcggagucgagggcgagggucugcacaaauugggguauauucugcgggaugugaguaagaaagaaggaggcgccauguacgcagacgauaccgccggcugggacacuagaaucacacucgaggaccuuaagaacgaagagauggugaccaaucacauggaaggggagcauaagaaacuggcugaggccauuuucaaguuaacauaucaaaacaaagucguuagggugcagcgcccuacuccccgaggaaccguaauggauauaaucucccggagagaccagagggguagcggccaaguggggacguacggacugaauaccuuuacaaacauggaagcgcaguugauucgccagauggagggcgaaggugucuucaagaacauccagcaccucacugugaccgaggagguugcagugaaaaauuggcuggccagagucgggcgggaaaggcuaucucguauggcuaucucaggagaugacugcgugguaaagccacuugaugaccgauucgccaacgcacugacagcucucaaugauaugggcaagauucgcaaagacauacaacagugggagcccaguaagggcuggaacgauuggacucagguuccuuuuugcucccaucacuuccaugaacugaucaugaaagacgggagaguguuggucgugccaugucggaaucaggaugaguuaauuggaagggcccgcaucagccaaggugcuggcuggucucugagagaaaccgccugccucgggaagucguaugcacagauguggucacuuauguacuuucaccggagggaccugcgacuagcggccaacgcuauuuguagcgccgugccgucccacuggguccccacgagucguacaaccuggucuauccaugcaaaacacgaguggaugacuacagaggauaugcugaccguuuggaauagaguguggauacgcgaaaacccuuggauggaggacaagacuccaguagaaagcugggaggaaauccccuaucucggaaagcgggaggaccaguggugcggcuccuugauuggucugaccucaagggcuacaugggccaaaaauauccaggcagccauuaaccaagugagaagucuuaucgggaaugaggaauacacggauuacaugccuucuaugaagcgcuuccggagggaggaagaggaagcgggaguccugugguga

SEQ ID NO: 14800 - RNA, 9876 nt, Artificial Sequence
  derived and/or modified CDS sequence (opt3) from DENV-2__FJ410202__SS-prME
agcgcaggcaugaucauuaugcugauccccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaagugucgguaaggcacugcaucagguguucggggccaucuauggcgcugcguuuagcggaguuuccuggaccaugaaaauucuuaucggcgugauuaucacauggauagggaugaacucucgcagcacuucauugagugucucccuggugcucguaggaaucgugacccuguaccuuggcguuaugguccaggcagauagcgguuguguggugucuuggaagaauaaggagcugaaaugcgggucaggaauuuucaucacggacaacguccacacauggaccgaacaguauaaguuucaacccgagaguccaagcaaauuggccuccgcuauucagaaggcccaggaagagggcaucugugguauaagaucuguuacuaggcucgagaaucugauguggaaacagauuacacccgaauuaaaccacauccuggcagagaaugaagugaagcuaaccauuaugacuggcgauaucaaagggauaaugcaagccggaaagcggucgcuccgcccucagccaaccgagcugaaguacagcuggaaaacauggggcaaggcuaaaaugcuuuccacggaaucauauaaccagaccuucuugaucgacgggccggagacugccgagugccccaauacaaacagagcauggaauagucuggaaguggaggauuacggauuuggcguauucaccacaaacauuuggcucaagcugaaagaaaagcaggacgcguuuugugacucuaaguuaaugagcgcugccaucaaagauaauagggcaguccaugccgacauggguuauuggauugaguccgcucugaacgauacuuggaagaucgagaaagccucauucauagaagugaagaauugccacuggccuaaaagccauacccuuuggucuaacgggguuuuggaguccgaaaugauuaucccaaagaaccucgcaggacccgugagucaacacaauuaccguccuggcuaccacacgcagaucgcugguccauggcaucugggcaagcuagagauggacuucgauuuuugugacgggacaaccgucauugugacugaagauugcggaaaccggggccccagccugcgaaccacaacugccucugggaaacucaucaccgaguggugcuguagauccugcacacugccgccucuuagguaucgcggagaggacggcuguugguacgguauggaaauucggccauugaaggagaaagaagagaaucugguuaacucauuagugacggcggggcacggacagguagauaauuucagucucggcguccuggguauggcccuuuuucuggaagagauguugagaaccagggugggcacuaagcaugcuauacuccugguggcagucagcuucguuacacuaaucaccgggaacaugucguuuaaagaccugggacgcgugguagugauggucggcgccacuauggcugaugacauugggaugggagugacauaucucgcccugcuugcagcguucaagguucgacccaccuuugccgcuggcuugcuguuacggaagcucacguccaaagagcugaugaugacuaccaucgguauugugcuucugucucaaagcacaaucccugaaaccguccuagagcucacugaugcccuggcauuggggaugauggugcugaagauaguucguaauauggaaaaauaccaguuagcugugacaaucauggccauucucugcguccccaacgcaguaauccugcagaaugccuggaaggugucauguaccauucuugcuguugugagugucuccccacuguugcucacaucuagccagcagaagacugacuggaucccucuggcgcuaaccauaaagggacugaaccccacggccauuuuccuuacaacccucuccagaacuaauaaaaagaggucauggccacugaacgaggcaaucauggcugugggcaugguaagcaucuuggccaguucucuguuaaagaaugacauuccgaugaccggcccucucguggccgggggacugcuuacagucugcuauguucugacuggucgcuccgcugauuuggaacucgagcgggcaaccgacgugaaaugggaggaucaggccgaaauaagcggcucgucacccauccugucuauuacgaucagugaggacggguccaugagcauuaagaacgaagaggaggaacagacacuaaccauccugauaagaacuggacuucucgugaucucuggccuguuuccaauuagcauccccauuacagcggcugccugguacuugugggaggucaaaaagcagagggccgguguguuaugggauguuccuuccccacccccuauggggaaagccgaacuggaggacggagcuuaucgaaucaagcaaaagggcauacucggcuacucacagauuggggcaggaguauacaaagaagguaccuuccacacuauguggcaugugacacgcggcgccguccugaugcacaaggggaaacggaucgagccgaguugggcggaugugaagaaagaccuuaucagcuauggaggcgguuggaagcuggagggggaauggaaggagggagaagagguucagguguuggcucuagaaccaggcaaaaaucccagagccguccagaccaagccuggccuguuuaaaacgaacacugggaccauuggagcagugucucucgauuucuccccagguacaucaggcagucccaucauagacaagaaagggaagguagucggacuguacggcaacggugugguuaccaggagcggggccuauguguccgcuauugcccaaacagagaagucuaucgaggauaauccugaaauugaggacgauaucuuucguaaacgccggcuuacuauaauggacuuacacccgggagcaggcaagaccaaaagauaccugcccgcuauugucagggaagccaucaagcgaggccuccggacguugauccuggcgccaacacgcgugguugccgcagagauggaagaggcucucagagggcugccuauuagguaucagacucccgccauccgggcugagcauaccggacgagaaauuguggaccuuaugugucacgcaacauucaccaugagacuguugucgccaguccgcgugccuaacuacaaucuaauaaucauggaugaggcccauuucacugaccccgccagcauugcugcgagggguuauaucucaacccguguagaaaugggcgaggcagccgggaucuuuaugacagcuacgccaccgggaucccgggauccuuucccccagaguaacgccccaauuauagacgaggaaagagagauccccgaaaggucuuggaauagcggccacgagugggugacugauuuuaaagguaagaccguuugguucgucccuuccauuaaggcagggaacgacaucgccgcuugccugcgcaaaaauggaaagaaagugauucaacucucacgaaagacauuugauucugaauacgugaaaaccagaacuaacgacugggauuucgucguaacaaccgacaucagcgagaugggcgcgaauuuuaaggccgagcgggugauagauccaaggcgcuguaugaaacccguuaucuuaacggacggcgaagaacgugugauucuggcagggccuaugccggucacucauaguuccgcugcccagagacggggaaggaucggucgcaacccaaagaaugaaaacgaccaguacauuuauaugggcgagccccuugaaaaugaugaggacugcgcacacuggaaggaggccaaaaugcugcucgauaacaucaauacaccugaagggauaauucccagcauguucgagccagaacgagagaagguggacgcuaucgauggagaauacagauugcggggcgaggccaggaaaaccuuuguugaccugaugcgcagaggugaucucccuguguggcuggcguauaaggucgcagccgaggggauuaacuacgcugacaggcggugguguuucgauggcaucaaaaacaaucagauacuugaagagaacguggaaguagagguguggaccaaggagggagaacguaagaaacuaaagccccgcuggcuggacgcccgaaucuauucugauccauuggcuuuaaaagaguuuaaggaguucgcagccggcagaaaaucacugacucucaaucugauuacagagauggggaggcuuccuaccuucaugacacaaaagacucgggacgcucuggauaaccucgccguuuugcacacggcagaagucggaggucgcgcguacaaucaugcccuguccgagcuaccggagacccuggaaacacuccuucuguuaacuuugcuggcuaccgugacaggcgggaucuuucucuuccugaugaguggaagaggcauugguaagaugacccuugggaugugcugcaucauaacugccagcauucugcucugguaugcacagauccagccccacuggaucgcugccucgauuaucuuggaguuuuuccugauaguguuacuaauuccagaaccugagaaacagaggacgccccaagacaaccagcugaccuacgucguuaucgcaauucucacagugguagccgcuacuauggcgaaugaaaugggcuuucuugagaagaccaaaaaggaccugggauugggcucuaucgccacacagcagccagaguccaacauacuggauaucgaccuccggccugcaagcgcuuggacccuguacgccguggccacuacauucgucacgcccaugcuucgacauucaauugaaaauaguucugugaacguuucccucaccgcaaucgcuaaucaagccacugugcugaugggguugggaaaagguuggccgcugagcaagauggauauuggcgucccauuacuagcgaucggguguuauucacagguaaacccuauuacacugaccgcugcccuccuucuguugguggcacacuacgccaucauaggacccggccugcaggcuaaggcaaccagagaggcccagaaacgcgcggcugccgguauuaugaagaauccaacaguugacgggaucacugugaucgaucucgaccccauuccuuaugauccgaaauuugaaaagcaacugggccaggucaugcuuuuaauacugugcgugacgcagguccucaugaugaggaccacaugggcauugugugaggcccugacucuagcuaccggacccaucaguacacugugggaaggcaacccagggcgguucuggaauaccacuauugccgugagcauggcaaacaucuuucguggauccuaccucgcuggcgccggucuucuguucucuauuaugaaaaauacgacaaacaccagaagggggacuggaaacaugggcgagaccuugggugagaaguggaaaagccgccugaaugcgcucggcaaguccgaauuucaaaucuauaagcggucagggauacaggagguugaccgaacacuggccaaagaaggaaucaagagaggcgagacugaucaccaugcagugucuagggggagugcuaaauuacgcugguucguagagcggaacauggugaccccugaaggaaaggucguugaccuuggcugcgguagagggggauggucguacuauuguggcggucugaaaaaugugcgugaggucaagggccucacaaaagggggacccggccacgaagaaccuauuccaaugagcacguacggguggaaccuagugaggcugcaguccggaguagauguguuuuucauacccccugaaaaaugcgacaccuugcugugugauauuggcgagucuucaccaaaucccacuguugaggccggucggacacuccgcgugcuuaaccuggucgaaaauugguugaacaauaacacccaguucugcaucaaggugcugaauccguacaugccuagcgucauagagaaaauggaagcacuccaacgaaaguaugggggagcuuuagugagaaacccacuguccaggaauaguacucaugagauguacuggguuucuaacgccagcggcaauauuguaucauccgugaacaugaucagucggaugcuuaucaaccgcuuuacaaugagacacaaaaaggccaccuaugaacccgacgucgaccugggcagcgggacgaggaauauuggaauagagucugagaucccuaaccuagauauuaucgguaagcgaauugagaaaaucaagcaggagcaugaaaccuccuggcacuacgaccaggaucacccauauaaaacaugggcguaccauggcucauaugagacuaagcagaccgggagcgcuucgucuauggugaauggaguugugcggcuccugacaaaacccugggacgucuugccgacugugacccaaauggcaaugacagauaccacuccuuucggccagcagcguguauuuaaggaaaagguggacacgagaacacaggagcccaaagaggguaccaagaaacugaugaagauaacugccgaauggcucuggaaagagcuugggaagaaaaagaccccacgcauguguacaagggaagaguucacgcggaagguuagaaguaacgcugcccugggagcaaucuuuaccgaugagaauaaauggaaguccgcccgcgaagcugucgaggacagcagguucugggaauuaguggauaaagagcgaaaccugcacuuggaaggcaagugcgagacuuguguguacaauaugaugggcaaacgggagaagaagcucggggaauuuggaaaagcgaaggguucaagagccauuugguacauguggcugggcgcaagguuccuagaguuugaagcucuuggguuccugaacgaggaccauugguuuucccgcgaaaauucucucagcggagucgagggcgagggucugcacaaauugggguauauccugcgugauguuaguaagaaagaaggaggcgccauguacgcagacgacacagccggcugggauacccggauuacucucgaggaccuuaagaacgaagagauggugacaaaucacauggaaggggagcauaagaaacuggcugaggccaucuucaaguuaaccuaucaaaacaaaguagugagaguccagaggccuacaccccgcggaacugugauggauauuauaucccgacgggaccagagagguagcggccaaguugggaccuacggacugaauacguuuaccaacauggaagcgcaguugaucaggcagauggagggcgaagguguguucaagaauauucagcaccucacagucacugaggagguggcaguacaaaacuggcuggcccgcguugggagagaacggcuaucuaggauggcuaucucaggagaugacugcguggucaaaccacuugaugaccguuucgccaacgcacugaccgcucucaaugauaugggcaagauccgaaaggacauucagcagugggagcccaguaaaggcuggaacgauuggacacaggugccuuuuugcucccaucacuuccaugaacugauaaugaaggacgggcgcguguuggucguuccauguagaaaucaagaugaguuaaucggacgggccaggauuagccagggugcuggcuggucucugcgcgaaacugccugccucgggaaaucguaugcacagauguggucacuuauguacuuucacagacgggaccugaggcuagcggccaacgcuaucuguagcgccgugccgucccacuggguacccaccagucgaacgacauggucuauucaugcaaagcacgaguggaugaccacugaggacaugcugacaguguggaaucgugucuggaucagagaaaacccuuggauggaggauaaaaccccaguggaaagcugggaggaaauacccuaucucggaaagcgcgaggaccaguggugcggcuccuugaucggucugacuucacgggcuaccugggccaagaauauucaagcagccaucaaccagguuaggagucuuauugggaaugaggaauacaucgauuacaugccuucuaugaaaagauuccgccgggaggaagaggaagcgggagugcugugguga

SEQ ID NO: 14801 - RNA, 9876 nt, Artificial Sequence
  derived and/or modified CDS sequence (opt3) from DENV-2__FJ410208__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucagcacaauuaccguccuggcuaccacacgcagauugcugguccauggcaucugggcaagcuagagauggacuucaacuuuugugaugggacaaccgugaucgucacugaagacugcggaaaucggggccccagccugcgaaccacaacugccucugggaagcucauuaccgaguggugcuguagauccugcacacugccgccucuuagguaucgcggagaggauggcuguugguacgguauggaaauacggccauugaaagagaaggaagagaaccuggugaauucauuaguuacggcggggcacggacaaguggacaacuucagucucggcguacuggguauggcccuuuuucuggaagagauguugagaaccagggucggcacuaaacaugcuauccuccugguggcagugagcuucgucacacuaauuaccgggaauaugucguuuaaggaucugggacgcguugugguaauggugggcgccacuaugacagacgauaucgggaugggagucaccuaucucgcucugcuugccgcauucaaagugcgacccacguuugcggccggcuugcuguuacggaagcucacuuccaaggagcugaugaugaccacaauugguaucguucuucugucucagagcaccauaccugaaacugugcuagagcucacagacgcucuggccuuggggaugaugguccugaaaaucgugcguaacauggaaaaguaccaguuagcaguuaccauuauggcuauccucugcgugcccaaugccgucauucugcagaacgcauggaaaguaucauguacaauccuugccgugguuaguguguccccacuguugcucacuucuagccaacagaagaccgauuggauaccucuggcucuaacgauuaaaggacugaaucccacagcgaucuuccuuaccacucucuccagaaccaacaagaaaaggucauggccacugaaugaggccaucauggcagucggcauggugagcauuuuggcuaguucucuguuaaagaacgacauaccgaugacaggcccucucguagccgggggacugcuuacugugugcuauguccugaccggucgcuccgccgacuuggaacucgagcgggcuacggauguuaagugggaggaccaggcagaaaucagcggcucgucacccauucugucuaucacaauuagugaggauggguccaugagcaucaaaaaugaagaggaggaacagacccuaacuauacugaucagaacaggacuucucgugauuucuggccuguuuccaaucagcauucccaucaccgccgcggcuugguacuugugggaggugaagaaacaaagggccggugucuuaugggacgugccuuccccacccccuauggggaaggcagaacuggaggauggagccuaucgaauaaaacagaagggcauucucggcuacucacagaucggggcuggaguuuacaaggaagguacuuuccacacaauguggcauguaacccgcggcgcagugcugaugcacaaagggaagcggaucgagccgaguugggccgacgucaaaaaggaucuuauuagcuauggaggcgguuggaaacuggagggggaauggaaggagggagaagaggugcagguuuuggcgcuagaaccaggcaagaaccccagagcugugcaaacgaaaccuggccuguuuaagacuaacaccgggacaaucggagccgucucucucgacuucuccccagguaccucaggcagucccauaauugauaaaaaggggaaagugguaggacuguacggcaauggugucgugacaaggagcggggcauauguuuccgccaucgcucagacugagaagucuauugaggacaacccugaaaucgaggaugacauauuucguaagcgccggcuuaccauuauggauuuacacccgggagccggcaaaacgaagagauaccugcccgcaaucgugagggaagcuaucaaacgaggccuccggacauugauucuggccccaacucgcgucguggcggccgagauggaagaggcacucagagggcugccuaucagguaucagacccccgcuauucgggccgagcauacaggacgagaaauaguugaccuuaugugucacgcuaccuucacuaugagacuguugucgccagugcgcgucccuaauuacaaccuaaucauuauggacgaggcacauuucaccgaucccgccagcaucgccgcuagggguuauaucucaacacguguggaaaugggcgaggcggcagggauuuuuaugacggccacuccaccgggaucccgggacccuuucccccaaaguaaugcuccaauaaucgaugaggaaagagagauucccgaaaggucuuggaacagcggccacgaguggguaaccgacuuuaaggguaaaacagugugguucguuccuuccaucaaggccgggaaugauauugcagccugccugcgcaagaacggaaaaaaggucauccagcucucacgaaaaaccuuugacucugaauacgugaagacuagaacaaaugauugggacuucguggucaccacggauauaagcgagaugggcgcuaacuuuaaagcggagcggguaaucgacccaaggcgcuguaugaagcccgugauuuuaacugauggcgaagagcguguuauccuggccgggccuaugccggugacacauaguuccgcagcucagagacggggaaggauuggucgcaauccaaaaaacgaaaaugaccaguacaucuauaugggcgagccccuugaaaacgacgaggauugcgcccacuggaaggaggcaaagaugcugcucgacaauauaaacaccccugaagggauuauccccagcauguucgagccagaacgagagaaagucgaugccauugacggagaauacagauugcggggcgaggcuaggaagaccuuuguggaucugaugcgcagaggugaccucccuguuuggcuggccuauaaaguggcggcagaggggaucaacuacgccgauaggcggugguguuucgacggcauaaagaauaaccaaauccuugaagagaauauggaagucgagauuuggacuaaagagggagaacguaagaagcuaaaaccccgcuggcuggaugcucgaaucuauucugacccauuggccuuaaaggaguuuaaagaauucgcugcaggcagaaagucacugacacucaaccugauuaccgagauggggaggcuuccuacauucaugacucagaaaacgcgggaugcccuggacaaucucgcuguguugcacaccgccgaagcaggaggucgcgcguacaaccaugcccuguccgagcuaccggagacacuggaaacucuccuucuguuaaccuugcuggcuacaguaaccggcgggaucuuucucuuccugaugaguggaagaggcauagguaagaugacucuugggaugugcugcauuaucacggccagcauccugcucugguaugcacagauucagccccacuggaucgcugccucgauaauuuuggaguuuuuccugaucguguuacuaauuccagaaccugagaagcaaaggaccccccaggauaaucagcugacauacguugucaucgcaauacucacugugguggccgcuaccauggcgaacgaaaugggcuuucuugagaaaacaaagaaagaccugggauugggcucuaucgccacccggcagccagaguccaauauucuggacaucgaucuccgaccugcaagcgcuuggacucuguacgccgucgccacaacguucguuacccccaugcuuagacauucaauugaaaacaguucugugaauguaucccucacugcaaucgcuaaccaagccacagugcugaugggguugggaaaggguuggccgcugagcaaaauggacauuggcgucccauuacuagcgaucggguguuauucacaggugaauccuauaacccugaccgcugcccuccuucuguugguugcacacuacgccauuaucggacccggccugcaggcuaaggcaacacgcgaggcccagaagagggcggcugccgguaucaugaaaaacccaacuguggaugggauuacggucauagaccucgaucccaucccuuaugacccgaaguuugaaaaacaacugggccagguaaugcuuuuagugcugugcguuacccaggugcucaugaugcggacaacuugggcauugugugaggcccugacccuagcuacaggacccauuaguacccugugggaaggcaauccagggcguuucuggaacacuacgaucgccgucagcauggcaaauauuuuuagaggauccuaccucgcuggcgccggucuucuguucucuaucaugaagaacacaaccaacacuaggcgcgggaccggaaauaugauagagacauugggcgagaaauggaagagccggcugaacgcgcucgguaaauccgaauuucaaaucuauaagaagucaggcauucaggagguggaucgaacucuggccaaagaagggaucaagagaggagagaccgaccaccaugcagucucuaggggcagugcuaaauuacgcugguucguggagcggaauaugguuacaccugaagggaaggugguagaucuuggaugcggcagagguggguggucguacuauuguggaggccugaaaaacgugcgugaggucaagggucucacgaagggcgggcccggacacgaagagccuauuccaaugagcaccuacggcuggaaucuaguuaggcugcaguccgggguggacgucuuuuucauccccccugaaaaaugcgauacuuugcugugugacauaggagagucuucaccaaaccccacaguggaggccggccggacccuccgcguacuuaaucugguggaaaacugguugaauaacaauacucaguucugcauuaagguucugaacccguacaugccuagcgugaucgagaaaauggaagcacuccaacgaaaguaugguggggcuuuagucagaaauccacuguccaggaacaguacacaugagauguacugggugucuaaugccagcggaaacaucgucucauccgugaacaugauuagucggaugcuuauaaaucgcuuuaccaugagacacaaaaaggccacguaugaacccgauguugaccugggcagcggcaccaggaacaucgggauugagucugagaucccuaaucuagacauuaucggaaagcgaauagaaaaaaucaagcaggagcaugaaacauccuggcacuacgaucaggaccacccauauaaaacuugggcguaccaugguucauaugagaccaagcagacaggcagcgcuucgucuaugguaaacggggugguccggcuccugacuaaacccugggauguguugccgaccguuacacaaauggcaaugaccgacacuacgccuuucggacagcagcguguguuuaaggaaaaggucgauacaagaacccaggagcccaaagagggcacuaagaaacugaugaagauuaccgccgaauggcucuggaaagagcuugguaagaaaaagacaccacgcauguguacgagggaagaguucacccggaaggugagaaguaaugcugcccugggggcaaucuuuacugacgagaacaaauggaaguccgcccgcgaagcuguagaggauagcagguucugggaauuaguggacaaagagcgaaaucugcacuuggaaggaaagugcgagacauguguuuacaacaugaugggcaaacgggagaagaagcucggcgaauuugggaaagcgaagggaucaagagccauuugguacauguggcugggugcaagguuccuagaguuugaagcucuuggcuuccugaaugaggaucauugguuuucccgcgaaaacucucucagcggggucgagggagagggccugcacaaauuggguuauauccugcgugacgugaguaagaaagaagggggagccauguacgcagaugacaccgccggcugggacacucggauuacacucgaggaucuuaagaaugaagagauggugaccaaccacauggaaggcgagcauaagaaacuggcugaggccauauucaaguuaacauaucaaaauaaagucguuagagugcagaggccuacuccccgcgggaccguaauggacaucauuucccgacgggaucagagaggaagcggucaagugggcacguacgggcugaacaccuuuacaaauauggaagcgcaguugaucaggcagauggagggagaaggcgucuucaagaacauccagcaccucacugugaccgaggagguugcagugaaaaacuggcuggcccgcgucgguagagaacggcuaucuaggauggcuauuucaggggacgauugcgugguaaagccacuugacgaucguuucgccaaugcacugacagcucucaacgacaugggaaagauacgaaaagauauccaacagugggagcccaguaagggcuggaaugacuggacucagguuccuuuuugcucccaucacuuccaugaacugauuaugaaagauggccgcguguuggucgugccauguagaaaccaggacgaguuaaucgggcgggccaggauuagccaaggagcugguuggucucugcgcgaaaccgccugccucggcaagucguaugcacagauguggucacuuauguacuuucacagacgggaucugaggcuagcggccaaugcuaucuguagcgccgugccgucccacuggguccccacgagucgaacaaccuggucuauacaugcaaaacacgaguggaugacuacagaggacaugcugaccguuuggaaccguguguggaucagagaaaauccuuggauggaggacaagacuccaguagaaagcugggaggaaauucccuaucucgggaagcgcgaggaucaguggugcggauccuugaucggccugaccucacgggcuacaugggccaaaaacauucaggcagccaucaaucaagugaggagucuuauagguaacgaggaauacacggacuacaugccuucuaugaagagauuccgccgggaggaagaggaagcggggguccugugguga

SEQ ID NO: 14802 - RNA, 9876 nt, Artificial Sequence
  derived and/or modified CDS sequence (opt3) from DENV-2__FJ461305__SS-prME
agcgcaggaaugaucauuaugcugauaccaaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaaaaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaaucgauaauuucagucucggcgugcuggguauggcccuuuuucuggaagagauguugaaaaccagaguaggcacuaagcaugcuauucuccuggucgcagugagcuucgugacacuaaucaccgggaacaugucguuuaaagaccugggaagggucguugugaugguaggcgccacuauggcugaugacauugggaugggagugacauaucucgcccugcuugcagcguucaagguccgccccaccuuugccgcuggcuugcuguuacgaaagcucacguccaaagagcugaugaugacuaccaucgguauagugcuucugucucagagcacaaucccugaaaccguucuagagcucacugaugcccuggcauuggggaugauggugcugaagauuguccggaauauggaaaaauaccaguuagcugugacaaucauggccauucucugcguucccaacgcagugauccugcagaaugccuggaaggucucauguaccauacuugcuguagugaguguuuccccacuguugcucacaucuagccaacagaaaacugacuggauuccucuggcgcuaaccaucaagggacugaaccccacggccaucuuccuuacaacccucucccguacuaauaaaaagagaucauggccacugaacgaggcaauuauggcugugggcauggucagcauauuggccaguucucuguuaaagaaugacaucccgaugaccggcccucucguggccgggggacugcuuacaguaugcuaugugcugacugguagguccgcugauuuggaacucgagcgcgcaaccgacgucaaaugggaggaucaggccgaaauuagcggcucgucacccauccugucuauuacgaucagugaggacggguccaugagcauaaagaacgaagaggaggaacagacacuaaccauccugauucggacuggacuucucguuaucucuggccuguuuccaauuagcauccccauaacagcggcugccugguacuugugggaggugaaaaagcaaagagccgguguguuaugggaugucccuuccccacccccuauggggaaagccgaacuggaggacggagcuuauaggauuaagcagaagggcauccucggcuacucacagaucggggcaggaguguacaaagaagguaccuuccacacuauguggcauguuacacgaggcgccguacugaugcacaaggggaaacgcauugagccgaguugggcggaugugaagaaagaccuuaucagcuauggaggcgguuggaagcuggagggggaauggaaggagggagaagagguccagguguuggcucuagaaccaggcaaaaauccccgggccguucaaaccaagccuggccuguuuaaaacgaacacugggaccauaggagcagugucucucgauuucuccccagguacaucaggcagucccauuaucgacaagaaagggaaggucgugggacuguacggcaacgguguagucaccagaagcggggccuauguguccgcuauugcccagacagagaagucuaucgaggauaauccugaaauagaggacgauauuuuuaggaaacgucgccuuacuaucauggacuuacacccgggagcaggcaagaccaaacgguaccugcccgcuaucguuagagaagccauuaagaggggccuccgaacguugauccuggcgccaacacggguggucgccgcagagauggaagaggcucuccgcgggcugccuauuagauaucagacucccgccauaagggcugagcauaccggacgggaaaucguggaccuuaugugucacgcaacauucaccaugcgacuguugucgccaguuagagugccuaacuacaaucuaauuaucauggaugaggcccauuucacugaccccgccagcaucgcugcgcgcgguuauauuucaaccagggucgaaaugggcgaggcagccgggauauuuaugacagcuacgccaccgggaucccgugauccuuucccccaaaguaacgccccaaucauugacgaggaacgggagauccccgaaagaucuuggaauagcggccacgagugggugacugauuuuaaagguaagaccguaugguucgugccuuccauuaaggcagggaacgacaucgccgcuugccugaggaaaaauggaaagaaaguuauacagcucucacgcaagacauuugauucugaauacgucaaaacccgaacuaacgacugggauuucguggugacaaccgacaucagcgagaugggcgcgaauuuuaaggccgagagagucauugauccacggagguguaugaaacccguaaucuuaacggacggcgaagaacgcgugauucuggcagggccuaugccgguuacucauaguuccgcugcccagcguagaggacggaucgguaggaacccaaagaaugaaaacgaccaguacauauauaugggcgagccccuugaaaaugaugaggacugcgcacacuggaaggaggccaaaaugcugcucgauaacauuaauacaccugaagggaucauucccagcauguucgagccagaacgcgagaagguggacgcuaucgauggagaauaccgauugagaggcgaggcccggaaaaccuuugucgaccugaugaggcgcggugaucucccuguguggcuggcguauaagguugcagccgaggggauaaacuacgcugacagaaggugguguuucgauggcaucaaaaacaaucaaauucuugaagagaacguggaagucgagaucuggaccaaggagggagaacggaagaaacuaaagccccguuggcuggacgcccgcauuuauucugauccauuggcuuuaaaagaguuuaaggaguucgcagccggccgaaaaucacugacucucaaucugaucacagagauggggagacuuccuaccuucaugacacagaagacuagggacgcucuggauaaccucgccguguugcacacggcagaagcgggaggucgggccuacaaucaugcucuguccgagcuaccggagacccuggaaacacuccuucuguuaacuuugcuggccaccguaacaggcgggauauuucucuuccugaugaguggacgcggcauugguaagaugacccuugggaugugcugcaucaucacugcaagcauucugcucugguaugcucagauccagccccacuggauagccgcaucgauuaucuuggaguuuuuccugauuguguuacuaaucccagaaccugagaaacaaagaacgccccaggacaaccagcugaccuacguugucauagccauccucacagugguggcugcgacuauggccaaugaaaugggcuuucuugagaagaccaaaaaggaccugggauugggcucuauugcaacacagcaaccagaguccaacauccuggauauugaccucaggccugcuagcgccuggacccuguacgccgucgcaacuacauucguuacgcccaugcuucggcauucaaucgaaaauaguucugugaacguaucccucaccgcuauugccaaucaggcgacugugcugaugggguugggaaaagguuggccgcugagcaagauggauaucggcgucccauuacuagcuauaggguguuauucacaggugaacccuauuacacugaccgccgcacuccuucuguugguugcccacuacgcuaucaucggacccggccugcaggcaaaggccacccgagaggcgcagaaaagagcugccgcagguauuaugaagaauccaacaguggacgggauaacugucaucgaucucgaccccauuccuuaugauccgaaauuugaaaagcagcugggccagguaaugcuuuuaauccugugcgugacgcaaguucucaugaugcgcaccacaugggccuugugugaggcucugacucuagccaccggacccauuaguacacugugggaaggcaacccagggagguucuggaauaccacuaucgcagugagcauggcuaacauauuucggggauccuaccucgccggcgcgggucuucuguucucuaucaugaaaaauacgacaaacacccguagagggacuggaaacaugggcgagaccuugggugagaaguggaaaagcaggcugaaugcccucggcaaguccgaauuucagauuuauaagaaaucagggauccaggaggucgaccgcacacuggcaaaggaaggaauuaaacggggcgagacugaucaccaugcugugucucgagggagugccaaguuaagaugguucgucgagaggaacauggugaccccugaaggaaaaguuguggaccuuggcugcggucgcgggggauggucguacuauuguggcggucugaagaauguacgggaggugaagggccucacaaaagggggacccggccacgaggaaccuaucccaaugagcacguacggguggaaccuagucagacugcaguccggaguugauguguuuuucauacccccugaaaagugcgacaccuugcugugugauauuggcgagucuucaccaaaucccacugucgaggcaggucguacacucagggugcuuaaccugguagaaaauugguugaacaauaacacccaauucugcaucaaagugcugaauccguacaugccuagcguuaucgagaagauggaagcucuccagcggaaauaugggggagccuuagugcgcaacccacugucccgaaauaguacucaugagauguacugggucucuaacgccagcggcaauauugugucauccgucaacaugauaaguagaaugcuuaucaacagguuuacaaugcggcacaagcgcgcgaccuaugaacccgacguggaccugggcagcgggacgagaaauauuggaaucgagucugagauuccuaaccuagauaucauagguaagaggaucgagaaaauuaagcaggagcaugaaaccuccuggcacuacgaccaggaucacccauauaaaacaugggcuuaccauggcucauaugagacuaagcaaaccgggagcgcaucgucuaugguuaauggaguagugcgacuccugacaaaacccugggacgucuugccgacugugacccagauggccaugacagauaccacuccuuucggccagcagcggguuuuuaaggaaaagguggacacgcguacacaagagcccaaagaggguaccaagaaacugaugaagaucacugcugaauggcucuggaaagagcuugggaagaaaaagaccccaagaauguguacacgcgaagaguucacgaggaagguccggaguaacgccgcacugggagccauuuuuaccgaugagaauaaauggaaguccgcuagagaagcgguggaggacagccgcuucugggaauuaguagauaaagagaggaaccugcacuuggaaggcaagugcgagacuuguguguacaauaugaugggcaaacgagagaagaagcucggggaauuuggaaaagccaaggguucacgggcaaucugguacauguggcugggcgcuagauuccuagaguuugaagcccuuggguuccugaacgaggaccauugguuuuccagggaaaauucucucagcggaguugagggcgagggucugcacaaauugggguauauucugcgcgaugucaguaagaaagaaggaggcgcaauguacgccgacgacacagcuggcugggauacccguauaacucucgaggaccuuaagaacgaagagauggugacaaaucacauggaaggggagcauaagaaacuggccgaggcgaucuucaaguuaaccuaucagaacaaagugguccggguucagagaccuacacccaggggaacugugauggauauuaucucccgccgagaccaacgggguagcggccagguagggaccuacggacugaauacguuuaccaacauggaagcacaguugaucagacagauggagggcgaagguguguucaagaauauucaacaccucacagucacugaggagguggccguucagaacuggcuggcuaggguggggcgcgaaagacuaucucggauggccauaucaggagaugacugcgucgugaaaccacuugaugacagguucgcaaacgcucugaccgcccucaaugauaugggcaagauccguaaggacauucagcagugggagcccaguaaaggcuggaacgauuggacacaaguaccuuuuugcucccaucacuuccaugaacugaucaugaaggacgggcgaguuuugguggucccaugucgcaaucaggaugaguuaauuggcagagcucggaucagccagggugccggcuggucucugagggaaacugcaugccucgggaaaucguaugcgcagauguggucacuuauguacuuucaccgcagagaccugcggcuagccgcuaacgccauauguagcgcagugccgucccacugggugcccaccaguaggacgacauggucuauccaugcuaagcacgaguggaugaccacugaggacaugcugacagucuggaaucgaguuuggauucgugaaaacccuuggauggaggauaaaaccccaguggaaagcugggaggaaauccccuaucucggaaagagagaggaccaauggugcggcuccuugauuggucugacuucacgcgccaccugggcaaagaauauccaggccgcgauaaaccagguacggagucuuauugggaaugaggaauacacagauuacaugccuucuaugaaaagguucagacgcgaggaagaggaagcuggagugcugugguga

SEQ ID NO: 14803 - RNA, 9876 nt, Artificial Sequence
  derived and/or modified CDS sequence (opt3) from DENV-2__FJ410215__SS-prME
agcgccggaaugaucauuaugcugauacccaccgugauggcuuuccaccucacaacuagaaacggggaaccucauaugaucgucggcauucaggaaaaggguaaaucccuucuguuuaagacggaggacggcguuaauaugugcaccuugauggcaauggauuuaggggaacugugugaggacacaaucacuuacaaaugcccacuucucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccgcuauggccgaugacaucgggaugggagucacuuaucucgcacugcuugcggccuucaaggugcgacccacauuugcugccggcuugcuguuacggaagcucaccuccaaagagcugaugaugacgacuauugguaucguucuucugucucaaagcaccauaccugaaacagugcuagagcucaccgaugcacuggcuuuggggaugaugguccugaagaucgugcguaauauggaaaaauaccaguuagccguuacuauuauggcaauccucugcgugcccaacgccgucauucugcagaaugcuuggaagguaucauguacaauccuugcggugguuaguguguccccacuguugcucaccucuagccagcaaaagacugacuggauaccucuggcccuaacuauuaagggacugaaccccaccgcaaucuuccuuacgacacucuccagaaccaauaaaaagaggucauggccacugaacgaggcuaucauggccgucggcauggugagcauuuuggccaguucucuguuaaagaaugacauaccgaugacuggcccucucguagcugggggacugcuuaccgugugcuauguccugacaggucgcuccgcagauuuggaacucgagcgggccacugacguuaaaugggaggaucaggcggaaaucagcggcucgucacccauucugucuaucaccauuagugaggacggguccaugagcaucaagaacgaagaggaggaacagacgcuaacaauacugaucagaaccggacuucucgugauuucuggccuguuuccaaucagcauucccaucacugcugccgcaugguacuugugggaggugaaaaagcagagggccggugucuuaugggaugugccuuccccacccccuauggggaaagcugaacuggaggacggagcauaucgaauaaagcaaaagggcauucucggcuacucacagaucggggccggaguuuacaaagaagguacauuccacaccauguggcauguaacucgcggcgcggugcugaugcacaaggggaaacggaucgagccgaguugggcugaugucaagaaagaccuuauuagcuauggaggcgguuggaagcuggagggggaauggaaggagggagaagaggugcagguuuuggcccuagaaccaggcaaaaaucccagagcagugcagacaaagccuggccuguuuaaaaccaacacggggacuaucggagccgucucucucgauuucuccccagguaccucaggcagucccauaauugacaagaaagggaaggugguaggacuguacggcaacggugucgugacaaggagcggggcuuauguuuccgccaucgcacaaaccgagaagucuauugaggauaauccugaaaucgaggacgauauauuucguaaacgccggcuuacaauuauggacuuacacccgggagcuggcaagacuaaaagauaccugcccgccaucgugagggaagcgaucaagcgaggccuccggaccuugauucuggccccaacgcgcgucguggcagcugagauggaagaggcccucagagggcugccuaucagguaucagacacccgcuauucgggcagagcauacuggacgagaaauaguugaccuuaugugucacgccaccuucacaaugagacuguugucgccagugcgcgucccuaacuacaaucuaaucauuauggaugaggcccauuucaccgaccccgcuagcaucgcggcaagggguuauaucucaacucguguggaaaugggcgaggccgcugggauuuuuaugaccgccacaccaccgggaucccgggauccuuucccccagaguaacgcaccaauaaucgacgaggaaagagagauucccgaaaggucuuggaauagcggccacgaguggguaacggauuuuaaagguaagacugugugguucguuccuuccaucaaggccgggaacgacauugcugcgugccugcgcaaaaauggaaagaaagucauccaacucucacgaaagaccuuugauucugaauacgugaaaacaagaaccaacgacugggauuucguggucacuacagacauaagcgagaugggcgccaauuuuaaggcagagcggguaaucgauccaaggcgcuguaugaaacccgugauuuuaaccgacggcgaagaacguguuauccuggcugggccuaugccggugacgcauaguuccgccgcacagagacggggaaggauuggucgcaacccaaagaaugaaaacgaccaguacaucuauaugggcgagccccuugaaaaugaugaggacugcgcccacuggaaggaggcuaaaaugcugcucgauaacauaaauacuccugaagggauuauccccagcauguucgagccagaacgagagaaggucgacgccauugauggagaauacagauugcggggcgaggcgaggaaaacauuuguggaccugaugcgcagaggugaucucccuguuuggcuggcauauaagguggccgcugaggggaucaacuacgccgacaggcggugguguuucgauggcaucaaaaacaaucagauccuugaagagaacgucgaaguggagauuuggaccaaggagggagaacguaagaaacuaaagccccgcuggcuggacgcucgaaucuauucugauccauuggcauuaaaagaguuuaaggaguucgccgcuggcagaaaaucacugacccucaaucugauuacugagauggggaggcuuccuacauucaugacccaaaagacacgggacgcccuggauaaccucgcaguauugcacacugcggaagccggaggucgcgcuuacaaucaugcccuguccgagcuaccggagacgcuggaaacccuccuucuguuaacauugcuggcaacugugaccggcgggaucuuucucuuccugaugaguggaagaggcauagguaagaugacacuugggaugugcugcauuaucaccgcuagcauccugcucugguaugcccagauucagccccacuggaucgcagccucgauaauuuuggaguuuuuccugaucguuuuacuaauuccagaaccugagaaacagaggacuccccaagacaaccagcugacguacgucgugaucgcuauacucaccguggucgcggccacaauggcaaaugaaaugggcuuucuugagaagacuaaaaaggacuucggacugggcucuaucgcuacccagcagccagaguccaacauuuuggauaucgaccugcggccugccagcgccuggacacucuacgcaguugcuaccacuuuugugacacccaugcugcgacauucaauugaaaauaguucuguaaacgugucccuuacggccaucgcgaaucaagcuaccguccucauggggcugggaaaagguuggccguugagcaagauggauauuggcgugccacuguuagccaucggguguuauucacagguuaacccuauaacucuaacagcagcccugcuccuucugguggcucacuacgcaauuaucggacccggcuugcaggccaaggcgaccagagaggcucagaaacgcgccgcagccgguaucaugaagaauccaaccgucgacgggauuacaguaauagaucuggaccccaucccuuaugauccgaaauucgaaaagcaacucggccaggugaugcugcuuauuuuaugcguuacucaggugcugaugaugaggacgaccugggcucucugugaggccuugacacuggcaacuggacccaucaguacccuaugggaaggcaacccagggcgguuuuggaauacaaccauugcugucagcauggccaacaucuuccguggauccuaccuggcgggcgccggucuccuauuuucuauaaugaaaaauacuacgaacacaagaagggggaccggaaacaucggcgagacucugggugagaaguggaaaagccgcuugaaugcacugggcaaguccgaguuccaaaccuauaagaaaucagggauucaggagguggaccggacacucgcuaaggaaggaaucaaacgaggcgagacugaucaccaugccgucucuagagggagugcaaagcugaggugguuuguggagcgcaacaugguuaccccugaaggaaaagugguagacuuaggcugcgguagagggggauggucguacuauuguggcggucuuaagaaugugagagaggucaagggccugacaaaagggggacccggccacgaagaaccuauuccaaugagcacguacggguggaaccucguucgucuacaguccggaguggaugucuucuucauacccccugaaaagugcgacacccuguugugugauauaggcgagucuucaccaaaucccacuguggaggcugguaggacacugcggguacucaaccuuguggaaaauuggcugaacaauaacacccaguuuugcauuaaaguuuugaauccguacaugccuagcgugaucgagaagauggaagcccugcaacgcaaauaugggggagcccucguccgaaacccauuauccagaaauaguacucaugagauguacugggugucuaacgcgagcggcaauaucgucucauccgugaacaugauuaguaggaugcugauaaaccgguucacaaugcgccacaagaaggcuaccuaugaacccgacguugaccuuggcagcgggacgagaaauaucggaauugagucugagaucccuaaccuggauauuaucgguaaaaggauagaaaagaucaaacaggagcaugaaaccuccuggcacuacgaccaggaucacccauauaagacaugggcauaccauggcucauaugagacuaaacagaccgggagcgccucgucuaugguaaauggagugguccgacuacucacaaagcccugggacgugcugccgacuguuacccaaauggcuaugacagauaccacuccuuuuggccagcagcggguguucaaggaaaaagucgacacgcguacacaggagcccaaggaggguaccaaaaaguugaugaaaauuacugccgaauggcuguggaaggagcucgggaaaaagaagaccccaagaauguguacacgcgaagaguuuacgaggaaagugcggaguaacgcagcccuuggagcuaucuucaccgaugagaauaaguggaaauccgcgagagaagccguagaggacagccgcuuuugggaacugguggauaaggagaggaacuuacaccuggaaggcaaaugcgagacuuguguuuacaauaugaugggcaagcgagagaagaaauugggggaguucggaaaggcaaaagguucacgggcuauuugguacauguggcucggcgccagauuucuggaguucgaagcacuaggguuucuuaacgaggaccauugguucuccagggaaaauucucugagcggagucgagggcgagggucuccacaagcugggguauaucuugcgcgaugugaguaaaaaggaaggaggcgccauguacgcugacgacacagccggcugggauacccguauuacucuggaggaccucaagaacgaagagauggugacaaaucacauggaaggggagcauaagaaacuugcggaggcaauauuuaaacugaccuaucaaaacaaagucguucgggugcagagaccuacacccaggggaacuguaauggauaucauuucccgccgagaccagcgggguagcggccaaguggggaccuacggauuaaauacguucaccaacauggaagcccagcugaucagacagauggagggcgaaggugucuucaaaaauauccagcacuugacagugacugaggagguugcugugcaaaacuggcucgccagggucgggcgcgaaagacugucucggauggcaauuucaggagaugacugcgugguaaagccacuagaugacagguuugcuaacgcccuuaccgcucugaaugauaugggcaagauacguaaagacauccagcagugggagcccaguaagggcuggaacgauuggacacagguuccuuucugcucccaucacuuucaugaacucauuaugaaagacgggcgagugcuggucgugccaugucgcaaucaagaugaguugaucggacgggcccggauuagccagggugcaggcuggucuuuaagggaaacugcgugccuggggaagucguaugcccagauguggucacucauguacuuccaccgcagagaccuucggcuggcugccaacgcaaucuguagcgcugugccgucccacuggguccccaccaguaggacgacauggucuauacaugccaaacacgaguggaugaccacugaggacaugcuaacaguuuggaaucgaguguggauccgugaaaacccuuggauggaggauaagaccccaguagaaagcugggaggaaauucccuaucugggaaagagagaggaccaguggugcggcucccucaucgguuugacuucacgcgcaaccugggccaaaaauauucaagcggcuaucaaccaggugcggagucugauagggaaugaggaauacacagauuacaugccuucuaugaagagguuuagacgcgaggaagaggaagccggaguccuuugguga

SEQ ID NO: 14804 - RNA, 9876 nt, Artificial Sequence
  derived and/or modified CDS sequence (opt3) from DENV-2__FJ461309__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugaaaaccagagucggcacuaagcaugcuauccuccugguggcagugagcuucgucacacuaauuaccgggaacaugucguuuaaagaccugggaaggguugugguaauggugggcgccacuauggcugaugacaucgggaugggagucacauaucucgcccugcuugcagcguucaaggugcgccccaccuuugccgcuggcuugcuguuacgaaagcucacguccaaagagcugaugaugacuaccauugguaucguucuucugucucagagcacaauaccugaaaccgugcuagagcucacugaugcccuggcauuggggaugaugguccugaagaucgugcggaauauggaaaaauaccaguuagcuguuacaauuauggccauccucugcgugcccaacgcagucauucugcagaaugccuggaagguaucauguaccauccuugcugugguuaguguguccccacuguugcucacaucuagccaacagaaaacugacuggauaccucuggcgcuaaccauuaagggacugaaccccacggccaucuuccuuacaacccucucccguacuaauaaaaagagaucauggccacugaacgaggcaaucauggcugucggcauggugagcauuuuggccaguucucuguuaaagaaugacauaccgaugaccggcccucucguagccgggggacugcuuacagugugcuauguccugacugguagguccgcugauuuggaacucgagcgcgcaaccgacguuaaaugggaggaucaggccgaaaucagcggcucgucacccauucugucuaucacgauuagugaggacggguccaugagcaucaagaacgaagaggaggaacagacacuaaccauacugauccggacuggacuucucgugauuucuggccuguuuccaaucagcauucccaucacagcggcugccugguacuugugggaggugaaaaagcaaagagcaggugucuuaugggaugugccuuccccacccccuauggggaaagccgaacuggaggacggagcuuauaggauaaagcagaagggcauucucggcuacucacagaucggggcaggaguuuacaaagaagguaccuuccacacuauguggcauguaacacgaggcgccgugcugaugcacaaggggaaacgcaucgagccgaguugggcggaugucaagaaagaccuuauuagcuauggaggcgguuggaagcuggagggggaauggaaggagggagaagaggugcagguuuuggcucuagaaccaggcaaaaauccccgggccgugcaaaccaagccuggccuguuuaaaacgaacacugggaccaucggagcagucucucucgauuucuccccagguacaucaggcagucccauaauugacaagaaagggaaggugguaggacuguacggcaacggugucgugaccagaagcggggccuauguuuccgcuaucgcccagacagagaagucuauugaggauaauccugaaaucgaggacgauauauuuaggaaacgucgccuuacuauuauggacuuacacccgggagcaggcaagaccaaacgguaccugcccgcuaucgugagagaagccaucaagaggggccuccgaacguugauucuggcgccaacacgggucguggccgcagagauggaagaggcucuccgcgggcugccuaucagauaucagacucccgccauuagggcugagcauaccggacgggaaauaguugaccuuaugugucacgcaacauucaccaugcgacuguugucgccagugagagucccuaacuacaaucuaaucauuauggaugaggcccauuucacugaccccgccagcaucgcugcgcgcgguuauaucucaaccaggguggaaaugggcgaggcagccgggauuuuuaugacagcuacgccaccgggaucccgugauccuuucccccaaaguaacgccccaauaaucgacgaggaacgggagauucccgaaagaucuuggaauagcggccacgaguggguaacugauuuuaaagguaagaccgugugguucguuccuuccaucaaggcagggaacgacauugccgcuugccugaggaaaaauggaaagaaagucauccagcucucacgcaagacauuugauucugaauacgugaaaacccgaacuaacgacugggauuucguggucacaaccgacauaagcgagaugggcgcgaauuuuaaggccgagagaguaaucgauccacggagguguaugaaacccgugauuuuaacggacggcgaagagcgcguuauccuggcagggccuaugccggugacucauaguuccgcugcccagcguagaggacggauugguaggaacccaaagaaugaaaacgaccaguacaucuauaugggcgagccccuugaaaaugaugaggacugcgcacacuggaaggaggccaaaaugcugcucgauaacauaaauacaccugaagggauuauccccagcauguucgagccagaacgcgagaaggucgacgcuauugauggagaauaccgauugagaggcgaggcccggaaaaccuuuguggaccugaugaggcgcggugaucucccuguuuggcuggcguauaagguggcagccgaggggaucaacuacgcugacagaaggugguguuucgauggcauaaaaaacaaucaaauccuugaagagaacgucgaaguggagauuuggaccaaggagggagaacggaagaaacuaaagccccguuggcuggacgcccgcaucuauucugauccauuggcuuuaaaagaguuuaaggaauucgcagccggccgaaaaucacugacucucaaucugauuacagagauggggagacuuccuaccuucaugacacagaagacuagggacgcucuggauaaccucgccguauugcacacggcagaagcgggaggucgggccuacaaucaugcucuguccgagcuaccggagacccuggaaacacuccuucuguuaacuuugcuggccaccgugacaggcgggaucuuucucuuccugaugaguggacgcggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaaacaaagaacgccccaggacaaccagcugaccuacgucgugaucgccauacucacaguggucgcugcgacuauggccaaugaaaugggcuuucuugagaagaccaaaaaggaccugggauugggcucuaucgcaacacagcaaccagaguccaacauucuggauaucgaccucaggccugcuagcgccuggacccuguacgccguugcaacuacauucgugacgcccaugcuucggcauucaauugaaaauaguucuguaaacgugucccucaccgcuaucgccaaucaggcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaggccacccgagaggcgcaaaaaagagcugccgcagguaucaugaagaauccaacagucgacgggauuacuguaauagaucucgaccccaucccuuaugauccgaaauuugaaaagcagcugggccaggugaugcuuuuaauucugugcguuacgcaagugcucaugaugcgcaccacaugggccuugugugaggcucugacucuagccaccggacccaucaguacacugugggaaggcaacccagggagguucuggaauaccacuauugcagucagcauggcuaacaucuuucggggauccuaccucgccggcgcgggucuucuguucucuauaaugaaaaauacgacaaacacccguagagggacuggaaacaugggcgagaccuugggugagaaguggaaaagcaggcugaaugcccucggcaaguccgaauuucagaucuauaagaaaucagggauucaggagguggaccgcacacuggcaaaggaaggaaucaaacggggcgagacugaucaccaugcugucucucgagggagugccaaguuaagaugguucguggagaggaacaugguuaccccugaaggaaaagugguagaccuuggcugcggucgcgggggauggucguacuauuguggcggucugaagaaugugcgggaggucaagggccucacaaaagggggacccggccacgaagagccuauuccaaugagcacguacggguggaaccuaguuagacugcaguccggaguggaugucuuuuucauccccccugaaaagugcgacaccuugcugugugauauaggcgagucuucaccaaaucccacuguggaggcaggucguacacucaggguacuuaaccugguggaaaauugguugaacaauaacacccaauucugcauuaaaguucugaauccguacaugccuagcgugaucgagaagauggaagcucuccagcggaaauaugggggagccuuaguccgcaacccacugucccgaaauaguacucaugagauguacugggugucuaacgccagcggcaauaucgucucauccgugaacaugauuaguagaaugcuuauaaacagguuuacaaugcggcacaagaaggcgaccuaugaacccgacguugaccugggcagcgggacgcgcaauaucggaauugagucugagaucccuaaccuagauauuaucgguaaaagaauagaaaagaucaaacaggagcaugaaaccuccuggcacuacgaccaggaucacccauauaagacaugggcuuaccauggcucauaugagacuaaacaaaccgggagcgcaucgucuaugguaaauggaguggucaggcuccugacaaagcccugggacguguugccgacuguuacccagauggccaugacagauaccacuccuuucggccagcagcgaguguuuaaggaaaaagucgacacgcggacacaagagcccaaggaggguaccaaaaagcugaugaaaauuacugcugaauggcucuggaaggagcuugggaaaaagaagaccccacguauguguacaagagaagaguucacgcgcaaagugaggaguaacgccgcacugggagccaucuuuaccgaugagaauaaguggaaauccgcucgggaagcgguagaggacggcagauucugggaauuaguggauaaggagcgcaaccugcacuuggaaggcaaaugcgagacuuguguuuacaauaugauggggaagagggagaagaaacucggagaauuugguaaggccaaaggcagccgagcaauuugguacauguggcugggggcucgguuccuagaguuugaagcccuuggauuccugaacgaggaccauugguuuucaagagaaaauucccucucuggcgucgagggugaggggcugcacaaguugggauauauccugagggaugugagcaaaaaggaaggcggcgcaauguacgccgacgacacagcugggugggauacccgcauuacucucgaggaccuuaagaacgaagagauggugacaaaucacauggaaggagagcauaaaaagcuggccgaggcgauauucaaauuaaccuaucagaacaaggucguucgugugcagcggccuacacccagagguacuguaauggauaucauuaguaggcgcgaccaacgaggcuccgggcaggugggaaccuacggccugaauacguuuaccaacauggaagcacaguugauccggcagauggagggugaaggggucuucaaaaauauccaacaccucacagugacugaggagguugccgugcagaacuggcuggcuagagucggaagggaacgccuaagcagaauggccauuucuggcgaugacugcgugguaaagccacuugaugaccgguucgcaaacgcucugaccgcccucaaugauaugggcaagauaaggaaagacauccagcagugggagcccucaaagggguggaacgauuggacacaaguuccuuuuugcagucaucacuuccaugaacugauuaugaaagacggacguguguuggucgugccaugucgaaaucaggaugaguuaaucggucgcgcuagaauuucccagggcgccggguggagccugcgggaaacugcaugccucggaaagucuuaugcgcagauguggucgcuuauguacuuucacaggcgcgaccugagacuagccgcuaacgccaucuguucagcagugccgagccacuggguccccaccucccggacgacauggaguauacaugcuaaacacgaguggaugaccacugaggacaugcugacaguuuggaauaggguguggauccgagaaaacccuuggauggaggauaagaccccaguagaaucuugggaggaaauucccuaucucggcaagcgugaggaccaauggugcgguagcuugaucgggcugacuuccagagccaccugggcaaaaaauauucaggccgcgaucaaccaggugcgcucacuuauaggaaaugaggaauacacagauuacaugccuaguaugaagcgguucaggagagaggaagaggaagcuggcguccugugguga

SEQ ID NO: 14805 - RNA, 9876 nt, Artificial Sequence
  derived and/or modified CDS sequence (opt3) from DENV-2__FJ461311__SS-prME
agcgccggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguggcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucagcacaauuaccguccuggcuaccacacgcagauugcugguccauggcaucugggcaagcuagagauggacuucaacuuuugugaugggacaaccgugaucgucacugaagacugcggaaaucggggccccagccugcgaaccacaacugccucugggaagcucauuaccgaguggugcuguagauccugcacacugccgccucuuagguaucgcggagaggauggcuguugguacgguauggaaauacggccauugaaagagaaggaagagaaccugguaaauucauuaguuacggcggggcacggacaaguggacaacuucagucucggcguacuggguauggcccuuuuucuggaagagauguugagaaccagggucggcacuaaacaugcuauccuccugguggcagugagcuucgucacacuaauuaccgggaauaugucguuuaaggaucugggacgcguugugguaauggugggcgccacuaugacagacgauaucgggaugggagucaccuaucucgcucugcuugccgcauucaaagugcgacccacguuugcggccggcuugcuguuacggaagcucacuuccaaggagcugaugaugaccacaauugguaucguucuucugucucagagcaccauaccugaaacugugcuagagcucacagacgcucuggccuuggggaugaugguccugaaaaucgugcguaacauggaaaaguaccaguuagcaguuaccauuauggcuauccucugcgugcccaaugccgucauucugcagaacgcauggaaaguaucauguacaauccuugccgugguuaguguguccccacuguugcucacuucuagccaacagaagaccgauuggauaccucuggcucuaacgauuaaaggacugaaucccacagcgaucuuccuuaccacucucuccagaaccaacaagaaaaggucauggccacugaaugaggccaucauggcagucggcauggugagcauuuuggcuaguucucuguuaaagaacgacauaccgaugacaggcccucucguagccgggggacugcuuacugugugcuauguccugaccggucgcuccgccgacuuggaacucgagcgggcuacggauguuaagugggaggaccaggcagaaaucagcggcucgucacccauucugucuaucacaauuagugaggauggguccaugagcaucaaaaaugaagaggaggaacagacccuaacuauacugaucagaacaggacuucucgugauuucuggccuguuuccaaucagcauucccaucaccgccgcggcuugguacuugugggaggugaagaaacaaagggccggugucuuaugggacgugccuuccccacccccuauggggaaggcagaacuggaggauggagccuaucgaauaaaacagaagggcauucucggcuacucacagaucggggcuggaguuuacaaggaagguacuuuccacacaauguggcauguaacccgcggcgcagugcugaugcacaaagggaagcggaucgagccgaguugggccgacgucaaaaaggaucuuauuagcuauggaggcgguuggaaacuggagggggaauggaaggagggagaagaggugcagguuuuggcgcuagaaccaggcaagaaccccagagcugugcaaacgaaaccuggccuguuuaagacuaacaccgggacaaucggagccgucucucucgacuucuccccagguaccucaggcagucccauaauugauaaaaaggggaaagugguaggacuguacggcaauggugucgugacaaggagcggggcauauguuuccgccaucgcucagacugagaagucuauugaggacaacccugaaaucgaggaugacauauuucguaagcgccggcuuaccauuauggauuuacacccgggagccggcaaaacgaagagauaccugcccgcaaucgugagggaagcuaucaaacgaggccuccggacauugauucuggccccaacucgcgucguggcggccgagauggaagaggcacucagagggcugccuaucagguaucagacccccgcuauucgggccgagcauacaggacgagaaauaguugaccuuaugugucacgcuaccuucacuaugagacuguugucgccagugcgcgucccuaauuacaaccuaaucauuauggacgaggcacauuucaccgaucccgccagcaucgccgcuagggguuauaucucaacacguguggaaaugggcgaggcggcagggauuuuuaugacggccacuccaccgggaucccgggacccuuucccccaaaguaaugcuccaauaaucgaugaggaaagagagauucccgaaaggucuuggaacagcggccacgaguggguaaccgacuuuaaggguaaaacagugugguucguuccuuccaucaaggccgggaaugauauugcagccugccugcgcaagaacggcaagaaggucauccagcucucacgaaaaaccuuugacucugaauacgugaagacuagaacaaaugauugggacuucguggucaccacggauauaagcgagaugggcgcuaacuuuaaagcggagcggguaaucgacccaaggcgcuguaugaagcccgugauuuuaacugauggcgaagaacguguuauccuggccgggccuaugccggugacacauaguuccgcagcucagagacggggaaggauuggucgcaaucccaaaaacgaaaaugaccaguacaucuauaugggcgagccccuugaaaacgacgaggauugcgcccacuggaaggaggcaaagaugcugcucgacaauauaaacaccccugaagggauuauccccagcauguucgagccagaacgagagaaagucgaugccauugacggagaauacagauugcggggcgaggcuaggaagaccuuuguggaucugaugcgcagaggugaccucccuguuuggcuggccuauaaaguggcggcagaggggaucaacuacgccgauaggcggugguguuucgacggcauaaagaauaaccaaauccuugaagagaauauggaagucgagauuuggacuaaagagggagaacguaagaagcuaaaaccccgcuggcuggaugcucgaaucuauucugacccauuggccuuaaaggaguuuaaagaguucgcugcaggcagaaagucacugacacucaaccugauuaccgagauggggaggcuuccuacauucaugacucagaaaacgcgggaugcccuggacaaucucgcuguguugcacaccgccgaagcaggaggucgcgcguacaaccaugcccuguccgagcuaccggagacacuggaaacucuccuucuguuaaccuugcuggcuacaguaaccggcgggaucuuucucuuccugaugaguggaagaggcauagguaagaugacucuugggaugugcugcauuaucacggccagcauccugcucugguaugcacagauucagccccacuggaucgcugccucgauaauuuuggaguuuuuccugaucguguuacuaauuccagaaccugagaagcaaaggaccccacaggauaaucagcugacauacguugucaucgcaauacucacugugguggccgcuaccauggcgaacgaaaugggcuuucuugagaaaacaaagaaagaccugggauugggcucuaucgccacccggcagccagaguccaauauucuggacaucgaucuccgaccugcaagcgcuuggacucuguacgccgucgccacaacguucguuacccccaugcuuagacauucaauugaaaacaguucugugaauguaucccucacugcaaucgcuaaccaagccacagugcugaugggguugggaaaggguuggccgcugagcaaaauggacauuggcgucccauuacuagcgaucggguguuauucacaggugaauccuauaacccugaccgcugcccuccuucuguugguugcacacuacgccauuaucggacccggccugcaggcuaaggcaacacgcgaggcccagaagagggcggcugccgguaucaugaaaaacccaacuguggaugggauuacggucauagaccucgaucccaucccuuaugacccgaaguuugaaaaacaacugggccagguaaugcuuuuagugcugugcguuacccaggugcucaugaugcggacaacuugggcauugugugaggcccugacccuagcuacaggacccauuaguacccugugggaaggcaauccagggcguuucuggaacacuacgaucgccgucagcauggcaaauauuuuuagaggauccuaccucgcuggcgccggucuucuguucucuaucaugaagaacacaaccaacacuaggcgcgggaccggaaauaugggcgagacauugggugagaaauggaaaagccaacugaacgcgcucggcaaauccgaauuucagauauauaagaagucagggauccaggagguggaucggacucuggccaaagaaggaauuaagcgaggcgagaccgaccaccaugcagucucuagagggagugcuaaauuaaggugguucguggagcgcaauaugguuacaccugaaggaaaggugguagaucuuggcugcgguagagggggauggucguacuauuguggcggucugaaaaacgugagagaggucaagggccucacgaaagggggacccggccacgaggaaccuaucccaaugagcaccuacggguggaaucuaguucgucugcaguccggaguggacgucuuuuucauucccccugaaaaaugcgauacuuugcugugugacaucggcgagucuucaccaaaccccacaguggaggccgguaggacccuccggguacuuaaucugguggaaaacugguugaauaacaauacucaauucugcauaaagguucugaacccguacaugccuagcgugauugagaaaauggaagcacuccagcgcaaguaugggggagcuuuaguccgaaauccacuguccagaaacaguacacaugagauguacugggugucuaaugccagcggcaacaucgucucauccgugaacaugaucaguaggaugcuuauuaaucgguuuaccaugcgccacaaaaaggccacguaugaacccgauguugaccugggcagcgggaccagaaacauaggaaucgagucugagauuccuaaucuagacaucauugguaagaggaucgagaaaauaaagcaggagcaugaaacauccuggcacuacgaucaggaccacccauauaaaacuugggcguaccauggcucauaugagaccaagcaaacagggagcgcuucgucuaugguaaacggagugguccgacuccugacuaaacccugggauguguugccgaccguuacacagauggcaaugaccgacacuacgccuuucggccagcagcggguguuuaaggaaaaggucgauacacguacccaagagcccaaagaggguacuaagaaacugaugaagaucaccgccgaauggcucuggaaagagcuugggaagaaaaagacaccaagaauguguacgcgcgaagaguucaccaggaaggugcggaguaaugcugcccugggagcaauuuuuacugacgagaacaaauggaaguccgccagagaagcuguagaggauagccgcuucugggaauuaguggacaaagagaggaaucugcacuuggaaggcaagugcgagacauguguuuacaacaugaugggcaaacgagagaagaagcucggggaauuuggaaaagcgaaggguucacgggccaucugguacauguggcugggcgcaagauuccuagaguuugaagcucuuggguuccugaaugaggaucauugguuuuccagggaaaacucucucagcggagucgagggcgagggucugcacaaauugggguauauucugcgcgacgugaguaagaaagaaggaggcgccauguacgcagaugacaccgccggcugggacacucguaucacacucgaggaucuuaagaaugaagagauggugaccaaccacauggaaggggagcauaagaaacuggcugaggccauuuucaaguuaacauaucagaauaaagucguucgggugcagagaccuacucccaggggaaccguaauggacauaaucucccgccgagaucaacgggguagcggccagguggggacguacggacugaacaccuuuacaaauauggaagcgcaguugauuagacagauggagggcgaaggugucuucaagaacauccaacaccucacugugaccgaggagguugcagugaaaaacuggcuggccagggucgggcgcgaaagacuaucucggauggcuaucucaggagacgauugcgugguaaagccacuugacgauagguucgccaaugcacugacagcucucaacgacaugggcaagauucguaaagauauacagcagugggagcccaguaagggcuggaaugacuggacucagguuccuuuuugcucccaucacuuccaugaacugaucaugaaagaugggcgaguguuggucgugccaugucgcaaccaagacgaguuaauugguagagcccggaucagccagggagcuggcuggucucugagggaaaccgccugccucgggaagucguaugcacagauguggucacuuauguacuuucaccgcagagaucugcggcuagcggccaaugcuauuuguagcgccgugccgucccacuggguccccacgaguaggacaaccuggucuauccaugcaaaacacgaguggaugacuacagaggacaugcugaccguuuggaaccgaguguggauacgugaaaauccuuggauggaggacaagacuccaguagaaagcugggaggaaauccccuaucucggaaagagagaggaucaguggugcggcuccuugauuggucugaccucacgcgcuacaugggccaaaaacauccaagcagccauuaaucaggugcggagucuuaucgggaacgaggaauacacggacuacaugccuucuaugaagagguucagacgcgaggaagaggaagcgggaguccugugguga

SEQ ID NO: 14806 - RNA, 9876 nt, Artificial Sequence
  derived and/or modified CDS sequence (opt3) from DENV-2__FJ410217__SS-prME
agcgcaggaaugaucauuaugcugauaccaaccgugauggcuuuccaccucacaacuagaaacggggaaccucauaugaucgucggcauucaggaaaaggguaaaucccuucuguuuaagacggaagacggaguuaauaugugcaccuugauggcaauggauuuaggggaacugugugaagacacaaucacuuacaaaugcccacuucucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguuguaucgucucuuggaagaauaaggagcugaaaugcgggucaggaauuuucgugacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucacauaaccagaccuucuugauugacgggccggagacugccgagugccccaauacaaacagagcauggaauagucuggaaguggaggauuauggauuuggcguguucaccacaaacaucuggcucaggcugaaggaaaaacaggacgcguuuugugacucuaaguuaaugagcgcugccauuaaggauaaucgugcaguacacgccgacauggguuacuggaucgaguccgcucugaacgauacuuggaaaauagagaaggccucauucauugaagucaaaaauugccauuggccuaagagccacacccuuuggucuaacgggguguuggaguccgaaaugaucauccccaagaaccucgcaggacccguuagucaacacaauuaucggccuggcuaccauacgcagauugcugguccauggcaccugggcaagcuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaccggggagaggacggcuguugguaugguauggaaauaagaccauugaaagagaaggaagagaaucuggugaacucauuaguuacggcggggcauggacagguggauaauuucagucucggcguacuggguauggcccuuuuucuggaagagauguugaggacccgcgucggcacuaaacacgcuauccuccugguggcagugagcuucgucacacuaauuaccgggaacaugucguuuaaggaccugggacgaguugugguaauggugggcgccacuauggcugaugacaucgggaugggagucacauaccucgcccugcuugcagcguucaaagugcggcccaccuuugccgcuggcuugcuguuacguaagcucacguccaaggagcugaugaugacuaccauugguaucguucuucugucucaaagcacaauaccugaaaccgugcuagagcucacugaugcccuggcauuggggaugaugguccugaaaaucgugagaaauauggaaaaguaucaguuagcuguuacaauuauggccauccucugcgugcccaacgcagucauucugcagaaugccuggaaaguaucauguaccauccuugcugugguuaguguguccccacuguugcucacaucuagccagcaaaagacugacuggauaccucuggcgcuaaccauuaaaggacugaaccccacggccaucuuccuuacaacccucuccaggacuaauaagaaacgcucauggccacugaacgaggcaaucauggcugucggcauggugagcauuuuggccaguucucuguuaaagaaugacauaccgaugaccggcccucucguagccgggggacugcuuacagugugcuacguccugacuggucgguccgcugauuuggaacucgagagagcaaccgacguuaagugggaggaucaggccgaaaucagcggcucgucacccauucugucuaucacgauuagugaggacggguccaugagcaucaaaaacgaagaggaggaacagacacuaaccauacugaucaggacuggacuucucgugauuucuggccuguuuccaaucagcauucccaucacagcggcugccugguauuugugggaggugaagaaacagcgagccggugucuuaugggaugugccuuccccacccccuauggggaaggccgaacuggaggacggagcuuaccgcauaaaacaaaagggcauuuucggcuauucacagaucggggcaggaguuuacaaggaagguaccuuucauacuauguggcacguaacacggggcgccgugcucaugcacaaagggaagagaaucgagccgaguugggcggaugucaaaaaggaccugauuagcuacggaggcgguuggaaacuugagggggaauggaaggagggagaagaggugcagguucuggcuuuggaaccaggcaagaaucccagggccgugcagaccaaaccuggccuauucaagacgaacacugggaccaucggagcagucucucuggauuuuuccccagguacaucaggcagucccauaauugacaaaaaggggaaagugguaggacucuauggcaacggugucgugacccguagcggggccuacguuuccgcuaucgcccaaacagagaagucuauugaggauaauccugaaaucgaggacgauauauuccgcaagcggagacugacuauuauggaccuucauccgggagcaggcaaaaccaagagguauuuacccgcuaucgugcgagaagccaucaaacggggccugcgcacgcucauuuuggcgccaacaagagucguggccgcagagauggaagaggcucugagggggcucccuauccgguaccagacucccgccauucgagcugagcacaccggaagagaaauaguugaccugaugugucaugcaacauucaccaugcgccuucugucgccagugagggucccuaacuauaauuugaucauuauggaugaggcccacuuuacugaccccgccagcaucgcugcgcgugguuacaucucaacccggguggaaaugggcgaggcagccgggauuuucaugacagcuacgccaccgggauccagagauccuuuuccccagaguaacgccccaauaaucgacgaggaaagggagauucccgaacgcucuuggaauagcggccaugaguggguaacugauuucaaggguaaaaccgugugguuuguuccuuccaucaaggcagggaacgacauugccgcuugccuacgaaagaauggcaagaaggucauccaacugucaagaaaaacauucgauucugaauaugugaagacccggacuaacgacugggauuuuguggucacaaccgacauaagcgagaugggcgcgaauuucaaagccgagaggguaaucgauccacgccguuguaugaagcccgugauucucgcagacggcgaagagagaguuaucuuagcugggccuaugccggugacgcacaguuccgccgcacagcggaggggacgcauuggucgaaaccccaagaaugaaaacgaccaguacaucuacaugggcgagccccuggaaaaugaugaggacugcgcccacuggaaggaggcuaagaugcuucuggauaacauaaauacuccugaagggauuauccccagcauguuugagccagaaagagagaaagucgacgccauugauggagaauaucggcucaggggcgaggcgcgcaagacauucguggacuugaugagaaggggugaucugccuguuuggcucgcauacaaaguggccgcugaggggaucaacuaugccgaccggcguugguguuuugauggcauaaagaacaaucagauccuggaagagaacgucgaaguggagauuuggaccaaagagggagaacgcaagaaacuuaaaccccgauggcuagacgcuagaaucuacucugauccacuggcauugaaggaguucaaagaguucgccgcuggcaggaagucauuaacccugaaucucauuacugagauggggcggcugccuacauuuaugacccagaaaacucgcgacgcccuugauaaccuggcaguacuccauacugcggaagccggagguagagcuuauaaucacgccuuguccgagcugccggagacgcuagaaacccugcuccuucugacauuauuggcaacugugaccggcgggaucuuccuguuucucaugaguggaaggggcauagguaagaugacacuggggaugugcugcauuaucaccgcuagcauccuucugugguacgcccaaauucagccccauuggaucgcagccucgauaauucucgaguucuuuuugaucguucuguuaauuccagaaccugagaagcagcggacuccccaagacaaccagcuaacguaugucgugaucgcuauacugaccguggucgcggccacaauggcaaaugaaaugggcuuccucgagaaaacuaagaaagaccuuggacugggcucuaucgcuacccagcagccagaguccaacauuuuggauaucgaccugcgaccugccagcgccuggacacucuacgcaguugcuaccacuuuugugacacccaugcugagacacucaauugaaaauaguucuguaaacgugucccuuacggccaucgcgaaucaagcuaccguccucauggggcugggaaaggguuggccguugagcaaaauggauauuggcgugccacuguuagccaucggguguuacucacagguuaacccuauaacucuaacagcagcccugcuccuucugguggcucacuaugcaauuaucggacccggcuugcaggccaaggcgacccgcgaggcucagaagagggccgcagccgguaucaugaaaaauccaaccgucgacgggauuacaguaauagaucuggaccccaucccuuacgauccgaaguucgaaaaacaacucggccaggugaugcugcuuauuuuaugcguuacucaggugcugaugaugcggacgaccugggcucucugugaggccuugacacuggcaacuggacccaucaguacccuaugggaaggcaacccagggcguuuuuggaauacaaccauugcugucagcauggccaacaucuucagaggauccuaucuggcgggcgccggucuccuauuuucuauaaugaagaauacuacgaacgcaaggcgcgggacaggaaacaugggcgagacccugggugagaaauggaaaagccgguugaaugcucugggcaaauccgaguuccaaaucuacaagaagucagggauucaggagguggaccgaacucucgccaaagaaggaaucaagagaggcgagaccgaucaucacgcagucucuagggggagugcuaaacugcgcugguuuguggagcggaacaugguuacaccugaaggaaaggugguagacuuaggcugcgguagagggggauggucguauuacuguggcggucuuaaaaaugugcgugaggucaagggccugacuaaagggggacccggccaugaagaaccuauuccaaugagcaccuauggguggaaccucguuaggcuacaguccggaguggaugucuucuucaucccaccugaaaaaugcgacacacuguugugugauauaggcgagucuucaccaaaucccacgguggaggccggucggacccugcgcguacucaaccuuguggaaaauuggcugaacaauaacacucaguuuugcauuaagguuuugaauccguacaugccuagcgugaucgagaaaauggaagcccugcaacgaaaguacgggggagcgcucgucagaaacccauuauccaggaauaguacacacgagauguauugggugucuaacgcuagcggcaauaucgucucauccgugaacaugauuagucggaugcugauaaaccgcuucaccaugagacauaaaaaggcaacuuacgaacccgacguugaccuuggcagcgggacaaggaauaucggaauugagucugagaucccuaaccuggauauuaucgguaagcgaauagagaaaaucaagcaggagcacgaaaccuccuggcacuaugaccaggaucauccauacaaaacgugggccuaucacggcucauacgagaccaagcagacagggagcgcuucgucuaugguaaauggagugguccggcuacucacuaaacccugggacgugcugccgaccguuacacaaauggccaugacugauaccacaccuuuuggccagcagcguguguucaaggaaaaggucgacaccagaacucaggagcccaaagaggguacgaagaaauugaugaagauuacagcagaauggcuguggaaagagcucgggaagaaaaagaccccacgcauguguacuagggaagaguuuacccggaaggugagaaguaacgccgcucuuggagcgaucuucacagaugagaauaaauggaaguccgcccgcgaagcaguagaggacagcagguuuugggaacugguggauaaagagcgaaacuuacaucuggaaggcaagugcgagacguguguuuauaauaugaugggcaaacgggagaagaaguugggggaguucggaaaagcuaaggguucaagagccauuugguacauguggcucggcgcaagguuucuggaguucgaagcccuaggguuucuuaacgaggaccacugguucucccgcgaaaauucucugagcggagucgagggcgagggucuccacaaacugggguacaucuugcgugaugugaguaagaaagaaggaggcgcuauguaugccgacgacaccgcgggcugggauacucggauuacacuggaggaccucaagaacgaagagauggugaccaaucauauggaaggggagcacaagaaacuugcagaggccauauuuaagcugacuuaccaaaacaaagucguuagagugcagaggccuacaccccgcggaaccguaauggauaucauuucccgacgggaccagagagguagcggccaaguggggacauauggauuaaauacuuucaccaacauggaagcucagcugaucaggcagauggagggcgaaggugucuucaagaauauccagcauuugacggugaccgaggagguugccgugcaaaacuggcucgcacgcgucgggagagaacggcugucuaggauggcuauuucaggagaugacugcgugguaaaaccacuagaugaccguuuugccaacgcucuuacagcccugaaugauaugggcaagauacgaaaggacauccagcagugggagcccaguaaaggcuggaacgauuggacucagguuccuuucugcucccaccauuuucacgaacucauuaugaaggacgggcgcgugcuggucgugccauguagaaaucaagaugaguugaucggacgggcaaggauuagccagggugcgggcuggucuuuacgcgaaaccgccugccuggggaaaucguacgcucagauguggucacucauguauuuccacagacgggaccuuaggcuggccgcaaacgcuaucuguagcgccgugccgucccauuggguccccacaagucgaacuaccuggucuauacacgcaaagcaugaguggaugacgacagaggacaugcuaaccguuuggaaucguguguggaucagagaaaacccuuggauggaggauaaaacuccaguagaaagcugggaggaaauucccuaccugggaaagcgcgaggaccaguggugcggcucccucaucgguuugacaucacgggccaccugggcgaagaauauucaagcugccaucaaccaggugaggagucugauagggaaugaggaauauacugauuacaugccuucuaugaaaagauuucgccgggaggaagaggaagcaggaguccuuugguga

SEQ ID NO: 14807 - RNA, 9876 nt, Artificial Sequence
  derived and/or modified CDS sequence (opt3) from DENV-2__FJ410219__SS-prME
agcgccggaaugauaauuaugcugauaccaaccgugauggcuuuccaccucacaacuagaaacggggaaccucauaugaucgucggcauucaggaaaaggguaaaucccuucuguuuaagacggaggacggaguuaauaugugcaccuugauggcuauggauuuaggggaacugugugaggacacaaucacuuacaaaugcccacuacucaggcaaaacgaaccggaggauauugacuguuggugcaauucuaccucaacaugggugaccuauggaacuuguacaaccacgggagagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacuaaugucaagcggaaaucugcucuuuacuggucaucugaagugccggcuucguauggacaaacugcaauugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggaccucgaaaagagauacgugcuggggagguuaauuacugucaacccgauagugaccgagaaagauagcccuguuaacaucgaagcugagcccccauuuggcgacucguacauuaucaucggaguggagccuggccagcugaagcuaaauugguucaagaaagggucuuccauuggacaaauguuugaaacgaccaugcggggugccaagcgaauggcuauacucggcgauacagccugggacuucgggucacugggaggcguauuuacaaguaucgguaaagcacuucaucaggucuucggggccauuuauggcgcugcguuuagcggaguguccuggaccaugaagaucuugauuggcguuaucauaacauggaucgggaugaacucucgcagcacuucacugagugugucccucguccuggugggaauuguaacccuuuaccugggcgugaugguucaggcagauagcgguugugucgugucuuggaaaaauaaggaguugaagugcgggucaggaaucuucauuacggacaacgugcacacauggaccgaacaguauaaauuucaacccgagaguccaagcaagcucgccuccgcuauccagaaagcccaggaagagggcauaugugguauuagaucugucacuaggcuggagaauuuaauguggaagcagaucacacccgaacugaaccacauucuagcagagaaugaaguuaaacucaccaucaugacuggcgauauaaaggggaucaugcaagccggaaaacgguuccugcgcccucagccaaccgagcuuaaguacucguggaagacauggggcaaagcuaagauguugagcacggaauccuauaaccagaccuuucugauugacgggccggagacugccgagugccccaauacaaacagagcauggaacucacucgaaguggaggauuacggauucggcguguuuaccacaaacaucuggcugaaauuaaaggaaaaacaggacgcguucugugacaguaagcugaugucugcugccauuaaggauaauagggcaguacaugccgacauggguuauuggaucgagagcgcucuuaacgauacuuggaaaauagagaaggccuccuucauugaagucaaaaauugccacuggccuaagucacauaccuuguggagcaacggggugcucgagucugaaaugaucauccccaagaaucuggcaggacccguuucccaacacaauuaccguccuggcuaccacacgcagauugcugguccauggcaucuaggcaagcuggagauggacuuugauuucugugacgggacaaccgugaucgucacugaagauugcggaaaccggggccccagucuccgaaccacaacugccagcgggaagcugauuaccgaguggugcuguagaucuugcacacuuccgccuuugagguaucgcggagaggacggcuguugguacgguauggaaauacggccacugaaagagaaggaagagaauuuagugaacucccucguuacggcggggcacggacagguggauaauuuuucacugggcguacuugguauggcccuguucuuggaagagaugcucagaaccagggucggcaugaaacaugcuauccugcuaguggcagugaguuuugucacucugauuacagggaacaugagcuucaaggaccucggacgcguugugguaauggugggcgccaccaugacugaugacaucgggaugggagucacauaucuggcucuuuuggccgcauuuaaagugcgacccaccuucgcggccggccuguuacuccggaagcugacgucgaaggagcuuaugaugauuacuaucgguauaguucugcuaucccaaucuaccaucccugaaacagugcucgagcugaccgaugcuuuggcccuggggaugauggucuuaaaaauugugcguaauauggaaaaguaccagcucgcaguuacuaucauggcuauucugugcgugcccaacgccgucauccuucagaaugcauggaaaguaagcuguacaauacuggccgugguuucagugaguccauugcuccugaccuccucucagcaaaagacagacuggauuccucuagcucugacuaucaaaggacuuaaccccaccgcgaucuuucucacgacacugagcagaaccaauaagaaaagguccuggccauugaacgaggccauuauggcagucggcauggugucaauacuggcuagcaguuuacucaagaaugacaucccgaugacuggcccucugguagccgggggacuucugaccgugugcuaugucuugacaggucgcucugccgaucucgaacuggagcggguuacugacgugaagugggaggaucaggcugaaauuuccggcagcucgcccauccuaucaauuaccaucucugaggacgggaguauguccaucaaaaaugaagaggaggaacagacgcugacaauccuuauuagaaccggacuccuggugaucagcggcuuguucccaauuucuauccccauaacugcagccgcgugguacuuaugggaggucaagaaacagagggcuggugugcugugggauguuccuagcccacccccuauggggaaggccgaacucgaggacggagcauaucgaauuaaacaaaagggcauccugggcuacucccagaucggggccggaguauacaaggaagguacauuucacaccauguggcaugugacucgcggcgcuguccuuaugcacaaagggaagcggauugagccgucaugggcagaugugaaaaaggaccugaucaguuauggaggcgguuggaaauuggagggggaauggaaggagggagaagagguucaggugcuagcccuggaaccaggcaagaaucccagagcgguccagacaaaaccuggccucuucaagaccaacacggggacuauaggagcugugagccuggauuuuucuccagguaccuccggcucacccauuaucgacaaaaaggggaaaguagucggacuuuacggcaacggugugguuacaaggaguggggccuaugugagcgcaauugcccaaaccgagaaguccaucgaggauaauccugaaauagaggacgauauuuuccguaagcgccgguuaacaaucauggaccugcacccgggagcuggcaaaacuaagagauaccuccccgccaucgucagggaagcaauuaaacgaggcuugcggacccugauccucgcuccaacgcgcgugguugccgcggagauggaagaggcccugagagggcuuccuauuagguaucagacacccgcaauacgggcugagcauacuggacgagaaaucguggaccugaugugucacgccaccuucacaaugagauugcuaucuccaguccgcgugccuaacuacaaucugauuaucauggaugaggcucauuuuaccgaccccgcaucgaucgccgccagggguuauauuagcacucguguagaaaugggcgaggcugcggggauauucaugaccgcaacaccaccgggaucacgggauccuuuuccccaguccaacgccccaaucauugacgaggaaagagagauccccgaaaggaguuggaacucuggccacgagugggugacggauuucaaggguaaaacuguuugguuugucccuagcauuaaggcugggaacgacaucgccgcaugccuccgcaagaauggcaaaaaggugauacaauuaucccgaaaaaccuucgauucagaauacgugaagacaagaaccaacgacugggauuuugucguaacuacagacaucucugagaugggcgccaauuucaaagcugagcgggugauugauccaaggcgcuguaugaagcccguuauccugaccgacggcgaagaacgugugauucuugcggggccuaugccggucacgcauagcagugccgcacagagacggggaaggaucggucgcaaccccaaaaaugaaaacgaccaguacauauauaugggcgagccccuggaaaaugaugaggacugcgcucacuggaaggaggccaagaugcucuuggauaacauuaauacuccugaagggaucauucccuccauguuugagccagaacgagagaaaguggacgcaaucgauggagaauacagacugcggggcgaggccaggaagacauucguugaccucaugcgcagaggugaucugccuguguggcuugcuuauaaagucgccgcggaggggauaaacuacgcagacaggcggugguguuuugauggcaucaagaacaaucagauucuagaagagaacguggaaguagagaucuggaccaaagagggagaacguaagaagcugaaaccccgcugguuggacgcccgaauuuauagcgauccauuagcucugaaggaguucaaagaguucgccgcuggcagaaagucucucacccugaaucuuaucacugagauggggaggcugccuacauuuaugacccagaaaacucgggacgcacucgauaacuuggccgugcugcacacugcugaagccggaggucgcgcauacaaucaugcgcuaucagagcugccggagacgcucgaaacccuucuguuauugacacugcucgccacuguuaccggcgggauauuccuguuucuuauguccggaagaggcauugguaagaugacacuggggaugugcugcaucaucaccgcuaguauucucuugugguaugcccaaauccagccccacuggauagcagcuagcauuauccuggaguucuuuuuaauuguccuacugaucccagaaccugagaagcagaggacuccccaagacaaccagcucacguacguggugauagccauccuuaccgucguugcagccacaauggcuaaugaaaugggcuuccuggagaaaacuaagaaagacuugggacugggcucgauugcgacccagcagccagagucuaacauccucgauauugaccugcggccugccuccgcauggacacuuuacgcuguggccaccacuuuuguaacacccaugcuccgacauagcaucgaaaauucaagugugaacgucucucugacggccauugcaaaucaagcuaccguguugauggggcugggaaaggguuggccguuauccaaaauggauaucggcguuccacuacuggccauaggguguuauagccaggugaacccuauuacucucacagcggcacuucuguugcuggucgcccacuacgcaaucaucggacccggccuccaggccaaggcuaccagagaggcacagaagcgcgccgcggcugguauuaugaaaaauccaaccguagacgggauaacagugaucgaucuggaccccauuccuuaugauccgaaguucgaaaaacaacuuggccagguuauguuacugauccucugcgugacucaggucuugaugaugaggacgaccugggcccugugugaggcacuaacacuggccacuggacccauuucaacccucugggaaggcaacccagggcgguuuuggaauacaaccaucgcugugaguauggccaacauauuccguggaagcuaccuugcaggcgcuggucuguuguuuuccaucaugaagaauacuacgaacacaagaagggggaccggaaacaugggcgagacucugggugagaaauggaagucucgccucaaugcccugggcaaaagcgaguuccaaauuuauaagaaguccgggauccaggaggucgaccggaccuuagcgaaagaaggaauuaagcgaggcgagacagaucaccaugccgugucaagagggucugcaaaacuuaggugguuuguugagcgcaacauggugacuccugaaggaaagguaguggaccugggcugcgguagagggggauggaguuacuauuguggcggucucaaaaauguccgggagguuaagggccuaaccaaagggggacccggccacgaagaaccuaucccaaugucgacauacggguggaaccuggugcguuugcagagcggagucgauguguucuucauacccccugaaaaaugcgacacgcugcucugugauauuggcgaguccucuccaaaucccaccguagaggcugguaggacucuucgggugcugaacuugguugaaaauuggcugaacaauaacacacaguuuugcaucaaggugcucaauccguacaugccuucagucaucgagaaaauggaagccuuacaacgcaaguaugggggagcacuggugcgaaacccacuuagcagaaauuccacccaugagauguacugggucaguaacgcuucuggcaauauugugagcucaguuaacaugauauccaggaugcugaucaaccgguucacuaugcgccacaaaaaggccacauaugaacccgacguagaccuaggcagugggaccagaaauauuggaaucgagagcgagauuccuaaccucgauaucauagguaagaggaucgagaaaauuaagcaggagcaugaaacgucuuggcacuacgaccaggaucacccauauaaaaccugggccuaccauggcuccuaugagacaaagcagacugggucagcgagcucgauggugaauggagucgugcgacuguugaccaaacccugggacguucugccgacagugacucaaauggcuaugaccgauacaaccccuuuuggccagcagcgggucuucaaggaaaagguggacacucguacgcaggagcccaaagaggguacaaagaaacucaugaagaucaccgcagaauggcuuuggaaagagcuggggaagaaaaagacuccaagaauguguacccgcgaagaguuuacaaggaagguacggucuaacgccgcuuuaggagccauuuucacggaugagaauaaauggaagagugcaagagaagccguggaggacucccgcuuuugggaacugguugauaaagagaggaacuugcaccucgaaggcaagugcgagaccugugucuacaauaugaugggcaaacgagagaagaagcugggggaguucggaaaagcuaaggguagccgggcgaucugguacauguggcuaggcgccagauuucuugaguucgaagcacugggguuucucaacgaggaccauugguucucaagggaaaauucccugucuggaguggagggcgaggguuugcacaaacugggguauauucuccgcgaugugagcaagaaagaaggaggcgcuauguacgccgacgacacugcaggcugggauacacguauaacccuugaggaccugaagaacgaagagauggucacuaaucacauggaaggggagcauaagaaauuagccgaggcuaucuuuaagcugacauaucaaaacaaaguugugcggguacagagaccuacccccaggggaacagugauggauauuaucagucgccgagaccagcgggguuccggccaagucgggacuuacggauugaauaccuucacgaacauggaagcccagcucaucagacagauggagggcgaagguguguucaagaauauucagcaccugaccguuacagaggagguggcggucaaaaacuggcuagcaaggguggggcgcgaaagacuuagccggauggccauaucuggagaugacugcguaguuaagccacuggaugacagguuugcuaacgcccucacugcacugaaugauaugggcaagauccguaaagacauucaacagugggagcccucaaagggcuggaacgauuggacccaggugccuuucugcagucaucacuuucaugaauugaucaugaaagacgggcgagucuuaguggugccaugucgcaaucaggaugagcugauuggcagagcucggaucucccaaggugccggcuggagccucagggaaacagcuugccuugggaagucuuaugcccagauguggucgcugauguacuuccaccgcagagaccuacggcuggcagcgaacgccauauguucagcugucccgagccacuggguucccacuuccaggaccacguggaguauccaugccaaacacgaguggaugacaaccgaggacaugcucacuguguggaaucgaguauggauucgugaaaacccuuggauggaggauaagacaccaguggaaucuugggaggaaauccccuauuugggaaagagagaggaccaguggugcggcagccugauuggucuuaccucccgcgcaacuugggcuaaaaauauccaggccgcaauaaaccaaguccggucacugauugggaaugaggaauacaccgauuacaugccuaguaugaagagguuuagacgcgaggaagaggaagccggagugcucugguga

SEQ ID NO: 14808 - RNA, 9876 nt, Artificial Sequence
  derived and/or modified CDS sequence (opt3) from DENV-2__FJ461314__SS-prME
agcgccggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggacccuuaagaucuugauuggcguuaucauaacauggaucgggaugaacucucgcagcacuucacugagugugucccucguccuggugggaauuguaacccuuuaccugggcgugaugguucaggcagauagcgguugugucgugucuuggaaaaauaaggaguugaagugcgggucaggaaucuucauuacggacaacgugcacacauggaccgaacaauauaaauuucagcccgagaguccaagcaagcucgccuccgcuauccagaaagcccaggaagagggcauaugugguauuagaucugucacuaggcuggagaauuuaauguggaagcaaaucacacccgaacugaaccacauucuagcagagaaugaaguuaaacucaccaucaugacuggcgauauaaaggggaucaugcaggccggaaaacggucgcugcgcccucagccaaccgagcuuaaguacagcuggaagacauggggcaaagcuaagauguuguccacggaaucauauaaccagaccuuccugauugacgggccggagacugccgagugccccaauacaaacagagcauggaauagucucgaaguggaggauuacggauuuggcguguucaccacaaacaucuggcugaaauuaaaggaaaaacaagacgcguuuugugacucuaagcugaugagcgcugccauuaaggauaauagggcaguacaugccgacauggguuauuggaucgaguccgcucuuaacgauacuuggaaaauagagaaggccucauucauugaagucaaaaauugccacuggccuaagagccauaccuuguggucuaacggggugcucgaguccgaaaugaucauccccaagaaccuggcaggacccguuagucagcacaauuaccguccuggcuaccacacgcagauugcugguccauggcaucuaggcaagcuggagauggacuucgauuuuugugacgggacaaccgugaucgucacugaagauugcggaaaccggggccccagccuccgaaccacaacugccucugggaagcugauuaccgaguggugcuguagauccugcacacuuccgccuuugagguaucgcggagaggacggcuguugguacgguauggaaauacggccacugaaagagaaggaagagaauuuagugaacucacucguuacggcggggcacggacaaguggauaauuucagucugggcguacuugguauggcccuguuuuuggaagagaugcucagaaccagggucggcacuaaacaugcuauccugcuaguggcagugagcuucgucacacugauuaccgggaacaugucguuuaaggaccucggacgcguugugguaauggugggcgccacuauggcugaugacaucgggaugggagucacauaucuggcccuuuuggcagcguucaaagugcgacccaccuuugccgcuggccuguuacuccggaagcugacguccaaggagcuuaugaugacuaccauugguaucguucugcuaucucagagcacaauaccugaaaccgugcucgagcugacugaugccuuggcacuggggaugauggucuuaaaaaucgugcguaauauggaaaaguaccagcucgcuguuacaauuauggccauccugugcgugcccaacgcagucauucuucagaaugccuggaaaguaucauguaccauccuggcugugguuaguguguccccauugcuccugacaucuagccaacagaagacugacuggauaccucuagcgcugaccauuaaaggacuuaaccccacggccaucuuccucacaacccuguccagaacuaauaagaaaaggucauggccauugaacgaggcaaucauggcugucggcauggugagcauucuggccaguucuuuacucaagaaugacauaccgaugaccggcccucugguagccgggggacuucugacagugugcuaugucuugacuggucgcuccgcugaucucgaacuggagcgggcaaccgacguuaagugggaggaucaggccgaaaucagcggcucgucacccauucuaucuaucacgauuagugaggacggguccaugagcaucaaaaacgaagaggaggaacagacacugaccauacuuaucagaacuggacuccuggugauuucuggcuuguuuccaaucagcauucccaucacagcggcugccugguacuuaugggaggugaagaaacaaagggccgguguccugugggaugugccuuccccacccccuauggggaaggccgaacucgaggacggagcuuaucgaauaaaacagaagggcauucugggcuacucacagaucggggcaggaguuuacaaggaagguaccuuccacacuauguggcauguaacacgcggcgccgugcuuaugcacaaagggaagcggaucgagccgaguugggcggaugucaaaaaggaccugauuagcuauggaggcgguuggaaauuggagggggaauggaaggagggagaagaggugcagguucuagcucuggaaccaggcaagaaucccagagccgugcaaaccaaaccuggccucuuuaagacgaacacugggaccaucggagcagucucucuggauuucuccccagguacaucaggcagucccauaauugacaaaaaggggaaagugguaggacuuuacggcaacggugucgugaccaggagcggggccuauguuuccgcuaucgcccagacagagaagucuauugaggauaauccugaaaucgaggacgauauauuucguaagcgccgguuaacuauuauggaccugcacccgggagcaggcaaaaccaagagauaccuccccgcuaucgugagggaagccaucaaacgaggcuugcggacgcugauucucgcgccaacacgcgucguggccgcagagauggaagaggcucugagagggcuuccuaucagguaucagacucccgccauucgggcugagcauaccggacgagaaauaguugaccugaugugucacgcaacauucaccaugagauugcuaucgccagugcgcgucccuaacuacaaucugaucauuauggaugaggcccauuucacugaccccgccagcaucgcugcgagggguuauaucucaacccguguggaaaugggcgaggcagccgggauuuuuaugacagcuacgccaccgggaucccgggauccuuucccccaaaguaacgccccaauaaucgacgaggaaagagagauucccgaaaggucuuggaauagcggccacgaguggguaacugauuuuaaggguaaaaccgugugguucguuccuuccaucaaggcagggaacgacauugccgcuugccuccgcaagaauggcaagaaggucauccaguuaucacgaaaaacauuugauucugaauacgugaagaccagaacuaacgacugggauuucguggucacaaccgacauaagcgagaugggcgcgaauuuuaaagccgagcggguaaucgauccaaggcgcuguaugaagcccgugauucugacggacggcgaagaacguguuauccuugcagggccuaugccggugacucauaguuccgcugcccagagacggggaaggauuggucgcaaccccaaaaaugaaaacgaccaguacaucuauaugggcgagccccuggaaaaugaugaggacugcgcacacuggaaggaggccaagaugcucuuggauaacauaaauacaccugaagggauuauccccagcauguucgagccagaacgagagaaagucgacgcuauugauggagaauacagacugcggggcgaggccaggaagaccuuuguggaccucaugcgcagaggugaucugccuguuuggcuugcguauaaaguggcagccgaggggaucaacuacgcugacaggcggugguguuucgauggcauaaagaacaaucaaauccuagaagagaacgucgaaguggagauuuggaccaaagagggagaacguaagaagcugaaaccccgcugguuggacgcccgaaucuauucugauccauuagcucugaaggaguuuaaagaguucgcagccggcagaaagucacucacucugaaucuuauuacagagauggggaggcugccuaccuucaugacacagaaaacucgggacgcucucgauaacuuggccguacugcacacggcagaagcgggaggucgcgccuacaaucaugcucuauccgagcugccggagacccucgaaacacuucuguuauugacucugcucgccaccgugacaggcgggaucuuucuguuccuuaugaguggaagaggcauagguaagaugacccuggggaugugcugcauuaucacugcaagcauccucuugugguaugcucagauucagccccacuggaucgccgcaucgauaauucuggaguuuuucuuaaucguucuacugauuccagaaccugagaagcaaaggacgccccaggacaaccagcucaccuacgucgugaucgccauacuuacaguggucgcugcgacuauggccaaugaaaugggcuuucuggagaaaaccaagaaagacuugggacugggcucuaucgcaacacagcaaccagaguccaacauucucgauaucgaccugcggccugcuagcgccuggacccuuuacgccguugcaacuacauucgugacgcccaugcuccgacauucaauugaaaauaguucuguaaacgugucccugaccgcuaucgccaaucaggcgacugucuugauggggcugggaaaggguuggccguuaagcaaaauggauauuggcgugccacuacuggcuaucggguguuauucacagguuaacccuauaacacucaccgccgcacuucuguugcugguggcccacuacgcuauuaucggacccggccuccaggcaaaggccaccagagaggcgcaaaagcgcgcugccgcagguaucaugaaaaauccaacagucgacgggauuacuguaauagaucuggaccccaucccuuaugauccgaaguuugaaaaacagcuuggccaggugauguuacugauucucugcguuacgcaaguguugaugaugaggaccacaugggcccugugugaggcucuaacucuggccaccggacccaucaguacacucugggaaggcaacccagggcgguucuggaauaccacuauugcagucagcauggcuaacaucuuucguggauccuaccuugccggcgcgggucuguuguucucuauaaugaagaauacgacaaacaccagaagggggacuggaaacaugggcgagacccugggugagaaauggaaaagccgccucaauacacugggcaaauccgaauuucagaucuauaagaagucagggauucaggagguggaccggacuuuagccaaagaaggaaucaagcgaggcgagaccgaucaccaugcagucucuagagggagugcuaaacuuaggugguucguggagcgcaacaugguuacaccugaaggaaaggugguagaccugggcugcgguagagggggauggucguacuauuguggcggucucaaaaaugugagagaggucaagggccuaacgaaagggggacccggccacgaggaaccuauuccaaugagcaccuacggguggaaccugguucguuugcaguccggaguggaugucuuuuucaucccaccugaaaaaugcgacacucugcucugugauauaggcgagucuucaccaaaucccacaguggaggccgguaggacccuucggguacugaacuugguggaaaauuggcugaacaauaacacucaauucugcauuaagguucucaauccguacaugccuagcgugaucgagaaaauggaagcauuacagcgcaaguaugggggagcucugguccgaaacccacuuuccagaaauaguacacaugagauguacugggugucuaacgccagcggcaauaucgucucauccgugaacaugauuaguaggaugcugauaaaccgguuuaccaugcgccacaaaaaggccacguaugaacccgacguugaccuaggcagcgggaccagaaauaucggaauugagucugagaucccuaaccucgauauuaucgguaagaggauagagaaaaucaagcaggagcaugaaacauccuggcacuacgaccaggaucacccauauaaaacuugggcguaccauggcucauaugagaccaagcaaacagggagcgcuucgucuaugguaaauggagugguccgacuguugacuaaacccugggacgugcugccgaccguuacacagauggcaaugaccgauacuacgccuuucggccagcagcggguguuuaaggaaaaggucgacacacguacccaagagcccaaagaggguacuaagaaacucaugaagauuaccgccgaauggcuuuggaaagagcuggggaagaaaaagacaccaagaauguguacgcgcgaagaguucaccaggaaggugcggaguaacgcugccuuaggagcaaucuuuacugaugagaauaaauggaaguccgccagagaagcuguagaggacagccgcuucugggaacugguggauaaagagaggaacuugcaccucgaaggcaagugcgagacauguguuuacaauaugaugggcaaacgagagaagaagcugggggaauuuggaaaagcgaaggguucacgggccauuugguacauguggcuaggcgcaagauuccuugaguuugaagcucugggguuccucaacgaggaccauugguuuuccagggaaaauucucugagcggagucgagggcgaggguuugcacaaacugggguauauccuccgcgaugugaguaagaaagaaggaggcgccauguacgcagacgacaccgccggcugggauacucguauuacacuugaggaccugaagaacgaagagauggugaccaaucacauggaaggggagcauaagaaauuagcugaggccauauucaagcugacauaucagaacaaagucguucgggugcagagaccuacucccaggggaaccguaauggauaucauuucccgccgagaccaacgggguagcggccagguggggacguacggauugaauaccuuuacaaacauggaagcgcagcucaucagacagauggagggcgaaggugucuucaagaauauccaacaccugacugugaccgaggagguugcagugcagaacuggcuagccagggucgggcgcgaaagacuuucucggauggcuauuucaggagaugacugcgugguaaaaccacuggaugacagguucgccaacgcacucacagcucugaaugauaugggcaagauacguaaggacauccagcagugggagcccaguaaaggcuggaacgauuggacucaaguuccuuuuugcucccaucacuuccaugaauugauuaugaaggacgggcgaguguuagucgugccaugucgcaaucaggaugagcugaucgguagagcacggauuagccagggagcuggcuggucucucagggaaaccgccugccuugggaaaucguaugcacagauguggucacugauguacuuucaccgcagagaccuacggcuggcggccaacgcuaucuguagcgccgugccgucccacuggguccccacgaguaggacaaccuggucuauacaugcaaagcacgaguggaugacuacagaggacaugcucaccguuuggaaucgaguguggauccgugaaaacccuuggauggaggauaaaacuccaguagaaagcugggaggaaauucccuauuugggaaagagagaggaccaauggugcggcucccugaucggucuuaccucacgcgcuacaugggccaagaauauucaggcagccaucaaccaggugcggagucugauagggaaugaggaauacacggauuacaugccuucuaugaaaagguucagacgcgaggaagaggaagcgggaguccucugguga

SEQ ID NO: 14809 - RNA, 9876 nt, Artificial Sequence
  derived and/or modified CDS sequence (opt3) from DENV-2__FJ410221__SS-prME
agcgccggaaugaucauuaugcugauccccaccgugauggcuuuccaccucacaacuagaaauggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccaucauggcugaugacauugggaucggagucacuuaucucgcccugcuugcagcguucaaggugcgacccacauuugccgcuggcuugcuguuacggaagcucaccuccaaagagcugaugaugacgacuauagguaucguucuucugucucaaagcaccauuccugaaacagugcuagagcucaccgaugcccuggcauuggggaugaugguccugaagaucgugcguaauauggaaaaauaccaguuagcuguuacuauuauggccauccucugcgugcccaacgcagucauacugcagaaugccuggaagguaucauguacaauucuugcugugguuaguguguccccacuguugcucaccucuagccagcagaaaacugacuggaucccucuggcgcuaacuaucaagggacugaaccccaccgccauuuuccuuacgacacucuccagaaccaauaaaaagaggucauggccacugaacgaggcaauaauggcugucggcauggugagcaucuuggccaguucucuguuaaagaaugacauuccgaugacuggcccucucguagccgggggacugcuuaccgugugcuauguccugacaggucgcuccgcugauuuggaacucgagcgggcaacugacguuaaaugggaggaucaagccgaaaucagcggcucgucacccauucugucuaucaccauaagugaggacggguccaugagcaucaagaacgaagaggaggaacagacgcuaacaauucugaucagaaccggacuucucgugauuucuggccuguuuccaaucagcauacccauuacugcggcugccugguacuugugggaggugaaaaagcagagggccggugucuuaugggaugugccuuccccacccccuauggggaaagccgaacuggaggacggagcuuaucgaaucaagcaaaagggcauccucggcuacucacagauuggggcaggaguuuacaaagaagguacauuccacaccauguggcauguaacucgcggcgccgugcugaugcacaaggggaaacggaucgagccgaguugggcggaugucaagaaagaccuuauaagcuauggaggcgguuggaagcuggagggggaauggaaggagggagaagaggugcagguuuuggcucuagaaccaggcaaaaaucccagagccgugcagacaaagccuggccuguuuaaaaccaacacggggacuauuggagcagucucucucgauuucuccccagguaccucaggcagucccaucauugacaagaaagggaaggugguaggacuguacggcaacggugucgugacaaggagcggggccuauguuuccgcuaucgcccaaucugagaagucgauagaggauaauccugaaauugaggacgauaucuuucguaaacgccggcuuaccaucauggacuuacacccgggagcaggcaagacaaaaagauaccugcccgcuauugugagggaagccaucaagcgaggccuccggacuuugauucuggcgccaacccgcgucguggccgcagagauggaagaggcucucagagggcugccuauaagguaucagacgcccgccauccggguugagcauacaggacgagaaauuguggaccuuaugugucacgcuacuuucaccaugagacuguugagcccaguccgcgugccuaacuacaaucuaaucaucauggaugaggcacauuucacagaccccgccucaauugccgcuagggguuauauauccacccguguagaaaugggcgaggcggcagggaucuuuaugacugccaccccaccgggaagucgggauccuuucccccagucuaacgcuccaauuaucgacgaggaaagagagauucccgaaaggagcuggaacuccggccacgagugggugacagauuuuaaagguaagacgguuugguucgucccuucaaucaaggccgggaacgacauagcagccugccugcgcaaaaauggaaagaaagugauccaacucucucgaaagacuuuugauagcgaauacgugaaaaccagaacaaacgacugggauuucgucguaaccacugacauuagugagaugggcgcuaauuuuaaggcggagcgggugaucgauccaaggcgcuguaugaaacccguuauuuuaacagacggcgaagaacgugugauccuggccgggccuaugccggucacccauuccagcgcagcucagagacggggaaggauaggucgcaacccaaagaaugaaaacgaccaguacauuuauaugggcgagccccuugaaaaugaugaggacugcgcccacuggaaggaggcaaaaaugcugcucgauaacaucaauacgccugaagggauuauccccucuauguucgagccagaacgagagaagguggacgccauagauggagaauacagauugcggggcgaggcuaggaaaacuuuuguugaccugaugcgcagaggugaucucccuguguggcuggccuauaaggucgcggcagaggggaucaacuacgccgacaggcggugguguuucgauggcauuaaaaacaaucagauccuugaagagaacguggaaguagagauuuggacaaaggagggagaacguaagaaacuaaagccccgcuggcuggacgcucgaaucuauucagauccauuggccuuaaaagaguuuaaggaguucgcugcaggcagaaaaucccugacccucaaucugauaaccgagauggggaggcuuccuacuuucaugacacaaaagacccgggacgcccuggauaaccucgcuguguugcacacagccgaagcaggaggucgcgcguacaaucaugcccugagugagcuaccggagacucuggaaacgcuccuucuguuaaccuugcuggcuacaguuacuggcgggauuuuucucuuccugaugagcggaagaggcaucgguaagaugacccuugggaugugcugcaucauuacagccucgauccugcucugguaugcacagauacagccccacuggauugcugccucuaucauuuuggaguuuuuccugaucgucuuacuaauaccagaaccugagaaacagaggacaccccaagacaaccagcugacuuacguggugaucgcaauucucacggucguugccgcuaccauggcgaaugaaaugggcuuucuugagaagaccaaaaaggaccugggauugggcuccaucgccacucagcagccagagagcaacauucuggauaucgaccuccggccugcaucagcuuggacccuguacgccguggccacaaccuucguaacucccaugcuucgacauaguauugaaaauucuuccgugaacgucagccucacagcaaucgcuaaucaagccacggugcugaugggguugggaaaagguuggccgcugucaaagauggauauaggcguuccauuacuagcgauuggguguuauagucaggugaacccuaucacccugacugcugcccuccuucuguuggucgcacacuacgccaucauuggacccggccugcaggcuaaggcaacaagagaggcccagaaacgcgcggcugccgguauaaugaagaauccaaccguagacgggaucaccgugauugaucucgaccccaucccuuaugauccgaaauuugaaaagcaacugggccagguuaugcuuuuaauucugugcgugacacagguccucaugaugaggacuacgugggcauugugugaggcccugacccuagcuacaggacccaucagcacucugugggaaggcaacccagggcgguucuggaauaccacaauagccguguccauggcaaacaucuuucguggaucuuaccucgcuggcgccggucuucuguucagcauuaugaaaaauaccacuaacacgagaagggggacaggaaacaucggcgagaccuugggugagaaguggaaaucccgccugaaugcgcucggcaagucagaauuucaaauuuauaagaaaucugggauccaggaggucgaccggacucuggccaaggaaggaauaaaacgaggcgagaccgaucaccaugcagugaguagagggucggcuaaguuaaggugguucguugagcgcaacauggugacaccugaaggaaaaguaguggaccuuggcugcgguagagggggauggagcuacuauuguggcggucugaagaaugucagagagguuaagggccucacuaaagggggacccggccacgaggaaccuauuccaauguccaccuacggguggaaccuagugcgucugcagucuggagucgauguguuuuucauacccccugaaaagugcgacacauugcugugugauaucggcgagucaagcccaaaucccacgguagaggccgguaggacccuccgggugcuuaaccugguugaaaauugguugaacaauaacacucaguucugcauuaaagugcugaauccguacaugccuuccgucauagagaagauggaagcacuccaacgcaaauaugggggagcuuuagugcgaaacccacugaguagaaauucuacacaugagauguacugggucagcaacgccucaggcaauaucguguccaguguuaacaugauuagcaggaugcuuaucaaccgguuuaccaugcgccacaagaaggccacuuaugaacccgacguagaccugggcucugggacaagaaaugugggaauugaguccgagaucccuaaccuagauauaaucgguaaaaggauugaaaagaucaaacaggagcaugaaaccucauggcacuacgaccaggaucacccauauaagacgugggcguaccauggcagcuaugagaccaaacagacagggucggcuucuaguauggucaauggagugguucgacuccugacuaagcccugggacguguugccgaccgucacacaaauggcaaugacugauaccacaccuuucggccagcagcggguguuuaaggaaaaaguagacacccguacucaggagcccaaggaggguacgaaaaagcugaugaaaauuacagccgaauggcucuggaaggagcuugggaaaaagaagaccccaagaauguguacucgcgaagaguucaccaggaaagugcgguccaacgcugcccugggagcaaucuuuacagaugagaauaaguggaaaagcgccagagaagcuguugaggacucacgcuucugggaauuagucgauaaggagaggaaccugcacuuggaaggcaaaugcgagacguguguguacaauaugaugggcaagcgagagaagaaacucggggaauuuggaaaggcgaaagguucccgggccauuugguacauguggcugggcgcaagauuccuagaguuugaagcucuuggguuccugaacgaggaccauugguuuucuagggaaaauagccucaguggaguggagggcgagggucugcacaaguugggguauauacugcgcgaugucuccaaaaaggaaggaggcgccauguacgcagacgacaccgccggcugggauacucguaucacacucgaggaccuuaagaacgaagagaugguuaccaaucacauggaaggggagcauaaaaagcuggcugaggccauuuucaaauuaacuuaucaaaacaaggugguacgggugcagagaccuacacccaggggaaccgucauggauaucaucagccgccgagaccagcgggguucuggccaaguggggacauacggacugaauacuuuuaccaacauggaagcgcaguugauuagacagauggagggcgaagguguuuucaaaaauauacagcaccucacggugaccgaggaggucgcagugcaaaacuggcuggccaggguagggcgcgaaagacuaucacggauggcuaucaguggagaugacugcguugugaagccacuugaugacagguucgccaacgcacugacagcucucaaugauaugggcaagauucguaaagacauccagcagugggagcccuccaagggcuggaacgauuggacucaggucccuuuuugcagccaucacuuccaugaacugauuaugaaagacgggcgaguguugguggucccaugucgcaaucaagaugaguuaaucggacgggcacggauaucucagggugcuggcuggucgcugagggaaaccgccugccucgggaagucauaugcacagauguggagccuuauguacuuucaccgcagagaccugcggcuagcggccaacgcuaucuguuccgccguuccgagucacugggugcccacaucuaggacuaccuggagcauucaugcaaaacacgaguggaugacgacagaggacaugcugaccguauggaaucgaguguggauccgugaaaacccuuggauggaggauaagacuccagucgaauccugggaggaaauucccuaucucggaaagagagaggaccaguggugcggcucauugaucggucugacaagucgcgcuaccugggccaaaaauauacaagcagccauuaaccaggugcggucucuuaucgggaaugaggaauacacugauuacaugccuagcaugaagagguucagacgcgaggaagaggaagcgggaguucugugguga

SEQ ID NO: 14810 - RNA, 9876 nt, Artificial Sequence
  derived and/or modified CDS sequence (opt3) from DENV-2__FJ547064__SS-prME
agcgccggcaugaucauuaugcugauacccaccgugauggcuuuccaccucacaacuagaaacggggagccucauauggucguuggaauccaggaaaaggguaaaucccuucuguuuaagacggaggacggcgugaauaugugcaccuugauggcaauggauuuaggggaacugugugaggacacaauuacuuacaaaugcccacuacucaggcaaaacgaaccggaggauaucgacuguuggugcaauucuaccucaacauggguaaccuauggaacuuguacaaccacgggcgagcaccggcgcgaaaagcgaaguguggcccuggucccccauguggguauggggcuugagacucguaccgaaacauggaugagcuccgagggagcguggaaacacgcucagagaauugagacuuggauccugaggcauccuggcuucaccauaauggccgcaaucuuggccuacacaauuggcaccacgcacuuucagcggguucucaucuucauucugcugacugcuguggcaccaucuaugacaaugcgcugcaucgggauaucgaacagagauuuugucgaaggagugucagguggcagcuggguagacauuguucucgagcacgggaguugugugaccacuauggccaagaauaagcccacauuagauuucgaacugaucaaaaccgaggcuaagcagccugccacgcuuaggaaauauugcauugaagcgaaguugaccaacacaacuaccgagucccgguguccaacacaaggagagcccucucugaaagaagagcaggacaagcgcuuugucugcaagcauagcaugguggaucgaggcugggguaauggguguggacuauucggcaaaggcgggaucgugacuugcgcaauguuuaccugcaagaaaaacauggaaggaaagaucguccagccugagaaucucgaauacacaauuguugugaccccacacuccggugaggagcaugccguaggcaacgacacugggaaacacggacaggaaauaaaggugacgccgcaaucaaguaucacagaggcugaacugaccggcuaugguacugucaccauggaguguagccccagaacagggcuugauuucaaugaaauggugcuguugcagauggagaacaaagccuggcucguucacaggcagugguuucuggacuuaccucugccauggcuccccggcgcagauaagcaggagucuaauuggauucaaaaggaaacccuugugacuuucaaaaacccucaugcuaagaaacaggacgucgugguacugggaucccaggagggcgccaugcacacagcguugacgggggccaccgaaauccaaaugucaagcggaaaucuacuguuuacuggucaucucaagugccggcugcguauggacaaacuucagcugaagggcaugaguuacucuauguguacagggaaguucaaaguugugaaggagauagcagagacccagcacggaacaauugucauccgcgugcaguaugaaggcgaugguuccccaugcaaaauccccuucgagauuauggacuuggaaaagagauacguccucgggaggcugaucacugugaacccgauuguuaccgagaaagauagcccugugaacauagaagcugagcccccauuuggcgacucguacaucauuaucggaguagagccuggccaauuaaagcugaauugguucaagaaagggucuuccaucggacagauguuugaaacgaccaugcggggugccaagcgaauggcuauucuaggcgauacagccugggacuucgggucacucggaggcgucuuuacuaguauagguaaagcacugcaucagguguucggggccaucuauggcgcugcguuuagcggaguuuccuggaccaugaagauucuuaucggcgugauuaucacauggauagggaugaacucucgcagcacuucauugagugucucccuggugcucguaggaaucgugacccuguaccuuggcguuaugguccaggcagauagcgguuguguggugucuuggaaaaauaaggagcugaagugcgggucaggaauuuucaucacggacaacguccacacauggaccgaacaauauaaauuucagcccgagaguccaagcaaguuggccuccgcuauucagaaagcccaggaagagggcaucugugguauaagaucuguuacuaggcucgagaaucugauguggaagcaaauuacacccgaauuaaaccacauccuggcagagaaugaagugaaacuaaccauuaugacuggcgauaucaaggggauaaugcaggccggaaaacggucgcuccgcccucagccaaccgagcugaaguacagcuggaagacauggggcaaagcuaagaugcuuuccacggaaucauauaaccagaccuucuugaucgacgggccggagacugccgagugccccaauacaaacagagcauggaauagucuggaaguggaggauuacggauuuggcguauucaccacaaacauuuggcucaaacugaaggaaaaacaagacgcguuuugugacucuaaguuaaugagcgcugccaucaaggauaauagggcaguccaugccgacauggguuauuggauugaguccgcucugaacgauacuuggaaaaucgagaaggccucauucauagaagugaaaaauugccacuggccuaagagccauacccuuuggucuaacgggguuuuggaguccgaaaugauuaucccaaaaaaccucgcaggacccgugagucagcacaauuaccguccuggcuaccacacgcagaucgcugguccauggcaucugggcaagcuagagauggacuucgauuuuugugacgggacaaccgucauugugacugaagauugcggaaaccggggccccagccugcgaaccacaacugccucugggaagcucaucaccgaguggugcuguagauccugcacacugccgccucuuagguaucgcggagaggacggcuguugguacgguauggaaauucggccauugaaagagaaggaagagaaucugguuaacucauuagugacggcggggcacggacaaguagauaauuucagucucggcguccuggguauggcccuuuuucuggaagagauguugagaaccagggugggcacuaaacaugcuauacuccugguggcagucagcuucguuacacuaaucaccgggaacaugucguuuaaggaccugggacgcgugguagugauggucggcgccacuaugacagaugacauugggaugggagugaccuaucucgcucugcuugccgcauucaaaguucgacccacguuugcggccggcuugcuguuacggaagcucacuuccaaggagcugaugaugaccacaaucgguauugugcuucugucucagagcaccaucccugaaacuguccuagagcucacagaugcucuggccuuggggaugauggugcugaaaauaguucguaauauggaaaaguaccaguuagcagugaccaucauggcuauucucugcguccccaacgccguaauccugcagaaugcauggaaagugucauguacaauucuugccguugugagugucuccccacuguugcucacuucuagccaacagaagaccgacuggaucccucuggcucuaacgauaaaaggacugaaccccacagcgauuuuccuuaccacucucuccagaaccaauaagaaaaggucauggccacugaacgaggccaucauggcagugggcaugguaagcaucuuggcuaguucucuguuaaagaaugacauuccgaugacaggcccucucguggccgggggacugcuuacugucugcuauguucugaccggucgcuccgccgauuuggaacucgagcgggcuacggacgugaagugggaggaucaggcagaaauaagcggcucgucacccauccugucuauuacaaucagugaggacggguccaugagcauuaaaaacgaagaggaggaacagacccuaacuauccugauaagaacaggacuucucgugaucucuggccuguuuccaauuagcauccccauuaccgccgcggcuugguacuugugggaggucaagaaacaaagggccgguguguuaugggauguuccuuccccacccccuauggggaaggcagaacuggaggacggagccuaucgaaucaaacagaagggcauacucggcuacucacagauuggggcuggaguauaccgcgaagguacuuuccacacaauguggcaugugacccggggcgcaguccugaugcacaaggggaaaagaaucgagccgaguugggccgaugugaagaaagaccuuaucagcuauggaggcgguuggaagcuggagggggaauggaaagagggagaagagguucagguguuggcgcuagaaccaggcaagaaucccagggcuguccaaacgaagccuggccuguuuaaaacuaacaccgggacaauuggagccgugucucucgauuucuccccagguaccucaggcagucccaucauagacaagaaagggaagguagucggacuguacggcaacggugugguuacacguagcggggcauauguguccgccauugcucagacugagaaaucuaucgaggauaauccugaaauugaggacgauaucuuucgcaagcggagacuuaccauaauggacuuacacccgggagccggcaagacgaaaagguaccugcccgcaauuguccgagaagcuaucaagcggggccuccgcacauugauccuggccccaacuagagugguugcggccgagauggaagaggcacucagggggcugccuauucgguaucagacccccgcuauccgagccgagcauacaggaagagaaauuguggaccuuaugugucacgcuaccuucacuaugcgccuguugucgccagucagggugccuaacuacaaucuaauaaucauggaugaggcacauuucaccgaccccgccagcauugccgcucgugguuauaucucaacacggguagaaaugggcgaggcggcagggaucuuuaugacggccacuccaccgggauccagagauccuuucccccaaaguaacgcuccaauuauagacgaggaaagggagauccccgaacgcucuuggaauagcggccacgagugggugaccgauuuuaaagguaagacaguuugguucgucccuuccauuaaagccgggaacgacaucguggcaugccugcgaaagaauggaaagaaagugauucagcucucaagaaagaccuuugauucugaauacgucaaaacucggacaaacgacugggauuucguagugaccacggacaucagcgagaugggcgccaauuuuaaggcugagaggguuauagauccacgccguuguaugaaacccgugaucuuaacugacggcgaagagagagucauucuggcggggccuaugccggugacacauaguuccgccgcacagcggaggggacgcaucggucgaaacccaaagaaugaaaacgaccaguacauuuauaugggcgagccccuugaaaaugaugaggacugcgcucacuggaaagaggccaagaugcugcucgauaacaucaauaccccugaagggauaauucccagcauguucgagccagaaagagagaagguugacgcaaucgauggagaauaccgguugaggggcgaggcccgcaaaaccuuuguggaccugaugagaaggggugaucucccugucuggcuggcuuauaagguggccgcggaggggauuaacuacgcagaccggcguugguguuucgauggcaucaaaaacaaucaaauacuugaagagaacguagaaguggagaucuggacuaaggagggagaacgcaaaaagcuaaagccccgauggcuggacgccagaauuuauucugauccauuggcuuuaaaagaguuuaaggaauucgccgcuggcaggaaaucacugacacucaaucugaucaccgagauggggcggcuuccuacauucaugacucagaagacgcgcgacgcacuggauaaccucgccguuuugcacaccgcugaagccggagguagagcauacaaucaugcgcuguccgagcuaccggagacacuggaaacucuccuucuguuaaccuugcuggccacagucaccggcgggauuuuucucuuccugaugaguggaaggggcaucgguaaaaugacucuugggaugugcugcauaauuacggcuagcauccugcucugguaugcccagauccagccccacuggauugcagcuucgaucauauuggaguuuuuccugauuguguuacuaaucccagaaccugagaagcaacggaccccccaggacaaccagcugacauacguggucauugccauccucacuguuguggcagccaccauggcuaaugaaaugggcuuucuugagaagacaaaaaaggaccugggauugggcucuauagcgacccagcaaccagaguccaacauccuggauauugaccuccgaccugccagcgcauggacucuguacgcuguagccacaacguucgugacccccaugcuuagacauucaaucgaaaauaguucugucaacgugucccucacugccauugcaaaucaggcuacaguucugaugggguugggaaaagguuggccgcugagcaagauggauaucggcgugccauuacuagccauuggguguuauucacaggucaacccuaucacccugaccgcggcucuccuucuguugguagcccacuacgcaauaauuggacccggccugcaggccaaagcuacacgcgaggcacaaaagagggccgcggcugguaucaugaagaauccaacuguggacgggaucacgguuauugaucucgaccccauaccuuaugauccgaaauuugaaaagcagcugggccaggugaugcuuuuaauccugugcgucacccaagugcucaugaugcggacaacuugggccuugugugaggcacugacccuagccacaggacccauuaguacccugugggaaggcaacccagggcguuucuggaauacuacgaucgcugucagcauggccaacauuuuuagaggauccuaccucgcaggcgcuggucuucuguucucuaucaugaaaaauacaaccaacacuaggcgcgggaccggaaacaugggcgagacauugggugagaaguggaaaagccggcugaaugcccucggcaaguccgaauuucagauauauaaaaagucagggauccaggagguggaccgaacucuggcgaaggaaggaauuaaaagaggcgagaccgaucaccaugccguuucuagggggagugcaaaguuacgcugguucguggagcggaacaugguaacaccugaaggaaaaguggucgaccuuggcugcgguagagggggauggucguacuauuguggcggucugaagaauguucgugaggugaaaggccucacgaaggggggacccggccacgaagagccuaucccaaugagcaccuacggguggaaccuagucaggcugcaguccggaguggauguauuuuucauucccccugaaaagugcgacacuuugcugugugauaucggcgagucuucaccaaaucccacaguggaggcuggucggacccuccgcguucuuaaccugguggaaaauugguugaacaauaacauacaauucugcauuaaaguccugaauccguacaugccuagcgugaucgagaagauggaagcccuccagcgaaaauaugggggagcauuagucagaaacccacuguccaggaauaguacucaugagauguacugggugucuaacgcuagcggcaauaucguuucauccguaaacaugauuagucggaugcuuauaaaccgcuuuacaaugagacacaagaaagccaccuaugaacccgacguggaccugggcagcgggacgaggaauaucggaaccgagucugagauuccuaaccuagauaucauugguaagcgaaucgaaaagauaaaacaggagcaugaaacauccuggcacuacgaccaggaucacccauauaagacuugggccuaccauggcucauaugagaccaaacaaacagggagcgcgucgucuauggucaauggagugguucggcuccugacuaagcccugggacguguugccgauggucacccagauggcuaugacagauaccacuccuuucggccagcagcguguguuuaaagaaaagguagacacgagaacacaagagcccaaggaggguaccaaaaagcugaugaaaaucacugcagaauggcucuggaaggagcuugggaaaaagaaaaccccacgcauguguacaagggaagaguucacgcggaaggugagaaguaacgccgcucugggagccauuuuuaccgaugagaauaaguggaaauccgcacgcgaagccguugaggacagcagguucugggaauuagucgauaaggagcgaaaccugcacuuggaaggcaaaugcgagacuuguguguacaauaugaugggcaagcgggagaaaaagcucggggaauuuggaaaggcuaaagguucaagagcgaucugguacauguggcugggcgccagguuccuagaguuugaagcacuuggguuccugaacgaggaccauugguuuucccgcgaaaauucucucagcggaguggagggcgagggucugcacaaguugggguauauucugcgugaugucaguaaaaaggaaggaggcgcuauguacgccgacgacacagcaggcugggauacccggaucacucucgaggaccuuaaaaacgaagagaugguuacaaaucacauggaaggggagcauaagaagcuggccgaggcuauuuucaaauuaaccuaucagaacaaggugguaagagugcagaggccuacaccccgcggaacugucauggauauaaucucccgacgggaccaaagagguagcggccagguggggaccuacggacugaauacguuuaccaacauggaagcccaguugauuaggcagauggagggcgaagguguuuucaaaaauauccaacaccucacagugacugaggaggucgcggugaagaacuggcuggcacgcguagggagagaacggcuaucuaggauggccaucucaggagaugacugcguugugaaaccacuugaugaccguuucgcuaacgcccugaccgcacucaaugauaugggcaagauucgaaaggacauacagcagugggagcccaguaaaggcuggaacgauuggacacaggucccuuuuugcucccaucacuuccaugaacugaucaugaaggacgggcgcguguugguggucccauguagaaaucaagaugaguuaauuggacgggcuaggaucagccagggugccggcuggucucugcgcgaaacugcuugccucgggaaaucguaugcccagauguggucacuuauguacuuucacagacgggaccugaggcuagcagcgaacgccauuuguagcgcuguuccgucccacugggugcccaccagucgaacgacauggucuauccaugccaagcacgaguggaugaccacugaggacaugcugacaguauggaaucguguguggauaagagaaaacccuuggauggaggauaaaaccccagucgaaagcugggaggaaauccccuaucucggaaagcgcgaggaccaguggugcggcuccuugauuggucugacuucacgggcaaccugggcuaagaauauccaagccgcaauuaaccaggugaggagucuuaucgggaaugaggaauacacagauuacaugccuucuaugaaaagauuccgccgggaggaagaggaagccggaguucugugguga

SEQ ID NO: 14811 - RNA, 9876 nt, Artificial Sequence
  derived and/or modified CDS sequence (opt3) from DENV-2__FJ410223__SS-prME
agcgcaggaaugaucauuaugcugauacccaccgugauggcuuuccaccucacaacuagaaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccauuacucaggcaaaacgaaccggaggauauugacuguuggugcaauucuaccucaacaugggugaccuauggaacuuguacaaccacgggagagcaccggcgcgaaaagcgaaguguagcacuggugccccaugucgguauggggcuugagacucguaccgaaacauggaugagcuccgagggagcguggaaacacgcucagcggaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggagaacauggggcaaggcuaaaaugcuuuccacggaaucauauaaccagaccuucuugauugacgggccggagacugccgagugccccaauacaaacagggcauggaauagucuggaaguggaggauuacggauuuggcguguucaccacaaacaucuggcucaagcugaaagaaaagcaagacgcguuuugugacucuaaauuaaugagcgcugccauuaaggauaaucgugcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucagcacaauuaccggccuggcuaccacacgcagauugcugguccauggcaucugggcaaacuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaggagaaagaagagaaucuggugaacucauuaguuacggcggggcacggacaaguggauaauuucagucucggcguacuggguauggcccuuuuucuggaagagauguugaggacccgcgucggcacuaagcaugcuauccuccugguggcagugagcuucgucacacuaauuaccgggaacaugucguuuaaagaccugggacgaguugugguaauggugggcgccacuauggcugaugacaucgggaugggagucacauaucucgcccugcuugcagcguucaaggugcggcccaccuuugccgcuggcuugcuguuacguaaacucacguccaaggagcugaugaugacuaccauugguaucguucuucugucucagagcacaauaccugaaaccgugcuagagcucacugaugcccuggcauuggggaugaugguccugaagaucgugagaaauauggaaaaauaccaguuagcuguuacaauuauggccauccucugcgugcccaacgcagucauucugcagaaugccuggaagguaucauguaccauccuugcugugguuaguguguccccacuguugcucacaucuagccaacagaaaacugacuggauaccucuggcgcuaaccauuaagggacugaaccccacggccaucuuccuuacaacccucuccaggacuaauaaaaagcgcucauggccacugaacgaggcaaucauggcugucggcauggugagcauuuuggccaguucucugcuaaagaaugacauaccgaugaccggcccucucguagccgggggacugcuuacagugugcuauguccugacuggucgguccgcugauuuggaacucgagagagcaaccgacguuaagugggaggaucaggccgaaaucagcggcucgucacccauucugucuaucacgauuagugaggacggguccaugagcaucaagaacgaagaggaggaacagacacuaaccauacugaucaggacuggacuucucgugauuucuggccuguuuccaaucagcauucccaucacagcggcugccugguacuugugggaggugaaaaagcaacgagccggugucuuaugggaugugccuuccccacccccuauggggaaagccgaacuggaggacggagcuuaucgcauaaagcagaaaggcauucucggcuacucacagaucggggcaggaguuuacaaggaagguaccuuccacacuauguggcauguaacacggggcgccgugcugaugcacaaggggaaaagaaucgagccgaguugggcggaugucaagaaagaccuuauuagcuauggaggcgguuggaagcuggagggggaauggaaagagggagaagaggugcagguuuuggcucuagaaccaggcaagaaucccagggccgugcaaaccaagccuggccuguuuaaaacgaacacugggaccaucggagcagucucucucgauuucuccccagguacaucaggcagucccauaauugacaagaaagggaaggugguaggacuguacggcaacggugucgugacccguagcggggccuauguuuccgcuaucgcccagacagagaaaucuauugaggauaauccugaaaucgaggacgauauauuucgcaagaagcggcuuacuauuauggacuuacacccgggagcaggcaaaaccaagagauaccugcccgcuaucgugagggaagccaucaaacgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccaaaguaacgccccaauaaucgacgaggaaagagagauucccgaaaggucuuggaauagcggccacgaguggguaacugauuuuaaggguaaaaccgugugguucguuccuuccaucaaggcagggaacgacauugccgcuugccugcgcaagaauggcaagaaggucauccagcucucacgaaaaacauuugauucugaauacgugaagaccagaacuaacgacugggauuucguggucacaaccgacauaagcgagaugggcgcgaauuuuaaagccgagcggguaaucgauccaaggcgcuguaugaagcccgugauuuuaacggacggcgaggaacguguuauccuggcagggccuaugccggugacucauaguuccgcugcccagagacggggaaggauuggucgcaaccccaaaaaugaaaacgaccaguacaucuauaugggcgagccccuugaaaaugaugaggacugcgcacacuggaaggaggccaagaugcugcucgauaacauaaauacaccugaagggauuauccccagcauguucgagccagaacgagagaaagucgacgcuauugauggagaauacagauugcggggcgaggccaggaagaccuuuguggaccugaugcgcagaggugaucucccuguuuggcuggcguauaaaguggcagccgaggggaucaacuacgcugacaggcggugguguuucgauggcauaaagaacaaucaaauccuugaagagaacgucgaaguggagauuuggaccaaagagggagaacguaagaagcuaaaaccccgcuggcuggacgcccgaaucuauucugauccauuggcuuuaaaggaguuuaaagaguucgcagccggcagaaagucacugacucucaaucugauuacagagauggggaggcuuccuaccuucaugacacagaaaacucgggacgcucuggauaaccucgccguauugcacacggcagaagcgggaggucgcgccuacaaucaugcucuguccgagcuaccggagacccuggaaacacuccuucuguuagccuugcuggcaacugugaccggcgggaucuuucucuuccugaugaguggaagaggcauagguaagaugacacuugggaugugcugcauuaucaccgcuagcauccugcucugguaugcccagauucagccccacuggaucgcagccucgauaauuuuggaguuuuuccugaucguuuuacuaauuccagaaccugagaagcaaaggacuccccaggacaaccagcugacguacgucgugaucgcuauacucaccguggucgcggccacaauggcaaaugaaaugggcuuucuugagaaaacuaagaaagaccugggauugggcucuaucgcuacccagcaaccagaguccaacauucuggauaucgaccuccggccugccagcgccuggacacuguacgcaguugcuaccacuuucgugacacccaugcuucgacauucaauugaaaauaguucuguaaacgugucccucacggccaucgcgaaucaggcuaccguccugaugggguugggaaaggguuggccgcugagcaaaauggauauuggcgugccauuacuagccaucggguguuauucacagguuaacccuauaacucugacagcagcccuccuucuguugguggcucacuacgcaauuaucggacccggccugcaggccaaggcgaccagagaggcucaaaagcgcgccgcagccgguaucaugaaaaauccaaccgucgacgggauuacaguaauagaucucgaccccaucccuuaugauccgaaguuugaaaaacagcugggccaggugaugcuuuuaauucugugcguuacucaagugcucaugaugaggacgaccugggcuuugugugaggcccugacacuagcaacuggacccaucaguacccugugggaaggcaacccagggcgguucuggaauacaaccauugcugucagcauggccaacaucuuucguggauccuaccucgcgggcgccggucuucuguucucuauaaugaagaauacuacgaacacaagaagggggaccggaaacaugggcgagacuuugggugagaaauggaaaagccgccugaaugcacucggcaaauccgaauuucagaucuauaagaagucagggauucaggagguggaccggacccuggcuaaagaaggaaucaagcgaggcgagacagaucaccaugccgucucuagagggagugcaaaauuaaggugguucguggagcgcaacaugguuacuccugaaggaaaggugguagaccuuggcugcgguagaggcggguggucguacuauugugggggucugaaaaaugugagagaggucaagggccucaccaaagggggacccggccacgaggaaccuauuccaaugagcacauacggguggaaccuaguucgucugcaguccggaguggaugucuuuuucaucccaccugaaaaaugcgacacguugcugugugauauaggcgagucuucaccaaaucccaccguggaggcugguaggacucuccggguacuuaaccugguggaaaauugguugaacaauaacacacaauucugcauuaagguucugaauccguacaugccuagcgugaucgagaaaauggaagcccuccagcgcaaguaugggggagccuuaguccgaaacccacuguccggcaaucuuaaaaacgagauguacugggugaguaaugcgucuggcaacaucgucagcucagugaacaugauuuccagaaugcugauaaauagguuuaccaugcggcauaagaaggcuacuuaugaacccgacguugaccuagggaguggaacacgcaacaucgguauugagagcgagaccccuaaucucgauaucauuggcaaaagaaucgaaaagauaaaacaggagcacgaaacgucuuggcauuacgaccaggaucacccauauaagaccugggcauaccacggguccuaugagacaaaacaaacuggaucagccagcucgaugguaaacggcguggucaggcuguugaccaagcccugggacgugcugccgacaguuacucagauggcuaugaccgauacaaccccuuucggucagcagcgaguguuuaaggaaaaagucgacacucggacgcaagagcccaaggaggggacuaaaaagcucaugaaaaucaccgccgaauggcuuuggaaggagcugggcaaaaagaagacuccacguauguguaccagagaagaguucacacgcaaagugaggucuaaugcagccuuaggcgcuauuuuuacggaugagaacaaguggaaaagugcgcgggaagccguagaggacuccagauucugggaacugguggauaaggagcgcaauuugcaucucgaaggcaaaugcgagaccuguguuuacaacaugauggggaagagggagaagaaacugggagaauuugguaaggcaaaaggcagccgagcuaucugguacauguggcuaggggcccgguuccuugaguuugaagcacugggauuccucaaugaggaccacugguuuucaagagaaaacucccugucuggcgucgagggugagggguugcauaagcugggauauauucucagggaugugagcaaaaaggaaggcggcgccauguacgcugacgacacugccgggugggauacacgcaucacccuugaggaccugaagaaugaagagauggugacuaaccacauggaaggagagcacaaaaaguuagcggaggcaauuuucaaacugacauaucagaauaaggucguucgugugcagcggccuacccccagagguacaguaauggauauaaucaguaggcgcgaccaacgaggcuccggacaggugggaacuuacggcuugaacaccuuuacgaauauggaagcccagcucauucggcagauggagggugaaggggucuucaaaaacauccaacaucugaccgugacagaggagguugcugugcagaacuggcuagccagagucggaagggaacgccuuagcagaauggcaaucucuggcgaugacugcgugguaaagccacuggaugaccgguucgcuaaugcccucacugcucugaacgauaugggcaagauuaggaaagacauacagcagugggagcccucaaagggguggaaugauuggacccaaguuccuuuuugcagucaccauuuccacgaauugaucaugaaagacggacguguguuagucgugccaugucgaaaccaggaugagcugauuggucgcgccagaaucucccagggcgcaggguggagccuccgggaaacagcgugccuuggaaagucuuaugcccagauguggucgcugauguacuuucauaggcgcgaccuaagacugguggcuaaugccauuuguucagcagucccgagccacuggguucccacuucccggaccacguggaguauccacgcuaaacaugaguggaugacaaccgaggacaugcucacuguguggaacaggguauggauacgagaaaauccuuggauggaggauaagacaccaguggaaucuugggaggaaauccccuauuugggcaagcgugaggaccaauggugcgguagccugauugggcuuaccuccagagccacuugggccaaaaacauccaggccgcgauuaaucagguccgcucacugaucggaaacgaggaauacaccgauuacaugccuaguaugaagcgguucaggagagaggaagaggaagcuggcgugcucugguga

SEQ ID NO: 14812 - RNA, 9876 nt, Artificial Sequence
  derived and/or modified CDS sequence (opt3) from DENV-2__FJ410224__SS-prME
agcgcaggcaugaucauuaugcugauccccaccgugauggcuuuccaccucaccacuagaaacggggagccucauaugaucgucgguauucaagaaaagggaaaaucccuucuguuuaagacggaggacggcguuaauaugugcaccuugauggcaauggauuuaggggaacugugugaggacacagugacuuacaaaugcccacuacucaggcaaaacgaaccggaggauaucgacuguuggugcaauucuaccucaacauggguaaccuauggaacuuguacaaccacgggcgagcaccggcgcgaaaagcgaaguguggcacuggucccccauguggguauggggcuugagacucguaccgaaacauggaugagcuccgagggagcguggaaacacgcucagagaauugagacuuggauccugaggcauccuggcuucaccauaauggccgcaaucuuggccuacacaauuggcaccacgcacuuucagcggguucucaucuucauucugcugacugcuguggcaccaucuaugacaaugcgcugcaucgggauaucgaacagagauuuugucgaaggagugucagguggcagcuggguagacauuguucucgagcacgggaguugugugaccacuauggccaagaauaagcccacauuagauuucgaacugaucaaaaccgaggcuaagcagccugccacgcuuaggaaauauugcauugaagcgaaguugaccaacacaacuaccgagucccgguguccaacacaaggagagcccucucugaaagaagaacaggacaagcgcuuugucugcaagcauagcaugguggaucgaggcugggguaauggguguggacuauucggcaaaggcgggaucgugacuugcgcaauguuuaccugcaagaaaaacauggaaggaaagaucguccagccugagaaucucgaauacacaauuguugugaccccacacuccggugaggagcaugccguaggcaacgacacugggaaacacggaaaggaaauaaaagugacgccgcagucaaguaucacagaggcugaacugaccggcuaugguacugucaccauggaguguagccccagaacagggcuugauuucaaugaaauggugcuguugcaaauggagaacaaggccuggcucguucacaggcagugguuucuggacuuaccucugccauggcuccccggcgcagauaagcaggagucuaauuggauucagaaagaaacccuugugacuuucaagaacccucaugcuaaaaagcaagacgucgugguacugggaucccaggagggcgccaugcacacagcguugacgggggccaccgaaauccagaugucaagcggaaaucuacuguuuacuggucaucucaaaugccggcugcguauggacaaacuucaacugaagggcaugaguuacucuauguguacagggaaauucaagguugugaaagagauagcagagacccagcacggaacaauugucauccgcgugcaguaugaaggcgaugguuccccaugcaagauccccuucgagauuauggacuuggagaagagauacguccucgggaggcugaucacugugaacccgauuguuaccgagaaggauagcccugugaacauagaagcugagcccccauuuggcgacucguacaucauuaucggaguagagccuggccaguuaaagcugaauugguucaaaaaggggucuuccaucggacaaauguuugaaacgaccaugcggggugccaaacgaauggcuauucuaggcgauacagccugggacuucgggucacucggaggcgucuuuacaaguauagguaaggcacugcaucagguguucggggccaucuauggcgcugcguuuagcggaguuuccuggaccaugaaaauucuuaucggcgugauuaucacauggauagggaugaacucucgcagcacuucauugagugucucccuggugcucguaggaaccgugacgcuguaccuuggcguuaugguccaggcagauagcgguuguguggugucuuggaagucaaaggagcugaaaugcgggaguggaaucuucauuacagacaauguccacaccuggacugaacaguauaaguuucaacccgagagcccauccaaauuggccucugcuauccagaaggcccaggaagagggcauuugugguaucagaucgguuacaaggcucgagaaccugauguggaaacagauaacccccgaauuaaaucacauucuggcagagaacgaagugaagcuaacuaucaugaccggcgauauuaaagggaucaugcaagccggaaagcggagccuccgcccucagccaacagagcugaaguacuccuggaaaacguggggcaaggcuaaaaugcuuucaaccgaaaguuauaaucagacuuucuugauagacgggccggagacagccgagugccccaacaccaauagagcauggaacucucuggaaguggaggauuacggauuuggcguauucacaacuaauaucuggcucaagcugaaagaaaagcaggacgcguuuugugacagcaaguuaauguccgcugccauuaaagauaacagggcaguccaugccgacauggguuauuggaucgagucagcucugaaugauaccuggaagauugagaaagccagcuucaucgaagugaagaacugccacuggccuaaaucucauacgcuuugguccaaugggguuuuggagagugaaaugauaauuccaaagaaccucgcaggacccgugagccaacacaacuaccguccuggcuaccacacacagaucgcugguccauggcaucugggcaagcuagagauggacuucgauuuuugugacgggaccacugucaucgugaccgaagauugcggaaaucggggccccucucugcgaacaacuaccgccuccgggaaacucauuacagaguggugcuguagaucaugcacgcugccgccucuuagguaucgcggagaggacggcuguugguacgguauggaaauccggccauugaaggagaaagaagagaaccugguuaauaguuuagugaccgcggggcacggacagguagauaacuucagccucggcguccuggguauggcccuuuuucuggaagagauguugagaacuagggugggcacaaagcaugcuauucuccugguggcagucucguucguuacccuaauaacugggaauauguccuuuaaagaccugggacgcgugguagugauggucggcgccacaauggcugaugacaucgggaugggagugaccuaucucgcccugcuugcagcguucaagguucgacccacguuugccgcuggcuugcuguuacggaagcucacuucuaaagagcugaugaugaccacaauugguaucgugcuucugagccaaucaaccauuccugaaacuguccuagagcucacagaugcccuggcauuggggaugauggugcugaagaucguucguaacauggaaaaauaccaguuagcugugaccauaauggccauccucugcguccccaaugcaguaauucugcagaacgccuggaaggugaguuguacaauccuugcuguuguguccgucucuccacuguugcucacuagcucccagcagaaaaccgacuggauuccucuggcgcuaacgaucaagggacugaaucccacagccauauuccuuaccacucucucaagaaccaacaaaaagaggagcuggccacugaaugaggcaauuauggcugugggcaugguaaguaucuuggccucuucccuguuaaagaacgacaucccgaugacaggcccucucguggccgggggacugcuuacugucugcuauguucugaccggucgcagcgcugauuuggaacucgagcgggcaacggacgugaaaugggaggaucaggccgaaauuucgggcucaucucccauacugaguaucacaauuuccgaggacgggagcaugucuaucaagaaugaagaggaggaacagacccuaacuauucugaucagaacaggacuucucgugauaagcggccuguuuccaaucuccauucccaucaccgcggcugccugguacuugugggaggucaaaaagcagagggccgguguguuaugggauguuccuucaccacccccuauggggaaagccgaacuggaggacggagcuuaucgaauuaagcaaaagggcauccucggcuacagucagauaggggcaggaguauacaaagaagguacuuuccacacaauguggcaugugacccgcggcgccguccugaugcacaaggggaaacggauugagccgagcugggcggaugugaagaaagaccuuaucucuuauggaggcgguuggaagcuggagggggaauggaaggagggagaagagguucagguguuggcucuagaaccaggcaaaaaccccagagccguccagacgaagccuggccuguuuaaaacuaauaccgggacaaucggagcagugucccucgauuucucaccagguaccaguggcagccccauuaucgacaagaaagggaagguagucggacuguacggcaacggugugguuacaagguccggggccuaugugucugcuauagcccaaacugagaagucgauugaggauaacccugaaaucgaggacgauauuuuucguaaacgccggcuuaccaucauggacuuacacccgggagcaggcaagacgaaaagauaccugcccgcuauagucagggaagccauuaagcgaggccuccggacauugauccuggcgccaacucgcgugguugccgcagagauggaagaggcucucagagggcugccuaucagguaucagacccccgccauucgggcugagcauacaggacgagaaaucguggaccuuaugugucacgcaaccuucacuaugagacuguugagcccaguccgcgugccuaauuacaaccuaauuauaauggaugaggcccauuucaccgaccccgccucaaucgcugcgagggguuauauuuccacacguguagaaaugggcgaggcagccgggaucuuuaugacggcuacuccaccgggaagucgggauccuuucccccagucuaaugccccaaucauugacgaggaaagagagauacccgaaaggagcuggaacuccggccacgagugggugaccgauuuuaaagguaagacaguuugguucgucccuucaaucaaggcagggaaugacauugccgcuugccugcgcaaaaacggaaagaaagugauccaacucucucgaaagaccuuugauagcgaauacgugaaaacuagaacaaaugacugggauuucgucguaaccacggacauuagugagaugggcgcgaacuuuaaggccgagcgggugaucgauccaaggcgcuguaugaaacccguuauauuaacugacggcgaagaacgugugauccuggcagggccuaugccggucacacauuccagcgcugcccagagacggggaaggauuggucgcaauccaaagaacgaaaaugaccaguacaucuauaugggcgagccccuugaaaacgaugaggacugcgcacacuggaaggaggccaaaaugcugcucgauaauauuaacaccccugaagggaucauacccucuauguucgagccagaacgagagaagguggacgcuauugauggagaauacagauugcggggcgaggccaggaaaaccuuuguugaccugaugcgcagaggugaucucccuguguggcuggcguauaaggucgcagccgaggggaucaauuacgcugacaggcggugguguuucgauggcauuaaaaacaaccagauccuugaagagaauguggaaguagagauauggacuaaggagggagaacguaagaaacuaaagccccgcuggcuggacgcccgaaucuauucagauccauuggcuuuaaaagaguuuaaggaguucgcagccggcagaaaaucccugacacucaaccugauuaccgagauggggaggcuuccuacauucaugacucaaaagacgcgggacgcucuggauaaucucgccguguugcacaccgcagaagcgggaggucgcgccuacaaccaugcucugagugagcuaccggagacacuggaaacucuccuucuguuaaccuugcuggccacaguuaccggcgggaucuuucucuuccugaugagcggaagaggcauugguaagaugacucuugggaugugcugcaucauaacggcaucgauucugcucugguaugcucagauccagccccacuggaucgccgcaucuauuaucuuggaguuuuuccugauagucuuacuaauuccagaaccugagaaacagaggacaccccaagacaaucagcugacauacguggugaucgccauucucacugucguugcugcgaccauggccaacgaaaugggcuuucuugagaagacuaaaaaggaccugggauugggcuccaucgcaacccagcagccagagagcaauauacuggauaucgaccuccggccugcuucagccuggacucuguacgccguggcaacaacguucguaacccccaugcuucgacauaguauugaaaacucuuccgugaaugucagccucacugcuaucgccaaccaagcgacagugcugaugggguugggaaaagguuggccgcugucaaagauggauauuggcguuccauuacuagcuaucggguguuauagucaggugaauccuauuacccugaccgccgcacuccuucuguuggucgcccacuacgcuaucauaggacccggccugcaggcaaaggccacaagagaggcgcagaaacgcgcugccgcagguauuaugaagaacccaacuguagacgggaucacggugaucgaucucgaccccauuccuuaugauccgaaauuugaaaagcaacugggccagguuaugcuuuuaauacugugcgugacccagguccucaugaugaggacaacuugggccuugugugaggcucugacccuagccacaggacccaucagcacccugugggaaggcaauccagggcgguucuggaacacuacgauugcaguguccauggcuaauaucuuucguggaucuuaccucgccggcgcgggucuucuguucagcauuaugaaaaacacaaccaauacuagaagggggaccggaaacaucggcgagacauugggugagaaguggaaaucccgccugaacgcccucggcaagucagaauuucaaacuuauaagaaaucugggauacaggaggucgaccggacccuggcaaaggaaggaaucaaacgaggcgagacagaucaccaugcugugaguagagggucggccaaguuaaggugguucguugagcgcaauauggugacgccugaaggaaaaguaguggaccuuggcugcgguagagggggauggagcuacuauuguggcggucugaagaacgucagagagguuaagggccucaccaaagggggacccggccacgaggaaccuauuccaauguccacuuacggguggaaucuagugcgucugcagucuggagucgauguguuuuucauacccccugaaaagugcgacacauugcugugugauauuggcgagucaagcccaaaccccaccguagaggcagguaggacucuccgggugcuuaaucugguugaaaacugguugaauaacaauacacaguucugcaucaaagugcugaacccguacaugccuuccgucauagagaagauggaagcucuccaacgcaaauaugggggagccuuagugcgaaauccacugaguagaaacucuacccaugagauguacugggucagcaaugccucaggcaacauuguguccaguguuaauaugaucagcaggaugcuuaucaaccgguuuacgaugcgccacaagaaggcgaccuaugaacccgacguagaccugggcucugggacaagaaacauuggaauagaguccgagaucccuaaucuagauauuaucgguaaaaggauugaaaagaucaaacaggagcaugaaacuucauggcacuacgaccaggaucacccauauaagaccugggcuuaccauggcagcuaugagacaaaacagacugggucggcaucuaguauggugaacggagucgugcgacuccugaccaagcccugggacguuuugccgacagugacccaaauggccaugacugauacgacaccuuucggccagcagcgggucuuuaaggaaaaaguggacacccguacucaggagcccaaggaggguaccaaaaagcugaugaaaauaacagcugaauggcucuggaaggagcuugggaaaaagaagacgccaagaauguguacccgcgaagaguucacuaggaaaguacgguccaaugccgcacugggagccaucuuuacagaugagaacaaguggaaaagcgcuagagaagcgguggaggacucacgcuucugggaauuaguugauaaggagaggaaucugcacuuggaaggcaaaugcgagaccugugucuacaacaugaugggcaagcgagagaagaaacucggggaauuuggaaaggccaaagguucccgggcaauuugguacauguggcugggcgcuagauuccuagaguuugaagcccuuggguuccugaaugaggaccauugguuuucuagggaaaacagccucaguggaguggagggcgagggucugcacaaguugggguauauccugcgcgauguguccaaaaaggaaggaggcgcaauguacgccgacgacacugcuggcugggauacacguauuacccucgaggaccuuaagaaugaagagauggucacaaaccacauggaaggggagcauaaaaagcuggccgaggcgaucuucaaauuaacuuaucaaaauaagguugugcggguacagagaccuacccccaggggaacggugauggauauuauaagccgccgagaccagcgggguucuggccaagucgggaccuacggacugaacacauuuacuaauauggaagcacaguugaucagacagauggagggcgaagguguguucaaaaacauucagcaccucaccguuacagaggagguggccguccaaaauuggcuggcuaggguggggcgcgaaagacuaucacggauggccaucaguggagaugacugcguaguuaagccacuugaugacagguucgcaaacgcucugacugcccucaacgauaugggcaagauccguaaagacauucagcagugggagcccuccaagggcuggaaugauuggacccaggugccuuuuugcagccaucacuuccaugaacugauaaugaaagacgggcgagucuugguggugccaugucgcaaccaagaugaguuaaucggacgggcucggauuucucagggugccggcuggucgcugagggaaacggcaugccucgggaagucauaugcgcagauguggagccuuauguacuuucaccgcagagaccugcggcuagccgcuaaugccaucuguuccgcagucccgagucacuggguucccacaucuaggaccacuuggagcauucaugcuaaacacgaguggaugacaaccgaggacaugcugacuguguggaaccgaguauggauccgugaaaauccuuggauggaggauaagaccccaguggaauccugggaggaaauacccuaucucggaaagagagaggaccaguggugcggcucauugaucggucugacaagucgcgccacgugggccaaaaacauucaagccgcgaucaaucagguccggucucuuauugggaacgaggaauacaccgauuacaugccuagcaugaagagguucagacgcgaggaagaggaagcuggagugcugugguga

SEQ ID NO: 14813 - RNA, 9876 nt, Artificial Sequence
  derived and/or modified CDS sequence (opt3) from DENV-2__FJ461321__SS-prME
agcgccggcaugauaauuaugcugauacccaccgugauggcuuuccaccucacuacuagaaacggggagccucauaugaucgucgggauucaagaaaaggguaaaucccuucuguuuaagacggaggacggcguuaauaugugcaccuugauggcaauggauuuaggggaacugugugaggacacgaucacuuacaaaugcccauuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcauucagugggcaacgacacugggaaacacggaauggaaaucaagguaacgccgcagaguagcauuacagaggccgaacugaccggcuaugguacugugaccauggaguguucucccagaacagggcuugauuucaaugaaaugguccuguugcaaauggagaacaaggcuuggcucgugcacaggcagugguuucuggacuuaccucugccauggcuccccggcgccgauaagcaggaguccaauuggauccagaaggaaacccuuguuacuuucaaaaacccucaugcaaagaaacaagacguggucgugcugggaucacaggagggcgcuaugcacacagccuugacgggggcgaccgaaauacagaugagcaguggaaaucuacuguuuacuggucaucucaagugccggcugcguauggacaaacuucaacugaagggcaugucuuacuccauguguacagggaaguucaaaguaguuaaggagauugccgagacccagcacggaacaaucgugauccgcguccaguaugaaggcgaugguagcccaugcaaaauucccuucgagaucauggacuuggaaaagagauacgugcucgggaggcugauuacugucaacccgauagugaccgagaaagauucgccuguuaacaucgaagcagagcccccauuuggcgacucuuacauuaucaucggaguggagccuggccaguuaaagcugaauugguucaagaaaggguccucaauuggacaaauguuugaaacgaccaugcggggugcuaagcgaauggccauacuaggcgauacagcuugggacuucgggagucucggaggcguauuuacuagcaucgguaaagcccugcaucaggucuucggggcaauuuauggcgccgcuuuuuccggagugucuuggaccaugaagauccuuauuggcguuaucauaacauggaucgggaugaacagccgcucaacaaguuuguccgugagccugguccucgugggaauuguaacccuguaccuuggcgugaugguucaggcggauucugguugugucgugucauggaaaaauaaggagcugaagugcgggaguggaaucuucauuacggacaacgugcacacauggaccgaacaguauaaauuucaacccgagagcccauccaaguuggcaucugccauccagaaagcucaggaagagggcauaugugguauuagaucggucacuaggcucgagaaucugauguggaagcagaucacacccgaauuaaaccacauucuggccgagaaugaaguuaaacuaaccaucaugacuggcgauauacgggggaucaugcaagcaggaaagcgcagccucagaccucagccaaccgagcugaaauacuccuggaagacauggggcaaggccaaaaugcuuucaacggaaaguuauaaccagaccuucuugauugacgggccggagacugcugagugccccaauacaaacagggccuggaacucucuggaaguggaggauuacggauuuggcguguucaccacaaacaucuggcucaagcugaaagaaaagcaggacgcauuuugugacagcaaauuaauguccgcggcuauuaaggauaaucgugccguacaugcagacauggguuauuggaucgagucagcccugaacgauacuuggaagauagagaaagcuagcuucauugaagucaagaauugccacuggccuaaaucucauacccuuugguccaacgggguguuggagagugaaaugaucaucccaaagaaccucgccggacccguuagccaacacaauuaccggccuggcuaccacacgcagauugcagguccauggcaucugggcaaacuagagauggacuucgauuuuugugacgggacaaccgugaucgucacugaagauugcggaaaccgaggccccucucugagaaccacaacugcuuccgggaagcucauuaccgaguggugcuguaggucaugcacacugccgccucuucgcuaucggggagaggacggcuguugguacgguauggaaauaagaccauugaaggagaaagaagagaaucuggugaacaguuuaguuacggccgggcacggacagguggauaauuucagccucggcguacuggguauggcgcuuuuucuggaagagauguugaggacccgcgucggcacuaagcaugccauccuccugguggcugugucguucgucacacuaauuaccgggaacauguccuuuaaagaccugggacgaguugugguaauggugggcgcaacuauggccgaugacaucgggaugggagucacauaucucgcucugcuugccgcauucaaggugcggcccaccuuugcggccggcuugcuguuacguaaacucacgucuaaggagcugaugaugacuaccauugguaucguucuucugagccaaucaacaauaccugaaaccgugcuagagcucacugaugcucuggccuuggggaugaugguccugaagaucgugagaaauauggaaaaauaccaguuagcaguuacaauuauggcuauccucugcgugcccaacgccgucauucugcagaaugcauggaagguaaguuguaccauccuugccgugguuuccgugucuccacuguugcucacaagcucccagcagaaaacugacuggauaccucuggcucuaaccauuaagggacugaaccccacggcgaucuuccuuacaacccucucaaggacuaauaaaaagcgcagcuggccacugaacgaggccaucauggcagucggcauggugaguauuuuggcuucuucccugcucaaaaaugacauaccgaugaccggcccucuaguagccgggggacugcuuacagugugcuauguccugacuggucggagcgccgauuuggaacucgagagagcuaccaacguuaagugggaggaccaggcagaaaucucgggcucaucucccauucugaguaucacgauuuccgaggaugggagcaugucuaucaagaaugaagaggaggaacagacacuaaccauacugaucaggacuggacuucucgugauuagcggccuguuuccaaucuccauucccaucacagccgcggcuugguacuugugggaggugaaaaagcagcgagccggugucuuaugggacgugccuucaccacccccuauggggaaagcagaacuggaggauggagccuaucgcauaaagcaaaaaggcauucucggcuacagucagaucggggcuggaguuuacaaggaagguaccuuccacacuauguggcauguaacacggggcgcagugcugaugcacaaggggaaaagaaucgagccgagcugggccgacgucaagaaagaucuuauuucuuauggaggcgguuggaagcuggagggggaauggaaagagggagaagaggugcagguuuuggcgcuagaaccaggcaagaaccccagggcugugcagaccaagccuggccuguuuaaaacgaacacugggaccaucggagccgucucccucgacuucucaccagguacaaguggcagccccauaauugauaagaaagggaaggugguaggacuguacggcaauggugucgugacccguuccggggcauauguuucugccaucgcucaaacagagaaaucgauugaggacaacccugaaaucgaggaugacauauuucgcaagcggagacuuacuauuauggauuuacacccgggagccggcaagaccaaaagguaccugcccgcaaucgugcgagaagcuaucaagcggggccuccgcacguugauucuggccccaacaagagucguggcggccgagauggaagaggcacucagggggcugccuauccgguaucagacucccgcuauucgagccgagcauaccggaagagaaauaguugaccuuaugugucacgcuacauucaccaugcgccuguugagcccagugagggucccuaauuacaaccuaaucauuauggacgaggcacauuucacugaucccgccucaaucgccgcucgugguuauaucuccacccggguggaaaugggcgaggcggcagggauuuuuaugacagccacgccaccgggaaguagagacccuuucccccagucuaaugcuccaauaaucgaugaggaaagggagauucccgaacgcagcuggaacuccggccacgaguggguaacugacuuuaaagguaagaccgugugguucguuccuucaaucaaagccgggaaugauauugcagccugccugcgaaagaacggaaagaaagucauccaacucucuagaaagacauuugacagcgaauacgugaaaacccggacuaaugauugggacuucguggucacaaccgauauaagugagaugggcgcuaacuuuaaggcggagaggguaaucgacccacgccguuguaugaaacccgugauuuuaacggauggcgaagagagaguuauccuggccgggccuaugccggugacucauuccagcgcagcucagcggaggggacgcauuggucgaaauccaaagaacgaaaaugaccaguacaucuauaugggcgagccccuugaaucugacgaggauugcgcccacuggaaagaggcaaagaugcugcucgacaacauaaauacaccugaagggauuauccccucaauguucgagccagaaagagagaaggucgaugccauugacggagaauaccgguugaggggcgaggcucgcaaaaccuuuguggaucugaugagaaggggugaccucccuguuuggcuggccuauaagguggcggcagaggggaucaacuacgccgaucggcguugguguuucgacggcaucaaaaauaaucagauccuugaagagaacgucgaaguggagauuuggaccaaggagggagaacgcaaaaagcuaaagccccgauggcuggaugcuagaaucuauuccgacccauuggccuuaaaagaguuuaaggaguucgcugcaggcaggaaaagucugacucucaaucugauuacagagauggggcggcuuccuaccuucaugacacaaaagacucgcgaugcccuggacaaccucgcuguauugcacacggccgaagcaggagguagagcguacaaucaugcccugagcgagcuaccggagacccuggaaacacuccuucuguuaacuuugcuggcuaccgugacaggcgggaucuuucucuuccugaugucgggaaggggcauagguaaaaugacccuugggaugugcugcauuaucacugccucuauccugcucugguaugcacagauucagccccacuggaucgcugccuccauaauuuuggaguuuuuccugaucguuuuacuaauuccagaaccugagaagcagcggacgccccaagauaaccagcugaccuacgucgugaucgcaauacucacaguggucgccgcuacuauggcgaaugaaaugggcuuucuugagaagaccaaaaaggaccugggauugggcagcaucgccacacagcagccagagucaaacauucuggacaucgaucuccgaccugcaagugcuuggacccuguacgccguugccacuacauucgugacgcccaugcuuagacauucuauugaaaauuccagcguaaacgugucacucaccgcaaucgcuaaucaagccacuguccugaugggguugggaaaagguuggccgcugaguaagauggacauuggcgugccauuacuagcgaucggguguuauagccagguuaacccuauaacacugaccgcugcccuccuucuguugguggcacacuacgccauuaucggacccggccugcaggcuaaagcaacccgcgaggcccagaagagggcggcugccgguaucaugaagaauccaacagucgaugggauuacuguaauagaccucgaucccaucccuuaugacccgaaauuugaaaagcaacugggccaggugaugcuuuuaauucugugcguuacacaggugcucaugaugcggaccacaugggcauugugugaggcccugacucuagcuaccggacccaucuccacacugugggaaggcaacccagggcguuucuggaauaccacuauugccgucucuauggcaaacaucuuuagaggaagcuaccucgcuggcgccggucuucuguucuccauaaugaaaaauacgacaaacaccaggcgcgggacuggaaacaucggcgagaccuugggugagaaguggaaaucacggcugaaugcgcucggcaagucugaauuucaaauuuauaaaaagagugggauccaggagguggaucgaacacuggccaaggaaggaauuaaaagaggcgagacugaccaccaugcagucucgagggggagcgcuaaguuacgcugguucguggagcggaacaugguuaccccugaaggaaaagugguagaucuuggcugcgguagagggggaugguccuacuauuguggcggucugaagaaugugcgugaggucaaaggccucacaaaagggggacccggccacgaggaaccuaucccaaugucuacguacggguggaaccuaguuaggcugcagucaggaguggacgucuuuuucauacccccugaaaagugcgauaccuugcugugugacauuggcgagagcuccccaaaucccacuguggaggccggucggacacuccgcguacuuaaccugguggaaaauugguugaacaauaacacccaguucugcaucaaaguucugaauccguacaugccuagugugaucgagaagauggaagcacuccaacgaaaauaugggggagcuuuagucagaaacccacugucuaggaauagcacucaugagauguacugggugucaaacgccuccggcaauauugucaguagcgugaacaugauaucucggaugcuuaucaaccgcuuuacaaugagacacaagaaagccaccuaugaacccgauguugaccugggcuccgggacgaggaauauuggaaucgagucagagauuccuaaccuagacaucauagguaagcgaaucgaaaagauuaaacaggagcaugaaaccagcuggcacuacgaucaggaccacccauauaagacaugggcguaccauggcucguaugagacuaaacagaccgggucugcuaguuccaugguaaauggagugguccggcuccugacaaagcccugggauguguugccgacuguuacccaaauggcaaugacagacaccacuccuuucggccagcagcguguguuuaaagaaaaggucgauacgagaacacaggagcccaaggaggguaccaaaaagcugaugaaaaucacugccgaauggcucuggaaggagcuugggaaaaagaaaaccccacgcauguguacaagggaagaguucacgcggaaggugagaagcaacgcugcccugggagcaauuuuuaccgacgagaauaaguggaaaucagcccgcgaagcuguagaggauuccagguucugggaauuaguggacaaggagcgaaaccugcacuuggaaggcaaaugcgagacuuguguuuacaauaugaugggcaagcgggagaaaaagcucggggaauuuggaaaggcgaaagguucuagagccaucugguacauguggcugggcgcaagguuccuagaguuugaagcucuuggguuccugaacgaggaucauugguuuagccgcgaaaauagucucuccggagucgagggcgagggucugcacaaguugggguauauucugcgugacgugagcaaaaaggaaggaggcgccauguacgcagaugacacagccggcugggacacccggauaacucucgaggaucuuaaaaacgaagagauggugacaaaucacauggaaggggagcauaagaagcuggcugaggccaucuucaaauuaaccuaucaaaacaaggucguuagagugcagaggccuacaccccgcggaacuguaauggacauuaucucucgacgggaucagagagguucaggccaaguggggaccuacggacugaauacguuuaccaacauggaagcgcaguugaucaggcagauggagggcgaaggugucuucaaaaauauucagcaccucacagugacugaggagguugcagugcauaacuggcuggcccgcgucgggagagaacggcuaaguaggauggcuauauccggagacgauugcgugguaaagccacuugacgaucguuucgccaacgcacugaccgcucucaaugacaugggcaaaauccgaaaggauauucaacagugggagcccagcaagggcuggaacgacuggacacagguuccuuuuugcucucaccauuuccacgaacugaucaugaaagaugggcgcauuuugguggucccauguagaaaucaggacgaguuaaucggacgggccaggauaucgcaaggugcuggcuggucacugcgcgaaacugccugccucggaaagagcuaugcacagauguggucccuuauguacuuucacagacgggaucugaggcuagcggccaacgcuaucuguagugccgugccgucucauugggugcccaccagccgaacgacaugguccauucacgcaaaacaugaguggaugaccacugaggacaugcugacagucuggaaucguguuuggaucagagaaaacccuuggauggaggacaagaccccaguggaaucaugggaggaaauucccuaucucggaaaacgcgaggaucaguggugcggcaguuugaucggucugacuucucgggcuaccugggccaagaauauacaggcagccauuaaccaaguaaggagccuuaucgggaaugaggaauacacagacuacaugccuuccaugaagagauuccgccgggaggaagaggaagcgggagugcugugguga

SEQ ID NO: 14814 - RNA, 9876 nt, Artificial Sequence
  derived and/or modified CDS sequence (opt3) from DENV-2__FJ410228__SS-prME
agcgcaggcaugaucauuaugcugauaccaaccgugauggcuuuccaccucacuacucgaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccauuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaagacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauacgggggaucaugcaagccggaaagcgcucgcucagaccucagccaaccgagcugaaauacagcuggaagacauggggcaaggcuaaaaugcuuuccacggaaucauauaaccagaccuucuugauugacgggccggagacugccgagugccccaauacaaacagggcauggaauagucuggaaguggaggauuacggauuuggcguguucaccacaaacaucuggcucaagcugaaagaaaagcaggacgcguuuugugacucuaaauuaaugagcgcugccauuaaggauaaucgugcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccggccuggcuaccacacgcagauugcugguccauggcaucugggcaaacuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaggagaaagaagagaaucuggugaacucauuaguuacggcggggcacggacagguggauaauuucagucucggcguacuggguauggcccuuuuucuggaagagauguugaggacccgcgucggcacuaagcaugcuauccuccugguggcagugagcuucgucacacuaauuaccgggaacaugucguuuaaagaccugggacgaguugugguaauggugggcgccacuauggcugaugacaucgggaugggagucacauaucucgcccugcuugcagcguucaaggugcggcccaccuuugccgcuggcuugcuguuacguaaacucacguccaaggagcugaugaugacuaccauugguaucguucuucugucucaaagcacaauaccugaaaccgugcuagagcucacugaugcccuggcauuggggaugaugguccugaagaucgugagaaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaagacugacuggauaccucuggcgcuaaccauuaagggacugaaccccacggccaucuuccuuacaacccucuccaggacuaauaaaaagcgcucauggccacugaacgaggcaaucauggcugucggcauggugagcauuuuggccaguucucugcucaaaaaugacauaccgaugaccggcccucuaguagccgggggacugcuuacagugugcuauguccugacuggucgguccgcugauuuggaacucgagagagcaaccgacguuaagugggaggaucaggccgaaaucagcggcucgucacccauucugucuaucacgauuagugaggacggguccaugagcaucaagaacgaagaggaggaacagacacuaaccauacugaucaggacuggacuucucgugauuucuggccuguuuccaaucagcauucccaucacagcggcugccugguacuugugggaggugaaaaagcagcgagccggugucuuaugggaugugccuuccccacccccuauggggaaagccgaacuggaggacggagcuuaucgcauaaagcaaaaaggcauucucggcuacucacagaucggggcaggaguuuacaaggaagguaccuuccacacuauguggcauguaacacggggcgccgugcugaugcacaaggggaaaagaaucgagccgaguugggcggaugucaagaaagaccuuauuagcuauggaggcgguuggaagcuggagggggaauggaaagagggagaagaggugcagguuuuggcucuagaaccaggcaagaaucccagggccgugcagaccaagccuggccuguuuaaaacgaacacugggaccaucggagcagucucucucgauuucuccccagguacaucaggcagucccauaauugacaagaaagggaaggugguaggacuguacggcaacggugucgugacccguagcggggccuauguuuccgcuaucgcccaaacagagaaaucuauugaggauaauccugaaaucgaggacgauauauuucgcaagcggagacuuacuauuauggacuuacacccgggagcaggcaagaccaaaagguaccugcccgcuaucgugcgagaagccaucaagcggggccuccgcacguugauucuggcgccaacaagagucguggccgcagagauggaagaggcucucagggggcugccuauccgguaucagacucccgccauucgagcugagcauaccggaagagaaauaguugaccuuaugugucacgcaacauucaccaugcgccuguugucgccagugagggucccuaacuacaaucuaaucauuauggaugaggcccauuucacugaccccgccagcaucgcugcgcgugguuauaucucaacccggguggaaaugggcgaggcagccgggauuuuuaugacagcuacgccaccgggauccagagauccuuucccccagaguaacgccccaauaaucgacgaggaaagggagauucccgaacgcucuuggaauagcggccacgaguggguaacugauuuuaacgguaaaaccgugugguucguuccuuccaucaaggcagggaaugacauugccgcuugccugcggaaaaacggaaagaaggucauccaacucucaagaaaaacauuugauucugaauacgugaagaccagaacuaaugacugggauuucguggucacaaccgacauaagcgagaugggcgcgaacuuuaaagccgagaggguaaucgauccacgccguuguaugaagcccgugauuuuaacggacggcgaagagagaguuauccuggcagggccuaugccggugacucauaguuccgcugcccagcggaggggacgcauuggucgaaaucccaaaaacgaaaaugaccaguacaucuauaugggcgagccccuugaaaacgaugaggacugcgcacacuggaaggaggccaaaaugcugcucgauaauauaaacacaccugaagggauuauccccagcauguucgagccagaaagagagaaggucgacgcuauugauggagaauaccgguugaggggcgaggcccgcaagaccuuuguggaccugaugagaaggggugaucucccuguuuggcuggcguauaaaguggcagccgaggggaucaacuacgcugaccggcguugguguuucgauggcauaaagaauaaccagauccuugaagagaaugucgaaguggagauuuggaccaaagagggagaacgcaagaaacuaaagccccgauggcuggacgccagaaucuauucugauccauuggcuuuaaaggaguuuaaagaguucgcagccggcaggaagucacugacucucaaccugauuacagagauggggcggcuuccuaccuucaugacacagaaaacucgcgacgcucuggauaaucucgccguauugcacacggcagaagcgggagguagagccuacaaccaugcucuguccgagcuaccggagacccuggaaacacuccuucuguuaacuuugcuggccaccgugacaggcgggaucuuucucuuccugaugaguggaaggggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaaacagcggacgccccaagacaaucagcugaccuacgucgugaucgccauacucacaguggucgcugcgacuauggccaacgaaaugggcuuucuugagaagaccaagaaagaccugggauugggcucuaucgcaacacagcagccagaguccaauauucuggauaucgaccuccgaccugcuagcgccuggacccuguacgccguugcaacuacauucgugacgcccaugcuuagacauucaauugaaaacaguucuguaaaugugucccucaccgcuaucgccaaccaagcgacuguccugaugggguugggaaaggguuggccgcugagcaaaauggauauuggcgugccauuacuagcuaucggguguuauucacagguuaauccuauaacacugaccgccgcacuccuucuguugguggcccacuacgcuauuaucggacccggccugcaggcaaaggccacccgcgaggcgcagaaaagggcugccgcagguaucaugaagaacccaacagucgacgggauuacuguaauagaucucgaccccaucccuuaugauccgaaguuugaaaaacaacugggccaggugaugcuuuuaauucugugcguuacacaggugcucaugaugcggaccacaugggccuugugugaggcucugacucuagccaccggacccaucaguacacugugggaaggcaauccagggcguuucuggaacaccacuauugcagucagcauggcuaauaucuuuagaggauccuaccucgccggcgcgggucuucuguucucuauaaugaagaacacgacaaacaccaggcgcgggacuggaaauaucggcgagaccuugggugagaaauggaaaagccggcugaacgcccucggcaaauccgaauuucaaauuuauaagaaaucagggauccaggagguggaccgaacacuggcaaaggaaggaauuaagagaggcgagacugaucaccaugcugucucuagggggagugccaaauuacgcugguucguggagcggaauaugguuaccccugaaggaaaggugguagaccuuggcugcgguagagggggauggucguacuauuguggcggucugaaaaacgugcgugaggucaagggccucacaaaagggggacccggccacgaggaaccuaucccaaugagcacguacggguggaaucuaguuaggcugcaguccggaguggaugucuuuuucauacccccugaaaagugcgacaccuugcugugugauauuggcgagucuucaccaaaccccacuguggaggcaggucggacacuccgcguacuuaaucugguggaaaacugguugaauaacaauacccaguucugcaucaagguucugaacccguacaugccuagcgugaucgagaaaauggaagcucuccaacgaaaguaugggggagccuuagucagaaauccacuguccaggaacaguacucaugagauguacugggugucuaaugccagcggcaacauugucucauccgugaacaugauaagucggaugcuuaucaaucgcuuuacaaugagacacaaaaaggcgaccuaugaacccgacguugaccugggcagcgggacgaggaacauuggaaucgagucugagauuccuaaucuagauaucauagguaaacgaaucgaaaagauuaagcaggagcaugaaaccuccuggcacuacgaccaggaucacccauauaaaacaugggcuuaccauggcucauaugagacuaagcagaccgggagcgcaucgucuaugguaaacggagugguccggcuccugacaaaacccugggacguguugccgacuguuacccaaauggccaugacagauaccacuccuuucggccagcagcguguguuuaaggaaaaagucgacacgagaacacaggagcccaaggaggguaccaagaaacugaugaagaucacugcugaauggcucuggaaagagcuugggaagaaaaagaccccacgcauguguacaagggaagaguucacgcggaaagugagaaguaaugccgcacugggagccauuuuuaccgaugagaacaaguggaaguccgcucgcgaagcgguagaggacagcagguucugggaauuaguggauaaagagcgaaaucugcacuuggaaggcaagugcgagacuuguguuuacaacaugaugggcaaacgggagaagaaacucggggaauuuggaaaggccaaggguucaagagcaaucugguacauguggcugggcgcuagguuccuagaguuugaagcccuuggguuccugaaugaggaccauugguuuucccgcgaaaacucucucagcggagucgagggcgagggucugcacaaauugggguauauucugcgugaugugaguaagaaagaaggaggcgcaauguacgccgacgacacagcuggcugggauacccggauaacucucgaggaccuuaagaaugaagagauggugacaaaccacauggaaggggagcauaaaaagcuggccgaggcgaucuucaaguuaaccuaucaaaauaaagucguuagagugcagaggccuacaccccgcggaacuguaauggauauuaucucccgacgggaccagagagguagcggccaaguggggaccuacggacugaacacguuuaccaauauggaagcacaguugaucaggcagauggagggcgaaggugucuucaagaacauucagcaccucacagugacugaggagguugccgugcauaacuggcuggcucgcgucgggagagaacggcuaucuaggauggccauaucaggagaugacugcgugguaaaaccacuugaugaccguuucgcaaaugcucugaccgcccucaacgauaugggcaagauccgaaaagacauucaacagugggagcccaguaagggcuggaaugauuggacacagguuccuuuuugcucccaccauuuccacgaacugaucaugaaggacgggcgcauuuugguggucccauguagaaaccaggaugaguuaaucggacgggcuaggauaagccaaggugccggcuggucucugcgcgaaacugcaugccucgggaaaucguaugcgcagauguggucacuuauguacuuucacagacgggaccugaggcuagccgcuaaugccaucuguagcgcagugccgucccauugggugcccaccagucgaacgacauggucuauucacgcuaagcaugaguggaugaccacugaggacaugcugacagucuggaaccguguuuggaucagagaaaauccuuggauggaggauaaaaccccaguggaaagcugggaggaaauucccuaucucggaaagcgcgaggaccaguggugcggcuccuugaucggucugacuucacgggccaccugggccaaaaacauacaggccgcgauuaaucaaguaaggagucuuaucgggaacgaggaauacacagauuacaugccuucuaugaagagauuccgccgggaggaagaggaagcuggagugcugugguga

SEQ ID NO: 14815 - RNA, 9876 nt, Artificial Sequence
  derived and/or modified CDS sequence (opt3) from DENV-2__FJ410233__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucagcacaauuaccguccuggcuaccacacgcagauugcugguccauggcaucugggcaagcuagagauggacuucaacuuuugugaugggacaaccgugaucgucacugaagacugcggaaaucggggccccagccugcgaaccacaacugccucugggaagcucauuaccgaguggugcuguagauccugcacacugccgccucuuagguaucgcggagaggauggcuguugguacgguauggaaauacggccauugaaagagaaggaagagaaccuggugaauucauuaguuacggcggggcacggacaaguggacaacuucagucucggcguacuggguauggcccuuuuucuggaagagauguugagaaccagggucggcacuaaacaugcuauccuccugguggcagugagcuucgucacacuaauuaccgggaauaugucguuuaaggaucugggacgcguugugguaauggugggcgccacuaugacagacgauaucgggaugggagucaccuaucucgcucugcuugccgcauucaaagugcgacccacguuugcggccggcuugcuguuacggaagcucacuuccaaggagcugaugaugaccacaauugguaucguucuucugucucagagcaccauaccugaaacugugcuagagcucacagacgcucuggccuuggggaugaugguccugaaaaucgugcguaacauggaaaaguaccaguuagcaguuaccauuauggcuauccucugcgugcccaaugccgucauucugcagaacgcauggaaaguaucauguacaauccuugccgugguuaguguguccccacuguugcucacuucuagccaacagaagaccgauuggauaccucuggcucuaacgauuaaaggacugaaucccacagcgaucuuccuuaccacucucuccagaaccaacaagaaaaggucauggccacugaaugaggccaucauggcagucggcauggugagcauuuuggcuaguucucuguuaaagaacgacauaccgaugacaggcccucucguagccgggggacugcuuacugugugcuauguccugaccggucgcuccgccgacuuggaacucgagcgggcuacggauguuaagugggaggaccaggcagaaaucagcggcucgucacccauucugucuaucacaauuagugaggauggguccaugagcaucaaaaaugaagaggaggaacagacccuaacuauacugaucagaacaggacuucucgugauuucuggccuguuuccaaucagcauucccaucaccgccgcggcuugguacuugugggaggugaagaaacaaagggccggugucuuaugggacgugccuuccccacccccuauggggaaggcagaacuggaggauggagccuaucgaauaaaacagaagggcauucucggcuacucacagaucggggcuggaguuuacaaggaagguacuuuccacacaauguggcauguaacccgcggcgcagugcugaugcacaaagggaagcggaucgagccgaguugggccgacgucaaaaaggaucuuauuagcuauggaggcgguuggaaacuggagggggaauggaaggagggagaagaggugcagguuuuggcgcuagaaccaggcaagaaccccagagcugugcaaacgaaaccuggccuguuuaagacuaacaccgggacaaucggagccgucucucucgacuucuccccagguaccucaggcagucccauaauugauaaaaaggggaaagugguaggacuguacggcaauggugucgugacaaggagcggggcauauguuuccgccaucgcucagacugagaagucuauugaggacaacccugaaaucgaggaugacauauuucguaagcgccggcuuaccauuauggauuuacacccgggagccggcaaaacgaagagauaccugcccgcaaucgugagggaagcuaucaaacgaggccuccggacauugauucuggccccaacucgcgucguggcggccgagauggaagaggcacucagagggcugccuaucagguaucagacccccgcuauucgggccgagcauacaggacgagaaauaguugaccuuaugugucacgcuaccuucacuaugagacuguugucgccagugcgcgucccuaauuacaaccuaaucauuauggacgaggcacauuucaccgaucccgccagcaucgccgcuagggguuauaucucaacacguguggaaaugggcgaggcggcagggauuuuuaugacggccacuccaccgggaucccgggacccuuucccccaaaguaaugcuccaauaaucgaugaggaaagagagauucccgaaaggucuuggaacagcggccacgaguggguaaccgacuuuaaggguaaaacagugugguucguuccuuccaucaaggccgggaaugauauugcagccugccugcgcaagaacggaaaaaaggucauccagcucucacgaaaaaccuuugacucugaauacgugaagacuagaacaaaugauugggacuucguggucaccacggauauaagcgagaugggcgcuaacuuuaaagcggagcggguaaucgacccaaggcgcuguaugaagcccgugauuuuaacugauggcgaagagcguguuauccuggccgggccuaugccggugacacauaguuccgcagcucagagacggggaaggauuggucgcaauccaaaaaacgaaaaugaccaguacaucuauaugggcgagccccuugaaaacgacgaggauugcgcccacuggaaggaggcaaagaugcugcucgacaauauaaacaccccugaagggauuauccccagcauguucgagccagaacgagagaaagucgaugccauugacggagaauacagauugcggggcgaggcuaggaagaccuuuguggaucugaugcgcagaggugaccucccuguuuggcuggccuauaaaguggcggcagaggggaucaacuacgccgauaggcggugguguuucgacggcauaaagaauaaccaaauccuugaagagaauauggaagucgagauuuggacuaaagagggagaacguaagaagcuaaaaccccgcuggcuggaugcucgaaucuauucugacccauuggccuuaaaggaguuuaaagaauucgcugcaggcagaaagucacugacacucaaccugauuaccgagauggggaggcuuccuacauucaugacucagaaaacgcgggaugcccuggacaaucucgcuguguugcacaccgccgaagcaggaggucgcgcguacaaccaugcccuguccgagcuaccggagacacuggaaacucuccuucuguuaaccuugcuggcuacaguaaccggcgggaucuuucucuuccugaugaguggaagaggcauagguaagaugacucuugggaugugcugcauuaucacggccagcauccugcucugguaugcacagauucagccccacuggaucgcugccucgauaauuuuggaguuuuuccugaucguguuacuaauuccagaaccugagaagcaaaggaccccccaggauaaucagcugacauacguugucaucgcaauacucacugugguggccgcuaccauggcgaacgaaaugggcuuucuugagaaaacaaagaaagaccugggauugggcucuaucgccacccggcagccagaguccaauauucuggacaucgaucuccgaccugcaagcgcuuggacucuguacgccgucgccacaacguucguuacccccaugcuuagacauucaauugaaaacaguucugugaauguaucccucacugcaaucgcuaaccaagccacagugcugaugggguugggaaaggguuggccgcugagcaaaauggacauuggcgucccauuacuagcgaucggguguuauucacaggugaauccuauaacccugaccgcugcccuccuucuguugguugcacacuacgccauuaucggacccggccugcaggcuaaggcaacacgcgaggcccagaagagggcggcugccgguaucaugaaaaacccaacuguggaugggauuacggucauagaccucgaucccaucccuuaugacccgaaguuugaaaaacaacugggccagguaaugcuuuuagugcugugcguuacccaggugcucaugaugcggacaacuugggcauugugugaggcccugacccuagcuacaggacccauuaguacccugugggaaggcaauccagggcguuucuggaacacuacgaucgccgucagcauggcaaauauuuuuagaggauccuaccucgcuggcgccggucuucuguucucuaucaugaagaacacaaccaacacuaggcgcgggaccggaaauaugggcgagacauugggugagaaauggaagagccggcugaacgcgcucggcaaauccgaauuucaaauauauaagaagucagggauccaggagguggaucgaacucuggccaaagaaggaauuaagagaggcgagaccgaccaccaugcagucucuagggggagugcuaaauuacgcugguucguggagcggaauaugguuacaccugaaggaaaggugguagaucuuggcugcgguagagggggauggucguacuauuguggcggucugaaaaacgugcgugaggucaagggccucacgaaggggggacccggccacgaagagccuaucccaaugagcaccuacggguggaaucuaguuaggcugcaguccggaguggacgucuuuuucauucccccugaaaaaugcgauacuuugcugugugacaucggcgagucuucaccaaaccccacaguggaggccggucggacccuccgcguacuuaaucugguggaaaacugguugaauaacaauacucaguucugcauaaagguucugaacccguacaugccuagcgugauugagaaaauggaagcacuccaacgaaaguaugggggagcuuuagucagaaauccacuguccaggaacaguacacaugagauguacugggugucuaaugccagcggcaacaucgucucauccgugaacaugaucagucggaugcuuauuaaucgcuuuaccaugagacacaaaaaggccacguaugaacccgauguugaccugggcagcgggaccaggaacauaggaaucgagucugagauuccuaaucuagacaucauugguaagcgaaucgaaaaaauaaagcaggagcaugaaacauccuggcacuacgaucaggaccacccauauaaaacuugggcguaccauggcucauaugagaccaagcagacagggagcgcuucgucuaugguaaacggagugguccggcuccugacuaaacccugggauguguugccgaccguuacacaaauggcaaugaccgacacuacgccuuucggccagcagcguguguuuaaggaaaaggucgauacaagaacccaggagcccaaagaggguacuaagaaacugaugaagaucaccgccgaauggcucuggaaagagcuugggaagaaaaagacaccacgcauguguacgagggaagaguucacccggaaggugagaaguaaugcugcccugggagcaauuuuuacugacgagaacaaauggaaguccgcccgcgaagcuguagaggauagcagguucugggaauuaguggacaaagagcgaaaucugcacuuggaaggcaagugcgagacauguguuuacaacaugaugggcaaacgggagaagaagcucggggaauuuggaaaagcgaaggguucaagagccaucugguacauguggcugggcgcaagguuccuagaguuugaagcucuuggguuccugaaugaggaucauugguuuucccgcgaaaacucucucagcggagucgagggcgagggucugcacaaauugggguauauucugcgugacgugaguaagaaagaaggaggcgccauguacgcagaugacaccgccggcugggacacucggaucacacucgaggaucuuaagaaugaagagauggugaccaaccacauggaaggggagcauaagaaacuggcugaggccauuuucaaguuaacauaucaaaauaaagucguuagagugcagaggccuacuccccgcggaaccguaauggacauaaucucccgacgggaucagagagguagcggccaaguggggacguacggacugaacaccuuuacaaauauggaagcgcaguugauuaggcagauggagggcgaaggugucuucaagaacauccagcaccucacugugaccgaggagguugcagugaaaaacuggcuggcccgcgucgggagagaacggcuaucuaggauggcuaucucaggagacgauugcgugguaaagccacuugacgaucguuucgccaaugcacugacagcucucaacgacaugggcaagauucgaaaagauauacaacagugggagcccaguaagggcuggaaugacuggacucagguuccuuuuugcucccaucacuuccaugaacugaucaugaaagaugggcgcguguuggucgugccauguagaaaccaggacgaguuaauuggacgggccaggaucagccaaggugcuggcuggucucugcgcgaaaccgccugccucgggaagucguaugcacagauguggucacuuauguacuuucacagacgggaucugaggcuagcggccaaugcuauuuguagcgccgugccgucccacuggguccccacgagucgaacaaccuggucuauccaugcaaaacacgaguggaugacuacagaggacaugcugaccguuuggaaccguguguggauaagagaaaauccuuggauggaggacaagacuccaguagaaagcugggaggaaauccccuaucucggaaagcgcgaggaucaguggugcggcuccuugauuggucugaccucacgggcuacaugggccaaaaacauccaggcagccauuaaucaagugaggagucuuaucgggaacgaggaauacacggacuacaugccuucuaugaagagauuccgccgggaggaagaggaagcgggaguccugugguga

SEQ ID NO: 14816 - RNA, 9876 nt, Artificial Sequence
  derived and/or modified CDS sequence (opt3) from DENV-2__FJ410237__SS-prME
agcgccggaaugaucauuaugcugauacccaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuaugacagaugacaucgggaugggagucaccuaucucgcucugcuugccgcauucaaagugcgacccacguuugcggccggcuugcuguuacggaagcucacuuccaaggagcugaugaugaccacaauugguaucguucuucugucucagagcaccauaccugaaacugugcuagagcucacagaugcucuggccuuggggaugaugguccugaaaaucgugcguaauauggaaaaguaccaguuagcaguuaccauuauggcuauccucugcgugcccaacgccgucauucugcagaaugcauggaaaguaucauguacaauccuugccgugguuaguguguccccacuguugcucacuucuagccaacagaagaccgacuggauaccucuggcucuaacgauuaaaggacugaaccccacagcgaucuuccuuaccacucucuccagaaccaauaagaaaaggucauggccacugaacgaggccaucauggcagucggcauggugagcauuuuggcuaguucucuguuaaagaaugacauaccgaugacaggcccucucguagccgggggacugcuuacugugugcuauguccugaccggucgcuccgccgauuuggaacucgagcgggcuacggacguuaagugggaggaucaggcagaaaucagcggcucgucacccauucugucuaucacaauuagugaggacggguccaugagcaucaaaaacgaagaggaggaacagacccuaacuauacugaucagaacaggacuucucgugauuucuggccuguuuccaaucagcauucccaucaccgccgcggcuugguacuugugggaggugaagaaacaaagggccggugucuuaugggaugugccuuccccacccccuauggggaaggcagaacuggaggacggagccuaucgaauaaaacagaagggcauucucggcuacucacagaucggggcuggaguuuacaaggaagguacuuuccacacaauguggcauguaacccgcggcgcagugcugaugcacaaagggaagcggaucgagccgaguugggccgaugucaaaaaggaccuuauuagcuauggaggcgguuggaaacuggagggggaauggaaggagggagaagaggugcagguuuuggcgcuagaaccaggcaagaaucccagagcugugcaaacgaaaccuggccuguuuaagacuaacaccgggacaaucggagccgucucucucgauuucuccccagguaccucaggcagucccauaauugacaaaaaggggaaagugguaggacuguacggcaacggugucgugacaaggagcggggcauauguuuccgccaucgcucagacugagaagucuauugaggauaauccugaaaucgaggacgauauauuucguaagcgccggcuuaccauuauggacuuacacccgggagccggcaaaacgaagagauaccugcccgcaaucgugagggaagcuaucaaacgaggccuccggacauugauucuggccccaacucgcgucguggcggccgagauggaagaggcacucagagggcugccuaucagguaucagacccccgcuauucgggccgagcauacaggacgagaaauaguugaccuuaugugucacgcuaccuucacuaugagacuguugucgccagugcgcgucccuaacuacaaucuaaucauuauggaugaggcacauuucaccgaccccgccagcaucgccgcuagggguuauaucucaacacguguggaaaugggcgaggcggcagggauuuuuaugacggccacuccaccgggaucccgggauccuuucccccaaaguaacgcuccaauaaucgacgaggaaagagagauucccgaaaggucuuggaauagcggccacgaguggguaaccgauuuuaaggguaaaacagugugguucguuccuuccaucaaggccgggaacgacauugcagccugccugcgcaagaauggcaagaaggucauccagcucucacgaaaaaccuuugauucugaauacgugaagacuagaacaaacgacugggauuucguggucaccacggacauaagcgagaugggcgcuaauuuuaaagcggagcggguaaucgauccaaggcgcuguaugaagcccgugauuuuaacugacggcgaagaacguguuauccuggccgggccuaugccggugacacauaguuccgcagcucagagacggggaaggauuggucgcaaccccaaaaaugaaaacgaccaguacaucuauaugggcgagccccuugaaaaugaugaggacugcgcccacuggaaggaggcaaagaugcugcucgauaacauaaauaccccugaagggauuauccccagcauguucgagccagaacgagagaaagucgacgccauugauggagaauacagauugcggggcgaggcuaggaagaccuuuguggaccugaugcgcagaggugaucucccuguuuggcuggccuauaaaguggcggcagaggggaucaacuacgccgacaggcggugguguuucgauggcauaaagaacaaucaaauccuugaagagaacgucgaaguggagauuuggacuaaagagggagaacguaagaagcuaaaaccccgcuggcuggacgcucgaaucuauucugauccauuggccuuaaaggaguuuaaagaguucgcugcaggcagaaagucacugacacucaaucugauuaccgagauggggaggcuuccuacauucaugacucagaaaacgcgggacgcccuggauaaccucgcuguauugcacaccgccgaagcaggaggucgcgcguacaaucaugcccuguccgagcuaccggagacacuggaaacucuccuucuguuaaccuugcuggcuacagugaccggcgggaucuuucucuuccugaugaguggaagaggcauagguaagaugacucuugggaugugcugcauuaucacggccagcauccugcucugguaugcacagauucagccccacuggaucgcugccucgauaauuuuggaguuuuuccugaucguuuuacuaauuccagaaccugagaagcaaaggaccccacaggacaaccagcugacauacgucgugaucgcaauacucacuguggucgccgcuaccauggcgaaugaaaugggcuuucuugagaaaacaaagaaagaccugggauugggcucuaucgccacccagcaaccagaguccaacauucuggauaucgaccuccggccugcaagcgcuuggacucuguacgccguugccacaacguucgugacccccaugcuucgacauucaauugaaaauaguucuguaaacgugucccucacugcaaucgcuaaucaggccacaguccugaugggguugggaaaggguuggccgcugagcaaaauggauauuggcgugccauuacuagcgaucggguguuauucacagguuaacccuauaacccugaccgcugcccuccuucuguugguggcacacuacgccauuaucggacccggccugcaggcuaaggcaacaagagaggcccaaaagcgcgcggcugccgguaucaugaaaaauccaacugucgacgggauuacgguaauagaucucgaccccaucccuuaugauccgaaguuugaaaaacagcugggccaggugaugcuuuuaauucugugcguuacccaagugcucaugaugaggacaacuugggcauugugugaggcccugacccuagcuacaggacccaucaguacccugugggaaggcaacccagggcgguucuggaauacuacgauugccgucagcauggcaaacaucuuucguggauccuaccucgcuggcgccggucuucuguucucuauaaugaagaauacaaccaacacuagaagggggaccggaaacaugggcgagacauugggugagaaauggaaaagccgccugaaugcgcucggcaaauccgaauuucagaucuauaagaagucagggauucaggagguggaccggacucuggccaaagaaggaaucaagcgaggcgagaccgaucaccaugcagucucuagagggagugcuaaauuaaggugguucguggagcgcaacaugguuacaccugaaggaaaggugguagaccuuggcugcgguagagggggauggucguacuauuguggcggucugaaaaaugugagagaggucaagggccucacgaaagggggacccggccacgaggaaccuauuccaaugagcaccuacggguggaaccuaguucgucugcaguccggaguggaugucuuuuucaucccaccugaaaaaugcgacacuuugcugugugauauaggcgagucuucaccaaaucccacaguggaggccgguaggacccuccggguacuuaaccugguggaaaauugguugaacaauaacacucaauucugcauuaagguucugaauccguacaugccuagcgugaucgagaaaauggaagcacuccagcgcaaguaugggggagcuuuaguccgaaacccacuguccagaaauaguacacaugagauguacugggugucuaacgccagcggcaauaucgucucauccgugaacaugauuaguaggaugcuuauaaaccgguuuaccaugcgccacaaaaaggccacguaugaacccgacguugaccugggcagcgggaccagaaauaucggaauugagucugagaucccuaaccuagauauuaucgguaagaggauagagaaaaucaagcaggagcaugaaacauccuggcacuacgaccaggaucacccauauaaaacuugggcguaccauggcucauaugagaccaagcaaacagggagcgcuucgucuaugguaaauggagugguccgacuccugacuaaacccugggacguguugccgaccguuacacagauggcaaugaccgauacuacgccuuucggccagcagcggguguuuaaggaaaaggucgacacacguacccaagagcccaaagaggguacuaagaaacugaugaagauuaccgccgaauggcucuggaaagagcuugggaagaaaaagacaccaagaauguguacgcgcgaagaguucaccaggaaggugcggaguaacgcugcccugggagcaaucuuuacugaugagaauaaauggaaguccgccagagaagcuguagaggacagccgcuucugggaauuaguggauaaagagaggaaccugcacuuggaaggcaagugcgagacauguguuuacaauaugaugggcaaacgagagaagaagcucggggaauuuggaaaagcgaaggguucacgggccauuugguacauguggcugggcgcaagauuccuagaguuugaagcucuuggguuccugaacgaggaccauugguuuuccagggaaaauucucucagcggagucgagggcgagggucugcacaaauugggguauauccugcgcgaugugaguaagaaagaaggaggcgccauguacgcagacgacaccgccggcugggauacucguauuacacucgaggaccuuaagaacgaagagauggugaccaaucacauggaaggggagcauaagaaacuggcugaggccauauucaaguuaacauaucagaacaaagucguucgggugcagagaccuacucccaggggaaccguaauggauaucauuucccgccgagaccaacgggguagcggccagguggggacguacggacugaauaccuuuacaaacauggaagcgcaguugaucagacagauggagggcgaaggugucuucaagaauauccaacaccucacugugaccgaggagguugcagugaaaaacuggcuggccagggucgggcgcgaaagacuaucucggauggcuauuucaggagaugacugcgugguaaagccacuugaugacagguucgccaacgcacugacagcucucaaugauaugggcaagauacguaaagacauccagcagugggagcccaguaagggcuggauugauuggacucagguuccuuuuugcucccaucacuuccaugaacugaucaugaaagacgggcgaguguuggucgugccaugucgcaaccaagaugaguuaauugguagagcccggaucagccagggagcuggcuggucucugagggaaaccgccugccucgggaagucguaugcacagauguggucacuuauguacuuucaccgcagagaccugcggcuagcggccaaugcuauauguagcgccgugccgucccacuggguccccacgaguaggacaaccuggucuauccaugcaaaacacgaguggaugacuacagaggacaugcugaccguuuggaaccgaguguggauucgugaaaauccuuggauggaggauaagacuccaguagaaagcugggaggaaauccccuaucucggaaagagagaggaccaguggugcggcuccuugauuggucugaccucacgcgcuacaugggccaaaaacauccaagcagccauaaaucaggugcggagucuuauugggaacgaggaauacgcggauuacaugccuucuaugaagagguucagacgcgaggaagaggaagcuggaguccugugguga

SEQ ID NO: 14817 - RNA, 9876 nt, Artificial Sequence
  derived and/or modified CDS sequence (opt3) from DENV-2__FJ410241__SS-prME
agcgcaggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugaaaaccagagucggcacuaagcaugcuauccuccugguggcagugagcuucgucacacuaauuaccgggaacaugucguuuaaagaccugggaaggguugugguaauggugggcgccacuauggcugaugacaucgggaugggagucacauaucucgcccugcuugcagcguucaaggugcgccccaccuuugccgcuggcuugcuguuacgaaagcucacguccaaagagcugaugaugacuaccauugguaucguucuucugucucagagcacaauaccugaaaccgugcuagagcucacugaugcccuggcauuggggaugaugguccugcggaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccaacagaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaagugggaggaucaggccgaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagcggcugccugguacuugugggaggugaagaaacaaagggccggugucuuaugggaugugccuuccccacccccuauggggaaggccgaacuggaggacggagcuuaucgaauaaaacagaagggcauucucggcuacucacagaucggggcaggaguuuacaaggaagguaccuuccacacuauguggcauguaacacgcggcgccgugcugaugcacaaagggaagcggaucgagccgaguugggcggaugucaaaaaggaccuuauuagcuauggaggcgguuggaaacuggagggggaauggaaggagggagaagaggugcagguuuuggcucuagaaccaggcaagaaucccagagccgugcaaaccaaaccuggccuguuuaagacgaacacugggaccaucggagcagucucucucgauuucuccccagguacaucaggcagucccauaauugacaaaaaggggaaagugguaggacuguacggcaacggugucgugaccaggagcggggccuauguuuccgcuaucgcccagacagagaagucuauugaggauaauccugaaaucgaggacgauauauuucguaagcgccggcuuacuauuauggacuuacacccgggagcaggcaaaaccaagagauaccugcccgcuaucgugagggaagccaucaaacgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccaaaguaacgccccaauaaucgacgaggaaagagagauucccgaaaggucuuggaauagcggccacgaguggguaacugauuuuaaggguaaaaccgugugguucguuccuuccaucaaggcagggaacgacauugccgcuugccugcgcaagaauggcaagaaggucauccagcucucacgaaaaacauuugauucugaauacgugaagaccagaacuaacgacugggauuucguggucacaaccgacauaagcgagaugggcgcgaauuuuaaagccgagcggguaaucgauccaaggcgcuguaugaagcccgugauuuuaacggacggcgaagaacguguuauccuggcagggccuaugccggugacucauaguuccgcugcccagagacggggaaggauuggucgcaaccccaaaaaugaaaacgaccaguacaucuauaugggcgagccccuugaaaaugaugaggacugcgcacacuggaaggaggccaagaugcugcucgauaacauaaauacaccugaagggauuauccccagcauguucgagccagaacgagagaaagucgacgcuauugauggagaauacagauugcggggcgaggccaggaagaccuuuguggaccugaugcgcagaggugaucucccuguuuggcuggcguauaaaguggcagccgaggggaucaacuacgcugacaggcggugguguuucgauggcauaaagaacaaucaaauccuugaagagaacgucgaaguggagauuuggaccaaagagggagaacguaagaagcuaaaaccccgcuggcuggacgcccgaaucuauucugauccauuggcuuuaaaggaguuuaaagaguucgcagccggcagaaagucacugacucucaaucugauuacagagauggggaggcuuccuaccuucaugacacagaaaacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaagcaaaggacgccccaggacaaccagcugaccuacgucgugaucgccauacucacaguggucgcugcgacuauggccaaugaaaugggcuuucuugagaaaaccaagaaagaccugggauugggcucuaucgcaacacagcaacuggaguccaacauucucgauaucgaccugcggccagcuagcgccuggacccuuuacgccguugcaacuacauucgugacgccuaugcuccgacauucaauugaaaauaguucuguaaacgugucccugaccgcuaucgccaaucaggcgacugucuugauggggcugggaaaggguuggcccuuaagcaaaauggauauuggcgugccgcuacuggcuaucggguguuauucacagguuaacccaauaacacucaccgccgcacuucuguugcugguggcccacuacgcuauuaucggaccuggccuccaggcaaaggccaccagagaggcgcaaaagcgcgcugccgcagguaucaugaaaaaucccacagucgacgggauuacuguaauagaucuggacccaauccccuaugauccuaaguuugaaaaacagcuuggccaggugauguuacugauucucugcguuacgcaaguguugaugaugaggaccacaugggcccugugugaggcucuaacucuggccaccggaccgaucaguacacucugggaaggcaaccccgggcgguucuggaauaccacuauugcagucagcauggcuaacaucuuucguggauccuaccuugccggcgcgggucuguuguucucuauaaugaagaauacgacaaacaccagaagggggacuggaaacaugggcgagacccugggugagaaauggaaaagccgccucaaugcccugggcaaauccgaauuucagaucuauaagaagucagggauucaggagguggaccggacauuagcaaaagaaggaaucaagcgaggcgagacugaucaccaugcugucucuagagggagugccaaacuuaggugguucguggagcgcaacaugguuaccccagaaggaaaggugguagaccugggcugcgguagagggggauggucguacuauuguggcggucucaaaaaugugagagaggucaagggccuaacaaaagggggaccuggccacgaagaaccaauuccuaugagcacguacggguggaaccugguucguuugcaguccggaguggaugucuuuuucaucccacccgaaaaaugcgacacccugcucugugauauaggcgagucuucaccuaauccaacuguggaggcagguaggacacuucggguacugaacuugguggaaaauuggcugaacaauaacacccaauucugcauuaagguucucaaucccuacaugccgagcgugaucgagaaaauggaggcuuuacagcgcaaguaugggggagcccugguccgaaacccucuuuccagaaauaguacucaugagauguacugggugucuaacgccagcggcaauaucgucucauccgugaacaugauuaguaggaugcugauaaaccgguuuacaaugcgccacaaaaaggcgaccuaugaaccagacguugaccuaggcagcgggacgagaaauaucggaauugagucugagauccccaaccucgauauuaucgguaagaggauagagaaaaucaagcaggagcaugaaaccuccuggcacuacgaccaggaucacccuuauaaaacaugggcuuaccauggcucauaugagacuaagcaaaccgggagcgcaucgucuaugguaaauggagugguccgacuguugacaaaaccaugggacgugcugcccacuguuacccagauggccaugacagauaccacuccguucggccagcagcggguguuuaaggaaaaggucgacacgcguacacaagagccuaaagaggguaccaagaaacucaugaagauuacugcugaauggcuuuggaaagagcuggggaagaaaaagacccccagaauguguacacgcgaagaguucacgaggaaggugcggaguaacgccgcauuaggagccaucuuuaccgaugagaauaaauggaaguccgcuagagaagcgguagaggacagccgcuucugggaacugguggauaaagagaggaacuugcaccucgaaggcaagugcgagacuuguguuuacaauaugaugggcaaacgagagaagaagcugggggaauuuggaaaagccaaggguucacgggcaauuugguacauguggcuaggcgcuagauuccuugaguuugaagcccugggguuccucaacgaggaccauugguuuuccagggaaaauucucugagcggagucgagggcgaggguuugcacaaacugggguauauccuccgcgaugugaguaagaaagaaggaggcgcaauguacgccgacgacacagcuggcugggauacccguauuacucuugaggaccugaagaacgaagagauggugacaaaucacauggaaggggagcauaagaaauuagccgaggcgauauucaagcugaccuaucagaacaaagucguucgggugcagagaccaacaccuaggggaacuguaauggauaucauuucccgccgagaccaacgggguagcggccagguggggaccuacggauugaauacguuuaccaacauggaagcacagcucaucagacagauggagggcgaaggugucuucaagaauauccaacaccugacagugacugaggagguugccgugcagaacuggcuagcuagggucgggcgcgaaagacuuucucggauggccauuucaggagaugacugcgugguaaaaccccuggaugacagguucgcaaacgcucucaccgcccugaaugauaugggcaagauacguaaggacauccagcagugggagccaaguaaaggcuggaacgauuggacacaaguucccuuuugcucccaucacuuccaugaauugauuaugaaggacgggcgaguguuagucgugccuugucgcaaucaggaugagcugaucgguagagcucggauuagccagggagccggcuggucucucagggaaacugcaugccuugggaaaucguaugcgcagauguggucacugauguacuuucaccgcagagaccuacggcuggccgcuaacgccaucuguagcgcagugccaucccacugggucccgaccaguaggacgacauggucuauacaugcuaagcacgaguggaugaccacugaggacaugcucacaguuuggaaucgaguguggauccgugaaaaccccuggauggaggauaaaaccccuguagaaagcugggaggaaauuccauauuugggaaagagagaggaccaauggugcggcucccugaucggucuuacuucacgcgccaccugggcaaagaauauucaggccgcgaucaaccaggugcggagucugauagggaaugaggaauacacagauuacaugcccucuaugaaaagguucagacgcgaggaagaggaagcuggaguccucugguga

SEQ ID NO: 14818 - RNA, 9876 nt, Artificial Sequence
  derived and/or modified CDS sequence (opt3) from DENV-2__FJ410259__SS-prME
agcgccggcaugaucauuaugcugauccccaccgugauggcuuuccaccucaccacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccauuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguacaaccgaggcugaacugacuggcuaugguaccgugacaauggaguguagccccagaaccgggcuugauuucaaugaaaugguccuguugcaaauggagaacaaagccuggcucgugcacaggcagugguuucuggacuuaccucugccauggcuccccggcgcagauaagcaggagucuaauuggauucagaaggaaacucuuguuacauucaaaaacccucaugcuaagaaacaagacguggucgugcugggaucccaggagggcgccaugcacacggcguugaccggggccacugaaauccagaugucaagcggaaaucuacuguuuacaggucaucucaagugccggcugcguauggacaaacuucaacugaagggcaugaguuacucuauguguaccgggaaguucaaaguaguuaaggagauagcagagacacagcacggaacuauugugauccgcguccaguaugaaggcgaugguuccccaugcaaaauccccuucgagauuauggacuuggaaaagagauacgugcucgggaggcugaucaccgucaacccgauugugacggagaaagauagcccuguuaacauagaagcugagcccccauuuggcgacucguacaucauuaucggaguggagccuggccaguuaaagcugaauugguucaagaaagggucuuccaucggacaaauguuugaaaccacaaugcggggugccaagcgaauggcuauucuaggcgauacugccugggacuucgggucacucggaggcguauuuaccaguauagguaaagcacugcaucaggucuucggggccaucuauggcgcugcguuuagcggaguguccuggacaaugaagauucuuaucggcguuauuaucacuuggauagggaugaacucucgcagcaccucauugagugugucccugguccucgugggaaucguaacgcuguaccuuggcgugaugguucaggcagauagcgguugugucgugucuuggaaaaauaaggagcugaagugcgggucaggaauuuucaucacagacaacgugcacaccuggacugaacaguauaaauuucaacccgagaguccaagcaaguuggccuccgcuauucagaaagcccaggaagagggcaucugugguauaagaucugucacaaggcucgagaaucugauguggaagcagauuacccccgaauuaaaccacauccuggcagagaaugaaguuaaacuaacuauuaugaccggcgauauccgggggauaaugcaagccggaaagcgcucgcucagaccucagccaacagagcugaaauacagcuggaagacguggggcaaggcuaaaaugcuuuccaccgaaucauauaaccagacuuucuugaucgacgggccggagacagccgagugccccaauaccaacagggcauggaauagucuggaaguggaggauuacggauuuggcguguucacaacuaacauuuggcucaagcugaaagaaaagcaggacgcguuuugugacucuaaauuaaugagcgcugccaucaaggauaaucgugcaguacaugccgacauggguuauuggauugaguccgcucugaacgauaccuggaagaucgagaaagccucauucauagaagucaagaauugccacuggccuaaaagccauacgcuuuggucuaacgggguguuggaguccgaaaugauuaucccaaagaaccucgcaggacccguuagucaacacaauuaccggccuggcuaccacacacagaucgcugguccauggcaucugggcaaacuagagauggacuucgauuuuugugacgggaccacugugauugucaccgaagauugcggaaaccgaggccccagccugagaacaacuaccgccucugggaagcucaucacagaguggugcuguagguccugcacgcugccgccucuucgcuaucggggagaggacggcuguugguacgguauggaaauuagaccauugaaggagaaagaagagaaucuggugaacucauuaguuaccgcggggcacggacagguggauaauuucagucucggcguacuggguauggcccuuuuucuggaagagauguugaggacucgcgucggcacaaagcaugcuauacuccuggcagccgugagcuucgugacccuaaucacugggaacaugucguuuaaagaccugggacgagucguugugaugguaggcgcuacaauggccgaugacauugggaugggagugaccuaucucgcacugcuugcggccuucaagguccggcccacguuugcugccggcuugcuguuacguaaacucacuuccaaggagcugaugaugaccacaaucgguauugugcuucugucucaaagcaccaucccugaaacuguucuagagcucacagaugcacuggcuuuggggaugauggugcugaagauagucagaaauauggaaaaauaccaguuagccgugaccaucauggcaauucucugcguucccaacgccgugauccugcagaaugcuuggaaggucucauguacaauucuugcgguagugaguguuuccccacuguugcucacuucuagccagcagaagacagacuggaucccucuggcccuaacgauaaagggacugaaccccacagcaauuuuccuuaccacucucuccaggaccaauaaaaagcgcucauggccacugaacgaggcuaucauggccgugggcauggucagcaucuuggccaguucucugcucaaaaaugacauuccgaugacaggcccucuaguggcugggggacugcuuacuguaugcuaugugcugaccggucgguccgcagauuuggaacucgagagagccacggacgucaagugggaggaucaggcggaaauaagcggcucgucacccauccugucuauuacaaucagugaggacggguccaugagcauuaagaacgaagaggaggaacagacccuaacuauccugauaaggacaggacuucucguuaucucuggccuguuuccaauuagcauccccauuaccgcugccgcaugguacuugugggaggugaaaaagcagcgagccgguguguuaugggaugucccuuccccacccccuauggggaaagcugaacuggaggacggagcauaucgcaucaagcaaaaaggcauacucggcuacucacagauuggggccggaguguacaaggaagguacuuuccacacaauguggcauguuacccggggcgcgguacugaugcacaaggggaaaagaaucgagccgaguugggcugaugugaagaaagaccuuaucagcuauggaggcgguuggaagcuggagggggaauggaaagagggagaagagguccagguguuggcccuagaaccaggcaagaaucccagggcaguucagacgaagccuggccuguuuaaaacuaacaccgggacaauuggagccgugucucucgauuucuccccagguaccucaggcagucccaucauagacaagaaagggaaggucgugggacuguacggcaacgguguagucacacguagcggggcuuauguguccgccauugcacaaacugagaaaucuaucgaggauaauccugaaauugaggacgauaucuuucgcaagcggagacuuaccauaauggacuuacacccgggagcuggcaagacgaaaagguaccugcccgccauuguucgagaagcgaucaagcggggccuccgcacauugauccuggccccaacuagaguggucgcagcugagauggaagaggcccucagggggcugccuauucgguaucagacccccgcuauccgagcagagcauacaggaagagaaauuguggaccuuaugugucacgccaccuucacuaugcgccuguugucgccaguuagggugccuaacuacaaucuaauaaucauggaugaggcccauuucaccgaccccgcuagcauugcggcacgugguuauaucucaacacgggucgaaaugggcgaggccgcugggaucuuuaugacggccacuccaccgggauccagagauccuuucccccagaguaacgcaccaauuauagacgaggaaagggagauccccgaacgcucuuggaauagcggccacgagugggugaccgauuuuaaagguaagacaguaugguucgugccuuccauuaaagccgggaacgacaucgcugcgugccugcgaaagaauggaaagaaaguuauucaacucucaagaaagaccuuugauucugaauacgucaaaacucggacaaacgacugggauuucguggugaccacggacaucagcgagaugggcgccaauuuuaaggcagagagggucauagauccacgccguuguaugaaacccguaaucuuaacugacggcgaagagagagugauucuggcugggccuaugccgguuacacauaguuccgccgcacagcggaggggacgcaucggucgaaacccaaagaaugaaaacgaccaguacauuuauaugggcgagccccuugaaaaugaugaggacugcgcccacuggaaagaggcuaagaugcugcucgauaacaucaauaccccugaagggauaauucccagcauguucgagccagaaagagagaagguggacgccaucgauggagaauaccgguugaggggcgaggcgcgcaaaaccuuugucgaccugaugagaaggggugaucucccuguguggcuggcauauaagguugccgcugaggggauuaacuacgccgaccggcguugguguuucgauggcaucaaaaacaaucagauacuugaagagaacguggaagucgagaucuggacuaaggagggagaacgcaaaaagcuaaagccccgauggcuggacgcuagaauuuauucugauccauuggcauuaaaagaguuuaaggaguucgccgcuggcaggaaaucacugacacucaaucugaucaccgagauggggcggcuuccuacauucaugacucaaaagacgcgcgacgcccuggauaaccucgcaguguugcacaccgcggaagccggagguagagcuuacaaucaugcccuguccgagcuaccggagacacuggaaacucuccuucuguuaaccuugcuggcaacaguaaccggcgggauuuuucucuuccugaugaguggaaggggcaucgguaaaaugacucuugggaugugcugcauaauuacggcuagcauccugcucugguaugcccagauccagccccacuggauugcagccucgaucauauuggaguuuuuccugauuguguuacuaaucccagaaccugagaagcagcggacaccccaagacaaccagcugacauacguugucauugcuauccucacugugguggcggccaccauggcaaaugaaaugggcuuucuugagaagaccaaaaaggaccugggauugggcucuauagcuacccagcagccagaguccaacauccuggauauugaccuccgaccugccagcgccuggacucuguacgcagucgcuacaacguucguuacccccaugcuuagacauucaaucgaaaauaguucugugaacguaucccucacugccauugcgaaucaagcuacagugcugaugggguugggaaaagguuggccgcugagcaagauggauaucggcgucccauuacuagccauuggguguuauucacaggugaacccuaucacccugaccgcagcccuccuucuguugguugcucacuacgcaauaauuggacccggccugcaggccaaagcgacacgcgaggcucagaagagggccgcagccgguaucaugaagaauccaacuguggacgggaucacggucauugaucucgaccccauaccuuaugauccgaaauuugaaaagcaacugggccagguaaugcuuuuaauccugugcgugacccagguucucaugaugcggacaacuugggcuuugugugaggcccugacccuagcaacaggacccauuaguacccugugggaaggcaacccagggcguuucuggaauacuacgaucgcugugagcauggccaacauuuuuagaggauccuaccucgcgggcgccggucuucuguucucuaucaugaaaaauacaaccaacacuaggcgcgggaccggaaacauaggcgagacauugggugagaaguggaaaagccggcugaaugcacucggcaaguccgaauuucaaaucuauaaaaagucagggauucaggaggucgaccgaacucuggcuaaggaaggaaucaaaagaggcgagaccgaucaccaugccgugucuagggggagugcaaaguuacgcugguucgucgagcggaacauggugacaccugaaggaaaaguuguggaccuuggcugcgguagagggggauggucguacuauuguggcggucugaagaauguacgugaggugaaaggccucacgaaagggggacccggccacgaggaaccuauuccaaugagcaccuacggguggaaccuagucaggcugcaguccggaguugauguguuuuucauacccccugaaaagugcgacacuuugcugugugauauaggcgagucuucaccaaaucccacagucgaggcuggucggacccuccgcgugcuuaaccugguagaaaauugguugaacaauaacacucaguucugcauuaaagugcugaauccguacaugccuagcguuaucgagaagauggaagcccuccaacgaaaauaugggggagccuuagugagaaacccacuguccaggaauaguacacaugagauguacugggucucuaacgcgagcggcaauaucgugucauccgucaacaugauuagucggaugcuuauaaaccgcuuuaccaugagacacaagaaagcuacguaugaacccgacguggaccugggcagcgggaccaggaauaucggaauugagucugagaucccuaaccuagauauuaucgguaagcgaauagaaaagaucaaacaggagcaugaaacauccuggcacuacgaccaggaucacccauauaagacuugggcauaccauggcucauaugagaccaaacagacagggagcgccucgucuaugguuaauggaguagugcggcuccugacuaagcccugggacgucuugccgaccgugacacaaauggcuaugaccgauacuacgccuuucggccagcagcguguuuuuaaagaaaagguggacacaagaacccaggagcccaaggaggguacuaaaaagcugaugaaaauuaccgccgaauggcucuggaaggagcuugggaaaaagaaaacaccacgcauguguacgagggaagaguucacccggaaggucagaaguaacgcagcccugggagcuaucuuuacugaugagaauaaguggaaauccgcgcgcgaagccguggaggacagcagguucugggaauuaguagauaaggagcgaaaccugcacuuggaaggcaaaugcgagacauguguguacaauaugaugggcaagcgggagaaaaagcucggggaauuuggaaaggcaaaagguucaagagcuauuugguacauguggcugggcgccagguuccuagaguuugaagcacuuggguuccugaacgaggaccauugguuuucccgcgaaaauucucucagcggaguugagggcgagggucugcacaaguugggguauauccugcgugaugucaguaaaaaggaaggaggcgccauguacgcugacgacaccgccggcugggauacucggauuacacucgaggaccuuaaaaacgaagagauggugaccaaucacauggaaggggagcauaagaagcuggcggaggcaauauucaaauuaacauaucaaaacaagguggucagaguucagaggccuacuccccgcggaaccgugauggauaucauuucccgacgggaccagagagguagcggccaaguagggacguacggacugaauaccuuuacaaacauggaagcccaguugaucaggcagauggagggcgaagguguguucaaaaauauccagcaccucacugucaccgaggagguggcuguucauaacuggcuggcccgcguggggagagaacggcuaucuaggauggcaauuucaggagaugacugcgucgugaagccacuugaugaccguuucgcuaacgcccugacagcucucaaugauaugggcaaaauacgaaaggacauccaacagugggagcccaguaagggcuggaacgauuggacucagguaccuuuuugcucccaccauuuccacgaacugauuaugaaagacgggcgcaucuugguugugccauguagaaaucaggaugaguuaauuggacgggccaggaucagccaaggugcaggcuggucucugcgcgaaaccgcgugccucgggaagucguaugcccagauguggucacuuauguacuuucacagacgggaccugaggcuagcugccaacgcaauauguagcgcugucccgucccauugggugcccacgagucgaacaaccuggucuauccacgccaaacaugaguggaugacuacagaggacaugcugaccguguggaaucgugucuggauuagagaaaacccuuggauggaggauaagacuccaguugaaagcugggaggaaauccccuaucucggaaaacgcgaggaccaguggugcggcuccuugauuggucugaccucacgggcaacaugggccaagaauauccaggcggcuauaaaccaagugaggagucuuauugggaaugaggaauacacggauuacaugccuucuaugaagagauuccgccgggaggaagaggaagccggaguacugugguga

SEQ ID NO: 14819 - RNA, 9876 nt, Artificial Sequence
  derived and/or modified CDS sequence (opt3) from DENV-2__FJ547067__SS-prME
agcgccggaaugaucauuaugcugauaccaaccgugauggcuuuccaccucacuacuagaaacggggagccucauaugaucguaggcauucaggaaaaggguaaaucccuucuguuuaagacggaggacggaguuaauaugugcaccuugauggcaauggauuuaggggaacugugugaggacacuaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagcggaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugagaaccagggucggcacuaaacaugcuauccuccugguggcaauuagcuucgugacacuaaucaccgggaacaugucguuuaaggaccugggacgcgucguugugaugguaggcgccacuauggcugaugacauugggaugggagugacauaucucgcccugcuugcagcguucaaaguccgacccaccuuugccgcuggcuugcuguuacggaagcucacguccaaggagcugaugaugacuaccaucgguauagugcuucugucucagagcacaaucccugaaaccguucuagagcucacugaugcccuggcauuggggaugauggugcugaaaauuguccguaauauggaaaaguaccaguuagcugugacaaucauggccauucucugcguucccaacgcagugauccugcagaaugccuggaaagucucauguaccauacuugcugcgguaaguguguccccacuguugcucacaucuagccaacagaagacugacuggauuccucuggcccuaaccaucaaaggacugaaccccacggcaaucuuccuuacaacccucuccagaacuaauaagaaaaggucauggccacugaacgaggcuauuauggccguuggcauggugagcauauuggccaguucucuguuaaagaaugacaucccgaugaccggcccucucgucgcugggggacugcuuacagugugcuauguacugacuggucgcuccgcagauuuggaacucgagcgggccaccgacgugaagugggaggaacaggcggagauuagcggcucgucacccauccugucuauuacgaucagugaagauggguccaugagcaucaagaacgaggaggaggaacagacacuaaccauccugauuagaacuggacuucucgucaucucuggccuguuuccaauuagcauccccauaacagcugccgcaugguacuugugggaaguuaagaaacaaagggccgguguguuaugggacgugccuuccccacccccuauggggaaggcugagcuggaagauggagcauaucgaauuaaacagaagggcauccucggcuacucacagaucggggccggagucuacaaggaggguaccuuccacacuauguggcaugugacacgcggcgcgguucugaugcacaaagggaagcggauugagccgaguugggcugacgucaaaaaggaucuuaucagcuauggaggcgguuggaaacuggaaggggaguggaaggaaggagaggaagugcaggucuuggcccuagagccaggcaagaaucccagagcagugcaaaccaaaccuggccuguuuaagacgaacacugggaccauaggagccguuucucucgacuucuccccagguacaucaggcagucccauuaucgauaaaaaggggaaaguggucggacuguacggcaacggugugguaaccaggagcggggcuuaugucuccgccauugcacagacagagaagucuaucgaagacaauccugagauagaagaugacauuuuucguaagcgccggcuuacuaucauggauuuacacccgggagcuggcaaaaccaagagauaccugcccgccaucgugagggaggcgauuaaacgaggccuccggacguugauccuggccccaacacgcguuguggcagcugaaauggaggaggcccucagagggcugccuauuagguaucagacucccgcuauacgggcagaacauaccggacgagagaucgucgaccuuaugugucacgccacauucaccaugagacuguugucgccagugcgcguuccuaacuacaaucuaauuaucauggacgaagcccauuucacugaucccgcuagcaucgcggcaagggguuauauuucaacccguguggagaugggcgaggccgcugggauauuuaugacagccacgccaccgggaucccgggacccuuucccccaaaguaacgcaccaaucauugaugaagagagagaaauccccgagaggucuuggaauagcggccacgaaugggucacugacuuuaaggguaaaaccgugugguucguaccuuccauuaaggccgggaacgauaucgcugcgugccugcgcaagaauggcaaaaaggugauacagcucucacgaaaaacauuugacucugaguacguuaagaccagaacuaacgauugggacuucgucgugacaaccgauaucagcgagaugggcgccaauuuuaaagcagaacgggugauugacccaaggcgcuguaugaagcccgucaucuuaacggauggcgaggaacguguaauucuggcugggccuaugccggugacucauaguuccgccgcacagagacggggaaggaucggucgcaaccccaaaaaugagaacgaccaguacauauauaugggcgaaccccuugagaaugacgaggauugcgcccacuggaaggaagcuaagaugcugcucgacaacauuaauacaccugaggggaucauucccagcauguucgaaccagagcgagaaaaaguugaugccaucgacggagaguacagauugcggggcgaggcgaggaagaccuuuguggaucugaugcgcagaggugaccucccugucuggcuggcauauaaaguggccgcugaagggauaaacuacgccgauaggcggugguguuucgacggcaucaagaacaaucaaauucuugaggaaaacguugagguggagaucuggaccaaagaaggagagcguaagaagcuaaaaccccgcuggcuggaugcucgaauuuauucugacccauuggcauuaaaggaauuuaaagaguucgccgcuggcagaaagucacugacucucaaucugaucacagaaauggggaggcuuccuaccuucaugacacagaaaacucgggaugcccuggacaaccucgcagucuugcacacggcggaggccggaggucgcgcuuacaaucaugcccuguccgagcuaccggaaacccuggagacacuccuucuguuaacuuugcuggcaaccgugacaggcgggauauuucucuuccugaugaguggaagaggcauugguaagaugacccuugggaugugcugcaucaucacugcuagcauucugcucugguaugcccagauccagccccacuggauagcagccucgauuaucuuggaauuuuuccugauuguauuacuaaucccagagccugaaaagcaaaggacgccccaggauaaccagcugaccuacgugguuauagcuauccucacagucguggcggccacuauggcaaaugagaugggcuuucuugagaaaaccaagaaagaccugggauugggcucuauugcuacacagcaaccagaauccaacauccuggacauugaucuccggccugccagcgccuggacccuguacgcaguggcuacuacauucgucacgcccaugcuucgacauucaaucgagaauaguucuguuaacgugucccucaccgccauugcgaaucaggcuacuguacugaugggguugggaaaggguuggccgcugagcaaaauggacaucggcgugccauuacuagccauaggguguuauucacaggucaacccuauuacacugaccgcagcccuccuucuguugguggcucacuacgcaaucaucggacccggccugcaggccaaggcgaccagagaagcucaaaagcgcgccgcagccgguauuaugaaaaauccaacaguugaugggauaacugugaucgaccucgaucccauuccuuaugacccgaaguuugagaaacagcugggccaggucaugcuuuuaauccugugcguaacgcaagugcucaugaugaggaccacaugggcuuugugugaagcccugacucuagcaaccggacccauuaguacacugugggagggcaacccagggcgguucuggaauaccacuaucgcuguuagcauggccaacauauuucguggauccuaccucgcgggcgccggucuucuguucucuaucaugaagaauacgacaaacaccagaagggggacuggaaacaugggcgagaccuugggugaaaaauggaaaagccgccugaaugcacucggcaaauccgaguuucagguguauaagaagucagggauucaggaagucgaucggacacuggcuaaagagggaaucaagcgaggcgagacugaccaccaugccgugucuagagggagugcaaaauuaaggugguucgucgaacgcaacauggugaccccugagggaaagguuguggaucuuggcugcgguagagggggauggucguacuauuguggcggucugaaaaauguaagagaagugaagggccucacaaaagggggacccggccacgaggaaccuauuccaaugagcacguacggguggaaccuaguccgucugcaguccggaguugacguguuuuucauaccaccugagaaaugcgauaccuugcugugugacauaggcgagucuucaccaaaucccacugucgaagcugguaggacacuccgggugcuuaaccugguagagaauugguugaacaauaacacccaauucugcauuaaggugcugaauccguacaugccuagcguuaucgagaaaauggaggcccuccagcgcaaguaugggggagccuuagugcgaaacccacuguccagaaauaguacucaugaaauguacugggucucuaacgcgagcggcaauaucgugucauccgucaacaugauuaguaggaugcuuauaaaccgguuuacaaugcgccacaaaaaggcuaccuaugagcccgauguggaccugggcagcgggacgagaaauaucggaauugagucugaaaucccuaaccuagacauuaucgguaagaggauagagaaaaucaagcaggaacaugagaccuccuggcacuacgaucaggaccacccauauaaaacaugggcauaccauggcucauaugaaacuaagcaaaccgggagcgccucgucuaugguuaauggaguagugcgacuccugacaaaacccugggaugucuugccgacugugacccagauggcuaugacagacaccacuccuuucggccagcagcggguuuuuaaggagaagguggauacgcguacacaagagcccaaagaagguaccaagaaacugaugaagauuacugccgaguggcucuggaaagaacuugggagaaagaaaaccccacgcauguguacaagggaggaguucacgcggaaggucagaaguaacgcagcccugggagcuaucuuuaccgacgaaaauaaguggaaauccgcgcgcgaggccguggaagauagcagguucugggaguuaguagacaaggaacgaaaccugcacuuggagggcaaaugcgagacuuguguguacaauaugaugggcaagcgggagaaaaagcucggggaguuuggaaaggcaaaagguucaagagcuauuugguacauguggcugggcgccagguuccuagaauuugaggcacuuggguuccugaacgaagaucauugguuuucccgcgaaaauucucucagcggaguugagggcgaaggucugcacaaguugggguauauccugcgugacgucaguaaaaaggagggaggcgccauguacgcugaugacacagccggcugggacacccggauuacucucgaagaucuuaaaaacgaggaaauggugacaaaucacauggagggggagcauaagaagcuggcggaagcaauauucaaauuaaccuaucagaacaagguggucagaguucagaggccuacaccccgcggaacugugauggacaucauuucccgacgggaucaaagagguagcggccagguagggaccuacggacugaauacguuuaccaacauggaggcccaguugaucaggcagauggaaggcgaggguguguucaaaucuauccaacaccucacagucacugaggaaguggcuguucagaauuggcuggcccgcguggggagagagcggcuaucaaggauggcaauuaguggagacgauugcgucgugaagccacuugacgaucguuucgcuaacgcccugaccgcucucaacgacaugggcaaaauacgaaaggauauccagcagugggaacccuccaagggcuggaaugacuggacacaaguaccuuuuugcagccaucacuuccaugagcugauuaugaaagaugggcgcguuuugguggucccauguagaaaccaggacgaauuaaucggacgggccaggauuucucagggugcaggcuggucgcugcgcgagacugcgugccucgggaagucauaugcccagauguggagccuuauguacuuucacagacgggaucugaggcuagcugccaaugcaaucuguuccgcugugccgagucacugggugcccaccucucgaacgacauggagcauacaugccaaacacgaguggaugaccacugaagacaugcugacagucuggaaccguguuuggaucagagagaauccuuggauggaagacaagaccccaguggaguccugggaagagauucccuaucucggaaaacgcgaggaucaauggugcggcucauugaucggucugacaagucgggcaaccugggccaagaacauucaggcggcuaucaaucagguaaggucucuuauagggaacgaagaguacacagacuacaugccuagcaugaagagauuccgccgggaagaggaagaggccggagugcugugguga

SEQ ID NO: 14820 - RNA, 9876 nt, Artificial Sequence
  derived and/or modified CDS sequence (opt3) from DENV-2__JN819418__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgugcagaggaucgagaccuggauacugcggcauccuggcuucacaaucauggccgcaauuuuggccuacaccaucggcacgacucacuuucagcgcgcucucauuuucauccugcugacagcaguugccccauccaugaccaugagaugcauagggauuucuaacagggauuuuguggaaggagucucggguggcucauggguggacaucguacucgagcacgggagcuguguuacuacaauggcuaagaauaagcccaccuuagauuucgaacugauuaaaacggaggccaagcagccugcgacccuucggaaauauugcaucgaagcaaaguugacaaacacuaccacagagagucgcuguccaacucaaggagagcccucccugaaugaagagcaggacaaacgauuugugugcaagcauucuauggucgauagaggcugggguaacggguguggacuauucggcaagggcgggaucgugaccugcgccauguuuacaugcaaaaagaauauggaaggaaaagugguccucccugagaaccuggaauacaccauuguuauaacuccacacagcggugaggagcaugcugugggcaaugacacggggaagcacggaaaagaaaucaagauuacaccgcaguccucaaucaccgaggccgaacuuacuggcuaugguaccguaacaauggaguguagucccaggaccgggcuggauuucaacgaaaugguguugcuccagauggaggacaaagcauggcugguccaccggcaaugguuuuuagaucugccucucccauggcuucccggcgcugacacucagggaagcaauuggauacagaaggagacacuggugacguucaagaacccucaugccaaaaagcaggacguuguggucuugggcucucaagaaggggcgaugcacaccgcccuaacuggagcaacagagauucagauguccucagguaaucugcucuuuaccggccaucugaaaugccgucuucgcauggauaagcugcaguugaaagggaugagcuacaguauguguacaggaaaguucaagaucgugaaagaaaucgcugagacucaacacggcaccauuguaaucagaguucaguaugagggugacgggucuccaugcaagauucccuucgaaauaauggaucucgagaaaaggcaugugcugggccgguuaaucacggucaacccgauugugaccgaaaaggacuccccugucaacaucgaggccgaacccccauuuggagauagcuacaucauuauaggcguggagccugggcagcugaaacuaaauugguucaagaagggaucgucuaucggucagauguuugagacaacuaugcgaggcgcuaaacgcauggccauucucggggacaccgcaugggauuucggaucccugggcgguguuuuuacaucaaucgggaaggcccuucaccaaguguucggcgcuauuuacggagcggcauuuaguggcguaagcuggacuaugaaaaucuugauaggggucaucauuaccuggaucggaaugaacuccagaucuacgagccugucagugagucucguucuggugggcgucgugacacuuuaucugggugccaugguacaggcugacuccgggugugugguuagcuggaagaauaaagaauugaagugcggaucuggcauuuucaucaccgauaacguccacacuuggacagagcaguacaaguuucagcccgaaucaccaaguaaacucgccagcgcaauacaaaaggcccaugaggaagguauuuguggcaucagguccgugacccggcuggagaauuuaauguggaaacagauuacucccgagcugaaccacauccuaucugaaaaugaggugaagcucaccauaaugacaggggacaucaaaggaauuaugcaggcuggcaagcgcucgcugagaccucagccaacggaacuuaaauauagcuggaagaccugggggaaggccaaaauguuguccacugagucacauaaccaaacauuccugaucgauggaccggaaaccgcagagugccccaauacaaacagggcguggaauagucucgaggucgaagacuacggcuuugguguuuucucuacuaacauuuggcugaaguuacgugagaaacaggacguguuuugugauagcaagcugauguccgcugccaucaaagacaaucgggcagugcacgccgauaugggguauuggauagaaucagcucuuaacgacaccuggaagauggagaaggccagcuucauugagguaaaaucuugccacuggccuaagucccauacguuguggaguaauggaguccucgaaagcgagaugaucaucccaaaaaacuucgcaggccccgugucucagcacaacuaccgaccugguuaucauacacagaccgcuggcccauggcaccuggggaagcuagaaauggauuuugacuucugugagggaacuaccguuguggucacagaagauugcggcaauagagggcccucccugaggacuaccacagccucaggaaaacucauuacggaguggugcugucgcaguugcacccugccgccucuucgguacagaggcgaggacgguuguugguacgggauggaaaucaggccauugaaggagaaggaagagaaccuggugaauagcuuaguuacugcgggacauggccaaauugauaacuuuucgcucggugugcugggcauggcccuuuuccuggaagagauguugcgcacacgaguagggaccaaacacgcuauacuccuggucgcaguguccuuuaugacucuaaucacaggaaauaugucuuuccgggaccugggccgugugauggucaugguuggggccaccaugacggaugacauuggaaugggcgugacuuaucucgcucugcuugccgcauuuaagguaagacccaccuucgcggccgguuugcuguuaaggaaacucacaagcaaggagcugaugauggcuaccaucgggauugcccuucugucacagaguacuaucccugaaacaauacuagagcucaccgaugcacuggcuuugggaaugauggugcugaaaaucguccgcaacauggaaaaguaccaguuagccgugacaauuauggcaaucuccugcguucccaaugccgugauucuccaaaacgcuuggaaggucucuuguacuauccuggcggccgugagcguuuccccacuucuguugaccucaagccagcagaaagcagacuggauaccucucgcucugacgauuaagggccuaaaucccacagccaucuuucugaccacucuuagucggaccucuaaaaagagauccuggccacucaacgaggccaucauggcugugggcauggucagcauucuggcaucgucauugcugaaaaaugacauaccgaugacagggccuuuaguagccggaggucuccugacugugugcuauguucuuaccggcaggucugcggaucuggaauuggagcgagcugccgacgugaagugggaggaucaggcagaaaucaguggguccagccccauucucucuaucacgauuagcgaggacggauccaugucaaucaaaaacgaagaggaggaacaaacacugaccauacuaauccgcacuggccugcuugucauuaguggucucuucccagugagcauccccauuacagccgcugcaugguaccugugggagguaaagaagcagcgggccgggguguugugggaugucccuucuccacccccuguuggaaaagcggaauuagaggacggcgcuuauagaaucaagcagaggggcauacugggguacucccagauuggagccgguguguauaaagaaggcaccuuucacacuauguggcaugugacacguggggcaguccucaugcaccgcggaaagcggaucgagccgucaugggccgaugugaaaaaggaccugaucaguuacggcgguggguggaagcuugagggagaauggaaagagggcgaagagguucaaguacuggcuuuggaaccaggcaagaaucccagagccgugcagaccaaaccugggcuauucaagacgaacacuggaaccauuggugcagucagccuggauuuuuccccaggcacaucugggucgcccaucguggacaggaaaggaaagguugugggccucuacgguaauggggucgugacccgaagcggagcuuauguaucagccauagcgcagacagagaaguccauugaggauaacccugaaaucgaggacgauauuuuccggaaaaagcgccugacuaucauggaccuucauccgggcgccggcaaaaccaagagauacuuacccgcaauagucagggaagcuauuaaacgggggcugcgaacgcucaucuuggccccaacaagagugguugcugcagagauggaagaggcccugcgcggacucccuaucagguaucagacucccgccauucgugcugagcacaccggucgggaaaucguggaccugaugugucaugcgacauucaccaugagacuucugaguccagucagggugccuaacuacaauuugauuauaauggaugaggcacacuuuacugaccccgccucuaucgcugcccgcggcuauauuagcacccgaguugaaaugggggaggcagccggaaucuucaugacagcuacgccaccgggcuccagagauccuuuuccccaaucaaacgcgccaaucauggacgaggaacgggagauucccgaaaggucuuggaauagcggucacgagugggugacugauuucaaggggaagaccgucugguuugugccuaguauaaaagccggaaacgacaucgcagcuugccuacgcaagaauggcaaaaagguaauucagcugucccguaaaacauucgauagcgaauacgugaagaccagagccaacgacugggauuuuguugucacuacagacaucucugagaugggcgcaaauuucaaggccgagcgggugauugauccaaggcgcuguaugaaacccgugauccucaccgacggggaagagcgagucauauuagcuggaccuaugccgguaacgcauucauccgccgcgcagagacgggguaggaucggccgcaacccaaagaaugaaaacgaccaauauauuuacaugggggagccccuggaaaaugaugaggacugcgcacacuggaaagaggccaagaugcuucuggauaacaucaauacuccugaaggaauuauccccaguauguuugagccagaaagagagaaaguggacgcuauagauggcgaauacaggcuccggggugaggcccguaagacauucguugacuugaugcgccgaggggaucugccuguguggcucgcuuauagagucgcagccgagggcauuaacuacgcugacaggcggugguguuuugauggaaucaaaaauaaccagauucuggaagagaacguggaaguugagaucuggaccaaggagggcgaacgcaagaaacuuaagcccagauggcuagacgccaggauauauagcgauccacuggcauugaaagaguucaaggaauucgcggccgggcggaaaucguuaacccugaaucucaucacugagaugggacgacugccuacauuuaugacccagaaggcuagagacgcccuugauaaccuggcagugcuccauacagcugaagccgguggccgcgcauacaaucacgccuugucugagcugccggagacucuagaaacgcugcuccuucugaccuuauuggcuacagucacugggggaauuuuccuguuucucauguccggcaaggguaucgggaaaaugacccugggcaugugcugcauuaucacagcgagcauacuucugugguaugcccagauucaaccccacuggaucgcagcuucaaucauucucgaguucuuuuugaucgugcuguuaauaccagaaccugagaagcagaggaccccccaggacaaccagcuaacuuacguagugauugccauccugacgguugucgccgcaaccauggcuaaugaaaugggauuccucgagaaaacaaagaaagaccuuggccuggggaguauuacuacccaagagucugaauccaacaucuuggauauagaccugcggccagccagcgcguggacacucuaugcuguggccaccacuuuugugacaccuaugcugcgucauucaaucgagaauaguagcgucaacguuucccuuacggcaauugccaaucaggcuaccgugcucaugggacuggguaagggcuggcccuugucuaagauggauaucgggguaccgcuguuagcaauuggauguuacagccaggugaacccaaucacucuaacagccgcgcugcuccuucuggucgcucacuacgccauuaucggcccugguuugcaggcaaaagccaccagagaagcucaaaagagggccgcagcugggauaaugaaaaaucccaccguggacggcauuacaguuaucgaucuggacccaauccccuaugauccuaaguucgagaaacagcucggacaggugaugcugcuuauuuuaugcgucacucagguacugaugaugcgcacgaccugggcccucugugaagcguugacacuggccacuggcccgauauccacccuaugggaggggaaccccggacgguuuuggaauacaaccaucgcagugucaauggcuaacauuuuccgaggcucuuaccuggccggugcagggcuccuuuuuaguaucaugaagaauacuacgaacacaagaaggggaaccggcaauauuggugagacucugggcgaaaaguggaaaucgcgcuugaacgcucuggggaagagcgaguuccaaaucuauaaaaaguccggaauacaggaaguugaccggacccucgccaaagagggcaucaagagaggggagacagaucaucacgccgugucucguggaucagcgaaacugaggugguuugucgaacggaacauggugacuccagagggcaaggucguggacuuagguugcgggcgcggaggcuggagcuacuauugugguggccuuaagaauguucgagaagugaaagggcugaccaagggaggcccugggcaugaggaacccauuccuauguccacauacggauggaaccucguaagacuacagaguggcguggaugucuucuucacgccacccgagaaaugcgacacccuguugugugauaucggugagucuagcccuaauccaacuauugaagcugggaggacacugcggguucucaaccuuguggagaauuggcugaacaauaacacccaauuuugcaucaaggucuugaaucccuauaugccgucagugauagaaaaaauggagacucugcagcgcaaguacggaggcgcacucguaagaaacccuuuauccaggaauaguacacacgaaauguacugggugagcaacgccaccggcaauauuguuucuuccgugaacaugaucucacgaaugcugaucaaucgguucacgaugaagcacaaaaaggcuaccuaugagccagacgucgaccuugggagcggaacacguaacauugguauagagucggaaauccccaaccuggauauuaucggcaaaagaauugagaagaucaaacaggaacaugagacuucuuggcacuacgaccaggaucauccuuauaagaccugggccuaccacgggaguuaugaaacaaagcaaacuggauccgcaagcucaauggugaauggcgucgugcgccuacucaccaaaccaugggacguuguacccauggugacacagauggccaugaccgauacuacgccguuuggucagcagagggucuucaaggagaaaguggacacacggacccaagagccuaaggaagggacuaaaaagcugaugaagauaaccgcugagugguuguggaaagaacugggaaagaaaaagacacccagaauguguacgcgcgaggaguuuaccaggaaaguucgauccaacgcggcccucggcgcaaucuucacugaugaaaauaaguggaaaucugcucgggaggccguggaagacggcagauuuugggagcuugucgauagggaacgcaaccugcacuuagaggggaagugcgagacauguguguacaauaugaugggaaagcgugaaaaaaagcugggugaguucggcaaagcaaaggggagccgggccauuugguauaugugguugggagcuagauuucucgaauucgaggcccugggcuuucuaaacgaagaccauugguucaguagggagaauucccuuagcgguguagagggggaaggacugcacaaacucggcuacauccugcgcgaugugucuaagaaggagggcggggcgauguacgcagacgacaccgccggaugggauacucgaauuacauuggaagaccugaaaaacgaggaaaugguuaccaaucauauggagggugagcacaagaaacucgcugaagccaucuuuaagcuuacauaucagaacaaagucgugcgggugcagagaccaacuccuaggggcaccgucauggauauuauaucacgcagagaccagcgggggaguggacaaguuggcacguacggucugaauaccuucacaaacauggaggcacaguuaaucaggcagauggaaggggagggaauuuucaaguccauccaacaucugacugugaccgaggaaaucgcuguacagaauugguuggcccgugugggccgagagcgccucagcagaauggcuauuucuggcgaugacugcgucgugaagccccuggaugaccgguuugccucggcacuaacagcgcuuaacgauauggggaaaguuaggaaggacauacagcagugggaaccaucacgcggauggaaugauuggacucaagugcccuucugcagccaccacuuucaugagcugaucaugaaagacgguagaguccucgugguaccuugucggaaccaggaugaacugauuggcagggcccgaaucucccagggggcuggauggaguuugaaggagaccgccugcuuaggcaaaucuuaugcacagauguggacgcugauguacuuccaccguagagaccuccgccuugcugccaacgcaauuuguagcgccguuccaucccauugggugccgacaucacggaccacuuggaguauccacgcgaagcacgaguggaugacaaccgaagacaugcuggcugucuggaauaggguguggauacaagagaaccccuggauggaagauaagacuccuguggagucuugggaagaggucccauaucuagguaaaagagaggaccaguggugcgggagccugaucggacucaccucccgcgccacaugggcaaagaauauucagacggccaucaaccagguucggucauugauuggcaaugaagaguacaccgauuauaugcccagcaugaaaagguuucgaagagaagaggaagaggcuggcgugcugugguga

SEQ ID NO: 14821 - RNA, 9876 nt, Artificial Sequence
  derived and/or modified CDS sequence (opt3) from DENV-2__EU482640__SS-prME
accgccggcaucauuauaaugaugaucccaacugugauggcuuuccaccugacuacgaggaacggggaaccucauaugauugucagcaggcaggaaaagggaaaaucccuccuuuuuaagaccgagaaugguguuaacaugugcacccugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacuacaguggcaccaucuaugaccaugagaugcaucggcauaucgaacagggacuuugucgaaggggugucaggagguagcuggguagauauuguucuggagcacggcaguugugugacuacaauggccaaaaauaagcccacccucgacuucgaauuaaucaagacggaggcuaaacacccugccacccugcggaaguacugcauugaagcgaaacuuacaaacacuaccacagcaucccgcuguccaacucagggggagcccucuuugaaugaggaacaagauaagcgauuugucugcaaacauagcaugguggacagaggauggggcaacgguugugggcuguucggaaagggcggcaucgugaccugcgccauguuuacaugcaagaaaaauauggaggggaagaucguccagccugaaaaccuagaguauaccauuguuauaacuccacacuccggagaagagaaugcuguggguaacgauacgggcaaacaugggaaggagaucaaaguaacaccgcagucaaguauuaccgaagccgagcucacuggauacggcaccgugacaauggaauguagccccaggaccggucuggacuucaaugagaugguccuucugcagauggaaaacaaggcaugguuggugcaccggcaaugguuucucgaucugccuuuaccauggcugcccggggcugacacucagggcucuaacuggauccagaaagagacacucguuacguucaagaauccucacgccaagaaacaggauguggucgugcuuggaucccaagagggcgcgaugcauaccgcccugacuggggcaacagaaauacagaugucaagcggaaacuugcuauuuaccggucaccugaagugccgucuccgcauggacaaacugcagcuuaagggcaugaguuauucuauguguacagggaaauucaagguaguuaaggagauugcugaaacucaacauggaaccaucgugaucagaguccaguacgagggcgacgguuccccaugcaaaauucccuucgagaucauggaucuggaaaagaggcacguguuggggcggcucauuacggucaauccgauagugaccgagaaagacagcccuguuaacaucgaagccgagcccccauuuggcgauucguacauuaucaucggaguggaaccuggccagcugaaguuaucuugguucaaaaagggguccucaauuggacagauguuugagacaacuaugcgaggugcuaagcgcauggccauacugggcgacaccgcaugggauuucgggagucuaggaggcguauuuacaagcaucgguaaagcccuccaucaagucuucggggcuauuuauggcgcggcauuuuccggagugucuuggacuaugaagauccugauuggcguugugaucaccuggauagggaugaauagcagaucaacgagucuuuccgucagcuuggugcugguaggagugguuacacucuaccugggcgucauggugcaggccgacucugguuguguggucucauggaaaaacaaggagcuuaaaugcgggaguggaaucuucauuaccgauaauguucacacuuggacagaacaguauaaguuucagcccgagagcccauccaagcuggcuucugccauccaaaaagcacacgaagagggcauuugugguaucaggucggugacccgguuggaaaaccucauguggcgccagauaacucccgagcugaaucauauuuuaagcgagaacgaagugaagcugaccaucaugacaggcgacauuaaagggaucaugcaggccggaaagagaucccuaaggccucagccaacggagcucaaauacucauggaaggcuuggggcaaagccaagaugcugaguaccgaacuucacaaucauacuuucuugauagaugggccggagacagcagaaugccccaacaccaaucgugcguggaacucucuggagguagaggacuauggauuuggcgucuucacaacuaauaucuggcucaagcugaaagaacggcaagauguguuuugugacagcaaguuaauguccgcugccauuaaagacucacgagcaguucacgccgauauggguuacuggaucgagagcgcucugaacgacaccuggaagauugaaaaagccucuuucaucgaggugaaguccugccacuggccuaagagucauacgcuuuggagcaacggggucuuggagucugaaaugauaauucccaagaauuucgcaggacccgugucccagcacaacuauagaccuggcuaccauacacagaccgcugguccauggcaccucggcaggcuggagauggauuuugacuucugugaagggacuaccguugugguaacagaggauugcggaaaucgcggccccucacuacggacuaccacagccagugggaagcugaucacggaauggugcuguagaagcugcacccucccgccucugagguaccgcggagaggacggcuguugguaugguauggagauccgaccacuuaaagaaaaggaggaaaacuuggucaauucgcuggugacugcggggcauggacagauugauaacuuuuccuuaggcgugcucgguauggcccuguuccuugaggaaaugcugcggacacguaucggcaccaaacacgcuauuuugcucgucgcaguuucuuuugugacucugauaacagggaauaugagcuucagagaccuaggaaggguaauggugauggucggcgccaccaugacggaugacaucgggaugggagugacuuaccuggcucuccuggccgcauuuaagguucgccccaccuucgcggccggccuuuugcugcggaaguuaacaucaaaagagcucaugaugaccacuauugguaucgugcugcuuagucaauccacagucccugagaccauucuggaacuaacagaugcucucgcccuggggaugaugguguugaagaucguuagaaacauggagaaauaucagcuggcagugacuauaauggcuaucuuaugcguccccaaugccguaauucuccagaacgcauggaaggugucuuguaccacgcuggccguugugagcgucuccccacuucuguugacaucaagcaggcaaaaagcugacuggaucccucucgcgcugaccauuaagggacuaaaucccacugccaucuuucugaccacacuuagucgaacuucuaagaaacgcuccuggccacucaacgaagcaauaauggcugugggcaugguaagcauucuggccucgucauugcugaagaaugauaucccgaugaccggcccuuuaguggccgggggacuccugacggucugcuacguucuuacaggucggucugcugaccuggaguuggaaagagcagccgacgugaggugggaggagcaggcggaaaucaguggcuccagccccauucucucuauaaccaucagcgaggauggguccaugucaauuaaaaacgaagaggaggaacagacucugacaauccuaauucguaccggacugcuugugaucaguggccucuucccagucagcauacccaucacugcugccgcaugguaucugugggaggugaagaaacagcgcgccgguguuuugugggacguaccuucuccacccccuguggggaaggcugaauuagaggauggagcauaccggauuaaacaaaagggcauccugggcuauucccagauuggggccggagucuacaaggaagguacauuucacaccauguggcaugugacgagaggcgcgguucucaugcacaaagggaagaggaucgagccgucaugggcugacgugaaaaaggaucugauaaguuacggaggcgguuggaaacuugagggggaauggaaggagggagaagagguccaggugcuggccuuggaaccaggcaagaauccccgagcaguacagacuaaaccuggccuauucaagaccaacacagggaccauuggagccgucagccuggacuuuuccccagguacaucuggcucgcccaucguggauaaaaaggggaaaguugugggacucuauggcaacggugucgugacucggagcgggaccuacguuucagcuaucgcccaaacggagaaguccauugaggacaauccugaaaucgaggaugacauauuccgcaagaaaagacugacaauuauggaucuucauccgggagcaggcaagacuaaaagguauuuacccgcuaucgugcgggaagccauuaagcgaggccugagaacccucaucuuggcgccaacacgcgucguggccgcagagauggaagaggcucugagggggcucccuauacguuaccagacccccgccauucgggcugagcacacuggaagagaaaucguagaccugaugugucaugcaaccuucacaaugaggcuucugaguccaauccgcgugccuaacuauaauuugauuaucauggaugaggcccacuuuacggaccccgccucuauugcugcgcgagguuacauaagcacuagaguugaaaugggcgaggcagccgggaucuucaugaccgcuacaccaccgggaucccgggacccuuuuccccagucaaacgccccaauuauggaugaggaaagggagauccccgaacgcucuuggaauagcggccacgagugggucaccgacuucaaagguaagacugugugguuugugccuaguaucaaggcagggaacgauauugccgcuugccuacguaaaaauggaaagaaagucauacagcuguccagaaagacauucgacagcgaauauaucaaaacccggacgaacgauugggacuuuguagugacuacagauauuucugagaugggcgcgaauuucaaggccgagaggguuaucgacccacgccgauguaugaagcccgugauucucaccgauggcgaagagagagucaucuuagcagggccuaugccggugacccauucauccgcugcccaacggaggggacgcguugguagaaaccccaagaaugaaaacgaccaguacauauacaugggcgagccccuggaaaaugaugaggacugcgcacacuggaaggaggccaaaaugcuucuggacaacaucaauacuccugaagggauuauccccaguauguuugagccagaaagggagaagguggaugcuauugacggagaauaucggcuccguggcgaggcccgcaaaacauucgucgauuugaugcgaagaggugaccugccuguguggcucgcguacaggguagcagccgaggggaucaacuaugcugaucggcgcugguguuuugacggcgugaagaacaaucagauacuggaagagaacguugaagucgagauuuggaccaaagagggagaaagaaagaaacuuaaacccagguggcuagaugcccggaucuacagcgacccacuggcuuugaaggaguucaaagaguucgcagccggccgaaagucguuaacacugaaucucauuacugagauggggagacugccuacguuuaugacccaaaaagcucgcaacgcccuugauaaucuggcagugcuccauacagcggaagccggagguagggcuuauaaccacgccuugucugagcugccggagacucuagaaacccugcuccuucugacauuauuggcaaccgugacuggcgggaucuuccuguuucucauguccggaaagggcauagguaagaugacgcuggggaugugcugcaucauuaccgcuagcauccuucugugguacgcccagauucagccccacuggaucgcagccucaauaauucucgaguucuuuuugaucguccuguuaaucccagaaccugagaaacagcggacaccccaagacaaucagcuaacuuauguugugauugcuauccugaccguaguggcggccacaauggcaaacgaaaugggcuuccucgagaagaccaaaaaggauuuuggacuuggcaguauaacuacacagcagccagagucuaauauucuggacaucgauuugcguccugcuuccgccuggacgcuguacgccgucgcaaccacuuucauuacacccaugcucagacauagcaucgaaaacucaagugugaauguuagccugaccgcuauagccaaccaagcgaccgugcuuauggggcucggaaaagguuggccgcuguccaagauggacaucggcgucccauugcuggcuauuggguguuacucucagguaaauccuaucacauuaacugccgcacuacugcuccuuguggcccacuaugcuauuaucggacccggccugcaggcaaaggccacgagggaggcgcagaaacgcgcugccgcagguauuaugaagaacccaaccguugacgggaucacagugauagauuuggaccccauuccuuacgauccgaaauuugaaaagcaacugggccaggucaugcuccuggugcuuugcgucacucagguguuaaugaugcggaccacaugggcccugugugaggcucucaccuuggccacuggacccaucagcacgcugugggaaggcaauccagggcgauucuggaacacaaccaucgcaguuuccauggcuaauauuuuuagaggaucauaucuagccggcgcgggucuacucuucucuauaaugaaaaacacugccaacaccaggcgcgggacaggaaauacuggcgagacccuuggugagaaguggaagaaccggcugaaugcauugggcaaaagugaauuucagaucuacaagaaaucggggauucaagagguggacagaacacuggcuaaggaaggaaucaaacguggcgagacggaucaucacgccguaagcaggggguccgcaaagcuccggugguucguggagcgcaaccuggucaccccugaaggaaaaguuguggacuuaggcugcggucgagggggauggucuuauuacuguggcggucuuaagaaugucaaggaggugaaaggccugacuaaaggcgggcccgggcaugaagaaccuauuccaaugucaacauauggguggaaccucguaagacuacagagcggaguggauguuuucuuuacaccaccugaaaaaugcgacacucuguugugugauaucggcgaguccaguccaaaucccacaguggaggcugguaggacccugcggguccucaaccuuguggaaaauuggcugaacaauaacacgcaguucugcauaaaggucuugaauccguacaugccuucugugaucgagaaaauggaagcccugcaacgcaaguacgggggagcccucguuagaaacccauuaagcagaaauucaacccacgagauguauuggguauccaacgcgaguggcaacauugugagcucugucaauaugaucucccgaaugcugauuaaccgguuuacaaugcgucacaagaaagcuacuuacgaacccgacguggaucuuggcucagggaccagaaauaucggaauagagagcgagacaccuaaccuggacauuaucgguaagcgcaucgagaagauuaagcaggagcaugaaacuucguggcacuaugaucaggaccauccauacaaaaccugggcauaucacggcucuuacgagacaaagcagaccgggagugccuccagcaugguuaauggaguggucaggcuacucacuaagcccugggacgugauaccgaugguaacgcaaauggcuaugacagauaccacuccuuucggccagcagcggguguuuaaagaaaagguugacaccagaacacaggagcccaaagaggguacgaagaaacugaugaagaucaccgccgaaugguuguggaaggagcuggggaaaaagaaaacuccacgcauguguacaagggaagaguucacccgaaagguccggucaaacgcagcccucggagcuauuuuuacugaugagaauaaauggaaguccgcgagagaagccguggaggacucuggcuucugggaacuuguggauaaagagaggaaccugcacuuagaaggcaagugcgagacaugugucuauaauaugauggggaagcgcgagaaaaagcugggagaauuugguaaagcaaagggcagccgugcuaucugguacaugugguugggggcccgguuccucgaguuugaagcacugggauuccuaaacgaggaccauugguuuaguagagaaaauucccuuagcggcguugagggugaggggcugcacaaacucggauacauucugagggaugugucuaagaaggaaggcggcgccauguaugcugacgauaccgccgggugggacacacgcaucacuuuggaggaucugaaaaacgaagagaugguaaccaaucauauggaaggagagcacaagaaacucgcggaggcaauauucaaacuuacguaccaaaacaaagugguccgagugcagcggccuacccccagagguacaguuauggacaucauuucaaggcgcgaccagagaggcaguggacagguggucacuuauggacugaauaccuucacaaacauggaagcccaauuaauccggcagauggagggcgaagguguguuuaaguccauucagcaacugacuguaaccgaggagaucgcuguuaagaacugguuggccaggguggggcgugaacgacucagccgcauggcaauuucuggagaugacugcgucgugaaaccacuggaugacagauucgcuucggcccuaacggcucuuaaugauaugggcaaggugcggaaagacauacagcagugggagcccucaaggggcuggaacgauuggacacaggucccuuuuugcagccaucacuuccacgaacugaucaugaaggacgggcgcguucucgugguaccauguagaaaucaagaugagcugauuggacgggccaggaucucccagggugcaggcuggaguaugcgagaaaccgcgugcuuggggaaaucuuacgcccagauguggagcuuaauguauuuucaucguagagaccugcgccucgcugccaacgcaaucuguuccgcugugccgucacacuggguccccacaagucggacaaccuggucuauucaugccacucacgaguggaugaccacagaggauaugcuuacgguguggaauaggguuuggauacaggaaaacccuuggauggaggacaagaccccaguggaaagcugggaggaaauccccuaccugggaaagagagaggaucaauggugcggcucccuaauuggucugacuucacgcgcaacaugggccaaaaauauccagaccgcgauuaaccagguccggagccucaucgggaaugaggaauauacugacuacaugccuucuaugaagagguuccgaagagaggaagaggaagcuggaguguugugguga

SEQ ID NO: 14822 - RNA, 9876 nt, Artificial Sequence
  derived and/or modified CDS sequence (opt3) from DENV-2__EU482641__SS-prME
agcgcaggaaugaucauuaugcugauacccaccgugauggcuuuccaccucacaacuagaaacggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccauuacucaggcaaaacgaaccggaggauauugacuguuggugcaauucuaccucaacaugggugaccuauggaacuuguacaaucaccggcgagcaccggcgcgaaaagcgaaguguagcccuggugccccaugucgguauggggcuugagacgcguacugaaaccuggaugagcuccgagggagcguggaaacacgcucagagaauagagacauggauccugaggcauccuggcuucacuauuauggccgcaaucuuggccuacaccauuggcacaacccacuuucagcgggugcucaucuucauacugcugacggcuguugcaccaucuaugacuaugcgcugcauugggaucucgaacagagauuuuguggaaggagucucagguggcagcuggguggacauuguacucgagcacgggaguuguguuacaaccauggccaagaauaagcccacuuuagauuucgaacugaucaaaacagaggcuaagcagccugccacccuuaggaaauauugcaucgaagcgaaguugacgaacaccacaacugagucccgguguccaacccaaggagagcccucucugaaagaagaacaggacaagcgcuuugugugcaagcauagcauggucgaucgaggcugggguaauggguguggacuauucggcaaaggcgggauugugacaugcgcaauguuuacuugcaagaaaaacauggaaggaaagauagugcagccugagaaucucgaauacaccaucgucguuacaccacacuccggugaggagcaugccgugggcaacgacaccgggaaacacggaauggaaauuaagguaacuccgcagucaaguaucacggaggcugaacugacaggcuaugguaccgugacuauggaguguagccccagaaccgggcuugauuucaaugaaaugguccuguugcaaauggagaacaaagccuggcucgugcacaggcagugguuucuggacuuaccucugccauggcuccccggcgcagauaagcaggagucuaauuggauacagaaggaaacacuuguuaccuucaaaaacccucaugcuaagaaacaagacguggucgugcugggaucccaggagggcgccaugcacacugcguugacaggggccacggaaauucagaugucaagcggaaaucuacuguuuaccggucaucucaagugccggcugcguauggacaaacuucaacugaagggcaugaguuacucuauguguacugggaaguucaaaguaguuaaggagaucgcagagacacagcacggaaccaucgugauucgcguccaguaugaaggcgaugguuccccaugcaaaauccccuucgagauuauggacuuggaaaagagauacgugcucgggaggcugauaacagucaacccgaucgugacugagaaagauagcccuguuaacauugaagcugagcccccauuuggcgacucguacaucaucauuggaguggagccuggccaguuaaagcugaauugguucaagaaagggucuuccauaggacaaauguuugaaaccacgaugcggggugccaagcgaauggcuauccuaggcgauaccgccugggacuucgggucacucggaggcguauuuacaaguauugguaaagcacugcaucaggucuucggggccaucuauggcgcugcguuuagcggaguguccuggacuaugaagauucuuaucggcguuauaaucaccuggauugggaugaacucucgcagcacaucauugagugugucccugguccucgugggaaucguaacucuguaccuuggcgugaugguucaggcagauagcgguugugucgugucuuggaaaaauaaggagcugaagugcgggucaggaauuuucaucaccgacaacgugcacacguggacagaacaguauaaauuucaacccgagaguccaagcaaguuggccuccgcuauacagaaagcccaggaagagggcauuugugguaucagaucugucaccaggcucgagaaucugauguggaagcagauuacucccgaauuaaaccacauccuggcagagaaugaaguuaaacuaacaauaaugaccggcgauauccgggggauuaugcaagccggaaagcgcucgcucagaccucagccaacugagcugaaauacagcuggaagaccuggggcaaggcuaaaaugcuuuccacagaaucauauaaccagacguucuugaucgacgggccggagaccgccgagugccccaauacuaacagggcauggaauagucuggaaguggaggauuacggauuuggcguguucacaaccaacauuuggcucaagcugaaagaaaagcaggacgcguuuugugacucuaaauuaaugagcgcugccaucaaggauaaucgugcaguacaugccgacauggguuauuggauagaguccgcucugaacgauacauggaagauugagaaagccucauucaucgaagucaagaauugccacuggccuaaaagccauacucuuuggucuaacgggguguuggaguccgaaaugaucauuccaaagaaccucgcaggacccguuagucaacacaauuaccggccuggcuaccacacccagaucgcugguccauggcaucugggcaaacuagagauggacuucgauuuuugugacgggacgacagugauugucaccgaagauugcggaaaccgaggccccagccugagaacuaccacagccucugggaagcucauaacugaguggugcuguagguccugcacccugccgccucuucgcuaucggggagaggacggcuguugguacgguauggaaaucagaccauugaaggagaaagaagagaaucuggugaacucauuaguuacagcggggcacggacagguggauaauuucagucucggcguacuggguauggcccuuuuucuggaagagauguugaggacgcgcgucggcaccaagcaugcuauucuccugguggcagugagcuucgucacucuaaucacagggaacaugucguuuaaagaccugggacgaguugugguaauggugggcgccaccauggcugaugacauugggaugggagucacuuaucucgcccugcuugcagcguucaaggugcggcccacauuugccgcuggcuugcuguuacguaaacucaccuccaaggagcugaugaugacgacuaucgguauaguucuucugucucaaagcaccaucccugaaacagugcuagagcucaccgaugcccuggcauuggggaugaugguccugaagauugugagaaauauggaaaaauaccaguuagcuguuacuaucauggccauucucugcgugcccaacgcagucauccugcagaaugccuggaagguaucauguacaauacuugcugugguuaguguguccccacuguugcucaccucuagccagcaaaagacugacuggauuccucuggcgcuaacuaucaagggacugaaccccaccgccaucuuccuuacgacacucuccaggaccaauaaaaagcgcucauggccacugaacgaggcaauuauggcugucggcauggugagcauauuggccaguucucugcucaaaaaugacaucccgaugacuggcccucuaguagccgggggacugcuuaccgugugcuauguccugacaggucgguccgcugauuuggaacucgagagagcaacugacguuaagugggaggaucaggccgaaauuagcggcucgucacccauccugucuauuaccaucagugaggacggguccaugagcauaaagaacgaagaggaggaacagacgcuaacaauccugauuaggaccggacuucucgugaucucuggccuguuuccaauuagcauccccauaacugcggcugccugguacuugugggaggugaaaaagcagcgagccggugucuuaugggaugugccuuccccacccccuauggggaaagccgaacuggaggacggagcuuaucgcauuaagcaaaaaggcauccucggcuacucacagaucggggcaggaguuuacaaggaagguacauuccacaccauguggcauguaacucggggcgccgugcugaugcacaaggggaaaagaauugagccgaguugggcggaugucaagaaagaccuuaucagcuauggaggcgguuggaagcuggagggggaauggaaagagggagaagaggugcagguuuuggcucuagaaccaggcaagaaucccagggccgugcagacaaagccuggccuguuuaaaaccaacacggggacuauaggagcagucucucucgauuucuccccagguaccucaggcagucccauuaucgacaagaaagggaaggugguaggacuguacggcaacggugucgugacacguagcggggccuauguuuccgcuauugcccaaaccgagaaaucuaucgaggauaauccugaaauagaggacgauauuuuucgcaagcggagacuuacaaucauggacuuacacccgggagcaggcaagacuaaaagguaccugcccgcuaucgugcgagaagccauuaagcggggccuccgcaccuugauccuggcgccaacgagagucguggccgcagagauggaagaggcucucagggggcugccuauucgguaucagacacccgccauacgagcugagcauacuggaagagaaaucguugaccuuaugugucacgcaaccuucacaaugcgccuguugucgccagugagggucccuaacuacaaucuaauuaucauggaugaggcccauuucaccgaccccgccagcaucgcugcgcgugguuauauuucaacucggguggaaaugggcgaggcagccgggauauuuaugaccgcuacaccaccgggauccagagauccuuucccccagaguaacgccccaaucauugacgaggaaagggagauccccgaacgcucuuggaauagcggccacgaguggguaacggauuuuaaagguaagacugugugguucguuccuuccauuaaagcagggaacgacaucgccgcuugccugcgaaagaauggaaagaaagucauacaacucucaagaaagaccuuugauucugaauacgugaaaacacggaccaacgacugggauuucguggucacuacagacaucagcgagaugggcgcgaauuuuaaggccgagaggguaauugauccacgccguuguaugaaacccgugaucuuaaccgacggcgaagagagaguuauucuggcagggccuaugccggugacgcauaguuccgcugcccagcggaggggacgcaucggucgaaacccaaagaaugaaaacgaccaguacauauauaugggcgagccccuugaaaaugaugaggacugcgcacacuggaaagaggccaagaugcugcucgauaacauuaauacuccugaagggaucauucccagcauguucgagccagaaagagagaaggucgacgcuaucgauggagaauaccgguugaggggcgaggcccgcaaaacauuuguggaccugaugagaaggggugaucucccuguuuggcuggcguauaagguggcagccgaggggauaaacuacgcugaccggcguugguguuucgauggcaucaaaaacaaucagauucuugaagagaacgucgaaguggagaucuggaccaaggagggagaacgcaaaaagcuaaagccccgauggcuggacgccagaauuuauucugauccauuggcuuuaaaagaguuuaaggaguucgcagccggcaggaaaucacugacccucaaucugaucacugagauggggcggcuuccuacauucaugacccaaaagacacgcgacgcucuggauaaccucgccguauugcacacugcagaagcgggagguagagccuacaaucaugcucuguccgagcuaccggagacgcuggaaacccuccuucuguuaacauugcuggccacugugaccggcgggauauuucucuuccugaugaguggaaggggcauugguaaaaugacacuugggaugugcugcaucaucaccgcaagcauucugcucugguaugcucagauccagccccacuggauagccgcaucgauuaucuuggaguuuuuccugauuguuuuacuaaucccagaaccugagaagcagcggacuccccaagacaaccagcugacguacgucgugauagccauccucaccguggucgcugcgacaauggccaaugaaaugggcuuucuugagaagacuaaaaaggaccugggauugggcucuauugcaacccagcagccagaguccaacauccuggauauugaccuccgaccugcuagcgccuggacacuguacgccguugcaaccacuuucgugacacccaugcuuagacauucaaucgaaaauaguucuguaaacgugucccucacggcuauugccaaucaagcgaccguccugaugggguugggaaaagguuggccgcugagcaagauggauaucggcgugccauuacuagcuauaggguguuauucacagguuaacccuauuacucugacagccgcacuccuucuguugguggcccacuacgcuaucaucggacccggccugcaggcaaaagccacccgcgaggcgcagaagagggcugccgcagguauuaugaagaauccaaccgucgacgggauaacaguaaucgaucucgaccccauuccuuaugauccgaaauuugaaaagcaacugggccaggugaugcuuuuaauccugugcguuacucaggugcucaugaugcggacgaccugggccuugugugaggcucugacacuagccacuggacccauuaguacccugugggaaggcaacccagggcguuucuggaauacaaccaucgcagucagcauggcuaacauauuuagaggauccuaccucgccggcgcgggucuucuguucucuaucaugaaaaauacuacgaacacaaggcgcgggaccggaaacauuggcgagacuuugggugagaaguggaaaagccggcugaaugcccucggcaaguccgaauuucaaaucuauaaaaagucagggauucaggagguggaccgaacccuggcaaaggaaggaaucaaaagaggcgagacagaucaccaugcugucucuagggggagugccaaguuacgcugguucguggagcggaacaugguuacuccugaaggaaaagugguagaccuuggcugcgguagagggggauggucguacuauuguggcggucugaagaaugugcgugaggucaaaggccucaccaaagggggacccggccacgaggaaccuauaccaaugagcacauacggguggaaccuaguuaggcugcaguccggaguggaugucuuuuucauucccccugaaaagugcgacacguugcugugugauaucggcgagucuucaccaaaucccaccguggaggcaggucggacucuccgcguacuuaaccugguggaaaauugguugaacaauaacacacaguucugcaucaaaguucugaauccguacaugccuagcgugauugagaagauggaagcucuccaacgaaaauaugggggagccuuagucagaaacccacuguccaggaauaguacccaugagauguacugggugucuaacgccagcggcaauauagucucauccgugaacaugaucagucggaugcuuauuaaccgcuuuacuaugagacacaagaaagcgacauaugaacccgacguugaccugggcagcgggaccaggaauaucggaauugagucugagaucccuaaccuagauauaaucgguaagcgaauugaaaagaucaaacaggagcaugaaacguccuggcacuacgaccaggaucacccauauaagaccugggcuuaccauggcucauaugagacaaaacagacugggagcgcaucgucuaugguaaauggagugguccggcuccugaccaagcccugggacguguugccgacaguuacucaaauggccaugaccgauacaaccccuuucggccagcagcguguguuuaaagaaaaggucgacacuagaacgcaggagcccaaggaggguaccaaaaagcugaugaaaauuaccgcugaauggcucuggaaggagcuugggaaaaagaaaacuccacgcauguguaccagggaagaguucacacggaaggugagaaguaacgccgcacugggagccaucuuuacggaugagaauaaguggaaauccgcucgcgaagcgguagaggacagcagguucugggaauuaguggauaaggagcgaaaccugcacuuggaaggcaaaugcgagaccuguguuuacaauaugaugggcaagcgggagaaaaagcucggggaauuuggaaaggccaaagguucaagagcaauuugguacauguggcugggcgcuagguuccuagaguuugaagcccuuggguuccugaacgaggaccauugguuuucccgcgaaaauucucucagcggagucgagggcgagggucugcacaaguugggguauauacugcgugaugugaguaaaaaggaaggaggcgcaauguacgccgacgacacugcuggcugggauacacggaucacccucgaggaccuuaaaaacgaagagauggugacuaaucacauggaaggggagcauaagaagcuggccgaggcgauuuucaaauuaacauaucaaaacaaggucguuagagugcagaggccuacaccccgcggaacaguaauggauaucaucucccgacgggaccagagagguagcggccaaguggggacuuacggacugaauaccuuuacgaacauggaagcacaguugauuaggcagauggagggcgaaggugucuucaaaaauauacagcaccucaccgugacagaggagguugccgugcauaacuggcuggcucgcgucgggagagaacggcuaucuaggauggccaucucaggagaugacugcgugguaaagccacuugaugaccguuucgcaaacgcucugacugcccucaaugauaugggcaaaauucgaaaggacauccaacagugggagcccaguaagggcuggaacgauuggacccagguuccuuuuugcucccaccauuuccacgaacugauuaugaaagacgggcgcaucuugguggucccauguagaaaucaggaugaguuaauaggacgggcuaggaucagccaaggugccggcuggucucugcgcgaaacagcaugccucgggaagucguaugcgcagauguggucacuuauguacuuucacagacgggaccugaggcuagccgcuaacgccauuuguagcgcagugccgucccauugggugcccacaagucgaaccacguggucuauccacgcuaaacaugaguggaugacaaccgaggacaugcugacugucuggaaucguguuuggauuagagaaaacccuuggauggaggauaagacaccaguggaaagcugggaggaaauccccuaucucggaaaacgcgaggaccaguggugcggcuccuugauaggucugaccucacgggccacuugggcaaagaauauucaggccgcgaucaaccaaguaaggagucuuauugggaaugaggaauacaccgauuacaugccuucuaugaagagauuccgccgggaggaagaggaagcuggagugcugugguga

SEQ ID NO: 14823 - RNA, 9876 nt, Artificial Sequence
  derived and/or modified CDS sequence (opt3) from DENV-2__EU482642__SS-prME
agcgcaggcaugaucauuaugcugauacccaccgugauggcuuuccaccucacuacucggaacggggaaccucauaugaucgucgguauucaagaaaagggaaaaucccuucuguuuaagacggaggacggcguuaauaugugcaccuugauggcaauggauuuaggggaacugugugaggacacgaucacuuacaaaugcccacuucucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccguguucgagcuaacugaugcccucgcacuggggaugauggucuugaagaucgugcguaauauggaaaaauaccagcuggcuguuacaauuauggccaucuuaugcgugcccaacgcagucauucuccagaaugccuggaagguaucauguaccauccuggcugugguuaguguguccccacuucuguugacaucuagccagcagaagacugacuggauaccucucgcgcugaccauuaagggacuaaaccccacggccaucuuucugacaacccuuuccagaacuaauaaaaagaggucauggccacucaacgaggcaaucauggcugucggcauggugagcauucuggccaguucuuugcugaagaaugacauaccgaugaccggcccuuuaguagccgggggacuccugacagugugcuauguccuuacuggucgcuccgcugaucuggaauuggagcgggcaaccgacguuaaaugggaggaucaggccgaaaucagcggcucgucacccauucucucuaucacgauuagugaggacggguccaugagcaucaagaacgaagaggaggaacagacacugaccauacuaaucagaacuggacugcuugugauuucuggccucuucccaaucagcauucccaucacagcggcugccugguaccugugggaggugaaaaagcagagggccggugucuugugggaugugccuuccccacccccuauggggaaagccgaauuagaggacggagcuuaucgaauaaagcaaaagggcauucugggcuacucacagaucggggcaggaguuuacaaagaagguaccuuucacacuauguggcauguaacacgcggcgccgugcucaugcacaaggggaaacggaucgagccgaguugggcggaugucaagaaagaccugauuagcuauggaggcgguuggaaacuugagggggaauggaaggagggagaagaggugcagguucuggcuuuggaaccaggcaaaaaucccagagccgugcagaccaagccuggccuauucaaaacgaacacugggaccaucggagcagucucucuggauuuuuccccagguacaucaggcagucccauaauugacaagaaagggaaggugguaggacucuacggcaacggugucgugaccaggagcggggccuauguuuccgcuaucgcccaaacagagaagucuauugaggauaauccugaaaucgaggacgauauauuccguaaacgccggcugacuauuauggaccuucacccgggagcaggcaagaccaaaagauacuuacccgcuaucgugagggaagccaucaagcgaggccugcggacgcucauuuuggcgccaacacgcgucguggccgcagagauggaagaggcucugagagggcucccuaucagguaucagacucccgccauucgggcugagcauaccggacgagaaauaguugaccugaugugucacgcaacauucaccaugagacuucugucgccagugcgcgucccuaacuacaauuugaucauuauggaugaggcccauuuuacugaccccgccagcaucgcugcgagggguuauaucucaacccguguggaaaugggcgaggcagccgggauuuucaugacagcuacgccaccgggaucccgggauccuuuuccccagaguaacgccccaauaaucgacgaggaaagagagauucccgaaaggucuuggaauagcggccacgaguggguaacugauuucaaagguaagaccgugugguuuguuccuuccaucaaggcagggaacgacauugccgcuugccuacgcaaaaauggaaagaaagucauccaacugucacgaaagacauucgauucugaauacgugaaaaccagaacuaacgacugggauuuuguggucacaaccgacauaagcgagaugggcgcgaauuucaaggccgagcggguaaucgauccaaggcgcuguaugaaacccgugauucucacggacggcgaagaacguguuaucuuagcagggccuaugccggugacucauaguuccgcugcccagagacggggaaggauuggucgcaacccaaagaaugaaaacgaccaguacaucuauaugggcgagccccuggaaaaugaugaggacugcgcacacuggaaggaggccaaaaugcuucuggauaacauaaauacaccugaagggauuauccccagcauguuugagccagaacgagagaaggucgacgcuauugauggagaauacagacuccggggcgaggccaggaaaaccuucguggacuugaugcgcagaggugaucugccuguuuggcucgcguauaagguggcagccgaggggaucaacuacgcugacaggcggugguguuuugauggcaucaagaacaaucagauccuggaagagaacgucgaaguggagauuuggaccaaggagggagaacguaagaaacuuaagccccgcuggcuagacgcccgaaucuauucugauccacuggcuuugaaagaguucaaggaguucgcagccggcagaaaaucauuaacucugaaucucauuacagagauggggaggcugccuaccuuuaugacacaaaagacucgggacgcucuugauaaccuggccguacuccacacggcagaagcgggaggucgcgccuacaaucaugcuuuguccgagcugccggagacccuagaaacacugcuccuucugacuuuauuggccaccgugacaggcgggaucuuccuguuucucaugaguggaagaggcauagguaagaugacccuggggaugugcugcauuaucacugcaagcauccuucugugguaugcucagauucagccccacuggaucgccgcaucgauaauucucgaguucuuuuugaucguucuguuaauuccagaaccugagaaacagaggacgccccaagacaaccagcuaaccuacgucgugaucgccauacugacaguggucgcugcgacuauggccaaugaaaugggcuuccucgagaagaccaaaaaggaccuuggacugggcucuaucgcaacacagcagccagaguccaacauuuuggauaucgaccugcggccugcuagcgccuggacccucuacgccguugcaacuacauuugugacgcccaugcugcgacauucaauugaaaauaguucuguaaacgugucccuuaccgcuaucgccaaucaagcgacuguccucauggggcugggaaaagguuggccguugagcaagauggauauuggcgugccacuguuagcuaucggguguuauucacagguuaacccuauaacacuaaccgccgcacugcuccuucugguggcccacuacgcuauuaucggacccggcuugcaggcaaaggccaccagagaggcgcagaaacgcgcugccgcagguaucaugaagaauccaacagucgacgggauuacuguaauagaucuggaccccaucccuuaugauccgaaauucgaaaagcaacucggccaggugaugcugcuuauuuuaugcguuacacaggugcugaugaugaggaccacaugggcccucugugaggcuuugacucuggccaccggacccaucaguacacuaugggaaggcaacccagggcgguuuuggaauaccacuauugcagucagcauggcuaacaucuuccguggauccuaccuggccggcgcgggucuccuauuuucuauaaugaaaaauacgacaaacaccagaagggggacuggaaacaugggcgagacccugggugagaaguggaaaagccgcuugaaugcccugggcaaguccgaguuccaaaucuauaagaaaucagggauucaggagguggaccggacacucgcaaaggaaggaaucaaacgaggcgagacugaucaccaugcugucucuagagggagugccaagcugaggugguuuguggagcgcaacaugguuaccccugaaggaaaagugguagacuuaggcugcgguagagggggauggucguacuauuguggcggucuuaagaaugugagagaggucaagggccugacaaaagggggacccggccacgaagaaccuauuccaaugagcacguacggguggaaccucguucgucuacaguccggaguggaugucuucuucauacccccugaaaagugcgacacccuguugugugauauaggcgagucuucaccaaaucccacuguggaggcagguaggacacugcggguacucaaccuuguggaaaauuggcugaacaauaacacccaguuuugcauuaaaguuuugaauccguacaugccuagcgugaucgagaagauggaagcucugcaacgcaaauaugggggagcccucguccgaaacccauuauccagaaauaguacucaugagauguacugggugucuaacgccagcggcaauaucgucucauccgugaacaugauuaguaggaugcugauaaaccgguucacaaugcgccacaagaaggcgaccuaugaacccgacguugaccuuggcagcgggacgagaaauaucggaauugagucugagaucccuaaccuggauauuaucgguaaaaggauagaaaagaucaaacaggagcaugaaaccuccuggcacuacgaccaggaucacccauauaagacaugggcuuaccauggcucauaugagacuaaacagaccgggagcgcaucgucuaugguaaauggagugguccgacuacucacaaagcccugggacgugcugccgacuguuacccaaauggccaugacagauaccacuccuuuuggccagcagcggguguucaaggaaaaagucgacacgcguacacaggagcccaaggaggguaccaaaaaguugaugaaaauuacugcugaauggcuguggaaggagcucgggaaaaagaagaccccaagaaucuguacacgcgaagaguuuacgaggaaagugcggaguaacgccgcacuuggagccauuuucaccgaugagaauaaguggaaauccgcuagagaagcgguagaggacagccgcuuuugggaacugguggauaaggagaggaacuuacaccuggaaggcaaaugcgagacuuguguuuacaauaugaugggcaagcgagagaagaaauugggggaguucggaaaggccaaagguucacgggcaaucugguacauguggcucggcgcuagauuucuggaguucgaagcccuaggguuucuuaacgaggaccauugguucuccagggaaaauucucugagcggagucgagggcgagggucuccacaagcugggguauauuuugcgcgaugugaguaaaaaggaaggaggcgcaauguacgccgacgacacagcuggcugggauacccguauaacucuggaggaccucaagaacgaagagauggugacaaaucacauggaaggggagcauaagaaacuugccgaggcgaucuuuaaacugaccuaucaaaacaaagucguucgggugcagagaccuacacccaggggaacuguaauggauauuaucucccgcaaagaccagcgagguagcggccaaguggggaccuacggauuaaauacguucaccaacauggaagcacagcugauccggcagauggagggcgaaggugucuucaagaauauucagcacuugacagugacugaggagguugccgugcaaaacuggcucgcuagagucgggagggaacgccugucuagaauggccauaucaggagaugacugcgugguaaagccacuagaugaccgguuugcaaacgcucuuaccgcccugaaugauaugggcaaaaucaggaaggacauucagcagugggagcccaguaaaggcuggaacgauuggacacagguuccuuucugcucccaucacuuucaugaacucaucaugaaggacgggcgugugcuggucgugccaugucgaaaucaagaugaguugauuggacgcgcuagaaucagccagggugccggcuggucuuuacgggaaacugcaugccuggggaaaucguaugcgcagauguggucacucauguacuuccacaggcgcgaccuuagacuggccgcuaacgccauauguagcgcagugccgucccacuggguccccaccagucggacgacauggucuauccaugcuaagcacgaguggaugaccacugaggacaugcuaacaguuuggaauaggguguggauucaggaaaacccuuggauggaggauaagaccccaguagaaagcugggaggaaauccccuaucugggaaaacgagaggaccaauggugcggcucccucauugguuugacuucacgugccaccugggcaaagaauauccaggccgcgauaaaccaggugagaagucugauugggaaugaggaauacacagauuacaugccuucuaugaaacgcuuucggagggaggaagaggaagcuggaguccuuugguga

SEQ ID NO: 14824 - RNA, 9876 nt, Artificial Sequence
  derived and/or modified CDS sequence (opt3) from DENV-2__EU482643__SS-prME
agcgccggaaugaucauuaugcugauacccaccgugauggcuuuccaccucacuacucggaacggggaaccucauaugaucgucggcauucaggaaaaggguaaaucccuucuguuuaagacggaggacggaguuaauaugugcaccuugauggcaauggauuuaggggaacugugugaggacacaaucacuuacaaaugcccauuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaaugaagaacaaggccuggcucgugcacaggcagugguuucuggacuuaccucugccauggcuccccggcgcagauaaacaggagucuaauuggauccagaaggagacccuuguuacuuucaaaaacccucaugcuaagaaacaagacguggucgugcugggaucccaggaaggcgccaugcacacagcguugacgggggccaccgagauacagaugucaagcggaaaucuacuguuuacuggucaucucaagugccggcugcguauggacaaacuucaacugaaaggcaugaguuacucuauguguacagggaaguucaaaguaguuaaggaaauugcagagacccagcacggaacaaucgugauccgcguccaguaugagggcgaugguuccccaugcaaaauucccuucgaaaucauggacuuggagaagagauacgugcucgggaggcugauuacugucaacccgauagugaccgaaaaggauagcccuguuaacaucgaggcugaacccccauuuggcgacucguacauuaucaucggaguggagccuggccaguuaaaacugaauugguucaagaaagggucuuccauuggacaaauguuugagacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaagaacugaagugcgggucaggaaucuucauuacggacaacgugcacacauggaccgagcaguauaaauuucaacccgaaaguccaagcaaguuggccuccgcuauccagaaagcccaggaggaaggcauaugugguauuagaucugucacuaggcucgagaaucugauguggaagcagaucacacccgaguuaaaccacauucuggcagaaaaugagguuaaacuaaccaucaugacuggcgauauaaaggggaucaugcaagccggaaagcggucgcuccgcccucagccaaccgaacugaaauacagcuggaagacauggggcaaagcuaagaugcuuuccacggagucauauaaccagaccuucuugauugacgggccggaaacuacagagugccccaauaccaacagagccuggaauagucuggagguggaagauuacggauuuggcguguucacaacuaacaucuggcucaaacugaaggagaagcaggacgcauuuugugacucuaaauuaaugagcgcggcuauuaaggauaauagggccguacaugcagacauggguuauuggaucgaauccgcccugaacgauaccuggaaaauagagaaggcuucauucauugaggucaaaaauugccacuggccuaagagccauacgcuuuggucuaacgggguguuggaauccgagaugaucaucccaaagaaccucgccggacccguuagucaacacaauuaccguccuggcuaccacacacagauugcagguccauggcaucugggcaaacuagaaauggacuucgauuuuugugacgggaccacugugaucgucaccgaggauugcggaaaccggggccccagccugcgaacaacuaccgcuucugggaagcucauuacagaauggugcuguagauccugcacgcugccgccucuuagguaucgcggagaggacggcuguugguacgguauggagauacggccauugaaagaaaaggaggaaaaucuggugaacucauuaguuaccgccgggcacggacagguggauaauuucagucucggcguacuggguauggcgcuuuuucuggaggaaauguugagaacuagggucggcacaaaacaugccauccuccuggugaccgugagcuucgucacucuaauuacagggaacaugucguuuaaggaccugggacgcguugugguaauggugggcgcuaccauggcagaugacaucgggaugggagucacguaucucgcccugcuugcugccuucaaggugcgacccacuuuugcagcgggcuugcuguuacggaaacucaccuccaaggagcugaugaugacaaccauugguaucguucuucugucucaaagcacuauaccugagacagugcuagaacucaccgaugcccuggcuuuggggaugaugguccugaaaaucgugcguaauauggagaaguaccaguuagccguuacaauuauggcaauccucugcgugcccaacgcugucauucugcagaaugccuggaaaguaucauguacuauccuugcagugguuaguguguccccacuguugcucaccucuagccagcaaaagacggacuggauaccucuggcccuaacaauuaaaggacugaaccccaccgcuaucuuccuuacuacccucuccagaacaaauaagaagaggucauggccacugaacgaagcgaucauggccgucggcauggugagcauuuuggcaaguucucugcuaaagaaugacauaccgaugacuggcccucucguagcugggggacugcuuaccgugugcuauguccugacgggucgcuccgccgauuuggagcucgaacgggccacagacguuaagugggaggaucaggcugagaucagcggcucgucacccauucugucuaucaccauuagugaagacggguccaugagcaucaaaaacgaggaagaggagcagacucuaacaauacugaucagaaccggacuucucgugauuucuggccuguuuccaaucagcauucccaucacugcagccgcgugguacuugugggaagugaagaaacagagggcuggugucuuaugggaugugccuuccccacccccuauggggaaggccgagcuggaagacggagcauaucgaauaaagcaaaaaggcauucucggcuacucacagaucggggccggaguuuacaaggaggguacauuccacaccauguggcauguaacgcgcggcgcugugcugaugcacaaagggaagcggaucgaaccgaguugggcagaugucaaaaaggaccuuauuagcuauggaggcgguuggaagcuggagggggaguggaaagaaggagaggaagugcagguuuuggcccuagagccaggcaagaaucccagagcggugcagacuaaaccuggccuguuuaagaccaacacagggaccaucggagcugucucucucgauuucuccccagguacaucaggcagucccauaauugacaaaaaggggaaggugguaggacuguacggcaacggugucgugacuaggagcggggccuauguuuccgcaaucgcccaaaccgaaaaaucuauugaggauaauccugagaucgaagacgauauauuucguaagcgccggcuuacgauuauggacuuacacccgggagcuggcaaaacaaagagauaccugcccgccaucgugagggaggcaaucaaacgaggccuccggacuuugauucuggcuccaacccgcgucguggccgcggaaauggaggaagcccucagagggcugccuaucagguaucagacacccgcaauucgggcugagcauaccggacgagagauaguugaccuuaugugucacgccacuuucaccaugagacuguugucgccagugcgcgucccuaacuacaaucuaaucauuauggaugaagcucauuucacagaccccgcaagcaucgccgccagggguuauaucucaacgcguguggagaugggcgaagcugcggggauuuuuaugacugcaaccccaccgggaucccgggauccuuucccccagaguaacgccccaauaaucgacgaggagagagaaauucccgagaggucuuggaauagcggccacgaauggguaacagauuuuaaggguaagaccgugugguucguuccuuccaucaaagcugggaacgacauugccgcaugccugcgcaagaauggcaagaaggucauccaacucucacgaaaaacuuuugauucugaguacgugaagacaagaaccaacgacugggauuucguggucacgacugacauaagcgaaaugggcgccaauuuuaaagcugagcggguaaucgauccaaggcgcuguaugaagcccgugauuuuaacagacggcgaggaacguguuauccuggcggggccuaugccggugacccauaguuccgccgcacagagacggggaaggauuggucgcaacccaaagaaugagaacgaccaguacaucuauaugggcgaaccccuugagaaugaugaagacugcgcucacuggaaagaggccaagaugcugcucgauaacauaaauaccccugaggggauuauccccagcauguucgaaccagagcgagaaaaagucgacgcaauugauggagaguacagauugcggggcgaagccaggaagacuuuuguggaccugaugcgcagaggugaucucccuguuuggcuggcuuauaaaguggccgcggaggggaucaacuacgcagacaggcggugguguuucgauggcauaaagaacaaucagauccuugaggaaaacgucgagguggaaauuuggacaaaggagggagagcguaaaaagcuaaaaccccgcuggcuggacgcccgaaucuauucugauccauuggcuuuaaaggaauuuaaagaguucgccgcuggcagaaagucacugacccucaaucugauuacagaaauggggaggcuuccuacuuucaugacgcaaaagacccgggacgcacuggauaaccucgccguauugcacacagcugaggccggaggucgcgcauacaaucaugcgcuguccgaacuaccggagacucuggagacccuccuucuguuaacauugcuggccaccgugacuggcgggaucuuucucuuccugaugaguggaagaggcauagguaaaaugacgcuugggaugugcugcauuaucaccgcuagcauccugcucugguaugcccagauucagccccacuggaucgcagcuucgauaauuuuggaauuuuuccugaucguuuuacuaauuccagagccugaaaagcagaggacaccccaagacaaccagcugacuuacgucgugaucgccauacucaccguggucgcagccacaauggcuaaugagaugggcuuucuugagaagaccaagaaagaccugggauugggcucuaucgcgacucagcagccagaguccaacauucuggauaucgaccuccggccugccagcgcauggacacuguacgcuguugccacgaccuucgugacucccaugcuucgacauucaauugagaauaguucuguaaacgugucccucacagccaucgcaaaucaagcuaccguccugaugggguugggaaaggguuggccgcugagcaagauggauauuggcgugccauuacuagccaucggguguuauucacagguuaacccuauaacccugacagcggcucuccuucuguugguggcccacuacgcaauuaucggacccggccugcaggccaaagcuacuagagaagcacagaagcgcgccgcggcugguaucaugaaaaauccaacggucgacgggauuaccguaauagaucucgaccccaucccuuaugauccgaaguuugagaaacaacugggccaggugaugcuuuuaauucugugcguuacacaggugcucaugaugaggacuaccugggccuugugugaagcacugacacuagccaccggacccaucaguacucugugggagggcaacccagggcgguucuggaauacgacaauugcugucagcauggccaacaucuuucguggauccuaccucgcaggcgcuggucuucuguucucuauaaugaagaauaccacuaacaccagaagggggacaggaaacaucggcgaaacuuugggugagaaauggaaaagccgccugaaugcccucggcaaguccgaguuucaaauuuauaaaaagucagggauccaggaaguggaccggacccuggcgaaagagggaauuaagcgaggcgaaacagaucaccaugccgucucuagagggagugcaaaauuaaggugguucguggagcgcaacaugguuacgccugagggaaaggugguagaccuuggcugcgguagagggggauggucguacuauuguggcggucugaagaaugugagagaagucaaaggccucaccaaagggggacccggccacgaggaaccuaucccaaugagcacuuacggguggaaccuaguucgucugcaguccggaguggaugucuuuuucauacccccugagaaaugcgacacauugcugugugauauuggcgaaucuucaccaaaucccaccguggaggcugguaggacucuccggguacuuaaccugguggagaauugguugaacaauaacacacaguucugcaucaagguucugaauccguacaugccuagcgugaucgagaaaauggaggcccuccaacgcaaguaugggggagcauuaguccgaaacccacuguccagaaauaguacccaugaaauguacugggugucuaacgcuagcggcaauauugucucauccgugaacaugauaaguaggaugcuuaucaaccgguuuacgaugcgccacaagaaagccaccuaugagcccgacguugaccugggcagcgggacaagaaauauuggaaucgaaucugagauuccuaaccuagauaucauagguaagaggaucgagaaaauuaagcaggaacaugagacuuccuggcacuacgaccaggaucacccauauaaaaccugggccuaccauggcucauaugaaacaaagcagacugggagcgcgucgucuaugguaaauggagugguccgacuccugaccaagcccugggacguguugccgacaguuacccaaauggcuaugacugauacgacaccuuucggccagcagcggguguuuaaagagaaggucgacacccguacucaggaacccaaagaggguaccaagaaacugaugaagaucacagcagaguggcucuggaaagaacuugggaagaagaaaacgccaagaauguguacccgcgaggaguucacuaggaaggugcggaguaacgccgcucugggagccauuuuuacagaugagaauaaauggaaguccgcaagagaggccguagaagacagccgcuucugggaguuaguggauaaagaaaggaaccugcacuuggagggcaagugcgaaaccuguguuuacaauaugaugggcaagcgagagaaaaagcucggggaguuuggaaaagcuaaggguucacgggcgaucugguacauguggcugggcgccagauuccuagaauuugaggcacuuggguuccugaacgaagaccauugguuuuccagggaaaauucucucagcggagucgaaggcgagggucugcacaaauugggguauauucugcgcgaugugaguaagaaggagggaggcgcuauguacgccgacgacacugcaggcugggauacacguauaacccucgaagaccuuaaaaacgaggaaauggugacaaaucacauggagggggaacauaagaaacuggccgaggcuaucuucaaguuaacuuaucaaaacaaagucguucgggugcagagaccuacccccaggggaacgguaauggauauuaucucccgccgagaccagcgggguagcggccaaguggggaccuacggacugaauacauuuacuaacauggaggcccaguugaucagacagauggaaggcgagggugucuucaagaauauucagcaccucaccgugacagaagagguugcggugcaaaacuggcuggcaagggucgggcgcgagagacuaucucggauggccauaucaggagaugacugcgugguaaagccacuugaugacagguucgcuaacgcccugacugcacucaaugauaugggcaaaauccguaaggacauucagcagugggaacccaguaaaggcuggaacgauuggacccagguuccuuuuugcucccaucacuuccaugagcugaucaugaaggacgggcgaguguuggucgugccaugucgcaaucaagaugaauuaauugguagagcucggaucagccagggagccggcuggucucugagggagacggcuugccucgggaaaucguaugcccagauguggucacuuauguacuuucaccgcagagaccugcggcuagcagcgaacgccauauguagcgcugugccgucccacuggguccccacaaguaggaccacuuggucuauccaugccaagcacgaauggaugacaaccgaggacaugcugacuguuuggaaucgaguguggauucgugauaacccuuggauggaggacaagaccccaguagaaagcugggaggaaauccccuaucucggaaaaagagaggaucaguggugcggcuccuugauuggucugacaucacgcgcaacgugggcuaagaauauccaagccgcaauaaaccaggugcggagucuuauggggaaugaagaguacaccgacuacaugccuucuaugaaaagguucagacgcgaggaagaggaagccggaguccugugguga

SEQ ID NO: 14825 - RNA, 9876 nt, Artificial Sequence
  derived and/or modified CDS sequence (opt3) from DENV-2__EU482644__SS-prME
agcgccggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggacaggagucaccuaucucgcccugcuugcagcguucaaagugcgacccacguuugccgcuggcuugcuguuacggaagcucacuuccaaggagcugaugaugaccacaauugguaucguucuucugucucagagcaccauaccugaaacugugcuagagcucacagaugcccuggcauuggggaugaugguccugaaaaucgugcguaauauggaaaaguaccaguuagcuguuaccauuaugacaauccucugcgugcccaacgccgucauucugcagaaugcauggaaaguaucauguacuauccuugccgugguuaguguguccccacuguugcucaccucuagccaacagaagacggacuggauaccucuggcucuaacaauuaaaggacugaaccccaccgcgaucuuccuuacuacccucuccagaacaaauaagaaaaggucauggccacugaacgaggccaucauggcagucggcauggugagcauuuuggcuaguucucuguuaaagaaugacauaccgaugacuggcccucucguagccgggggacugcuuaccgugugcuauguccugacgggucgcuccgccgauuuggaacucgagcgggcuacagacguuaagugggaggaucaggcagaaaucagcggcucgucacccauucugucuaucaccauuagugaggacggguccaugagcaucaaaaacgaagaggaggaacagacucuaacaauacugaucagaaccggacuucucgugauuucuggccuguuuccaaucagcauucccaucacugccgcggcuugguacuugugggaggugaagaaacaaagggccggugucuuaugggaugugccuuccccacccccuauggggaaggcagaacuggaggacggagccuaucgaauaaaacagaagggcauucucggcuacucacagaucggggcuggaguuuacaaggaagguacauuccacaccauguggcauguaacgcgcggcgcagugcugaugcacaaagggaagcggaucgagccgaguugggccgaugucaaaaaggaccuuauuagcuauggaggcgguuggaaacuggagggggaauggaaggagggagaagaggugcagguuuuggcgcuagaaccaggcaagaaucccagagcugugcaaacuaaaccuggccuguuuaagaccaacacagggaccaucggagccgucucucucgauuucuccccagguacaucaggcagucccauaauugacaaaaaggggaaagugguaggacuguacggcaacggugucgugacuaggagcggggcauauguuuccgccaucgcucagaccgagaagucuauugaggauaauccugaaaucgaggacgauauauuucguaagcgccggcuuacgauuauggacuuacacccgggagccggcaaaacaaagagauaccugcccgcaaucgugagggaagcuaucaaacgaggccuccggacuuugauucuggccccaacccgcgucguggcggccgagauggaagaggcacucagagggcugccuaucagguaucagacacccgcuauucgggccgagcauaccggacgagaaauaguugaccuuaugugucacgcuacuuucaccaugagacuguugucgccagugcgcgucccuaacuacaaucuaaucauuauggaugaggcacauuucacagaccccgccagcaucgccgcuagggguuauaucucaacgcguguggaaaugggcgaggcggcagggauuuuuaugacugccaccccaccgggaucccgggauccuuucccccaaaguaacgcuccaauaaucgacgaggaaagagagauucccgaaaggucuuggaauagcggccacgaguggguaacagauuuuaaggguaaaaccgugugguucguuccuuccaucaaggccgggaacgacauugcagccugccugcgcaagaauggcaagaaggucauccagcucucacgaaaaacuuuugauucugaauacgugaagacaagaaccaacgacugggauuucguggucacgacugacauaagcgagaugggcgcuaauuuuaaagcggagcggguaaucgauccaaggcgcuguaugaagcccgugauuuuaacagacggcgaagaacguguuauccuggccgggccuaugccggugacccauaguuccgcagcucagagacggggaaggauuggucgcaaccccaaaaaugaaaacgaccaguacaucuauaugggcgagccccuugaaaaugaugaggacugcgcccacuggaaggaggcaaagaugcugcucgauaacauaaauaccccugaagggauuauccccagcauguucgagccagaacgagagaaagucgacgccauugauggagaauacagauugcggggcgaggcuaggaagacuuuuguggaccugaugcgcagaggugaucucccuguuuggcuggccuauaaaguggcggcagaggggaucaacuacgccgacaggcggugguguuucgauggcauaaagaacaaucaaauccuugaagagaacgucgaaguggagauuuggacaaaagagggagaacguaagaagcuaaaaccccgcuggcuggacgcucgaaucuauucugauccauuggccuuaaaggaguuuaaagaguucgcugcaggcagaaagucacugacccucaaucugauuacagagauggggaggcuuccuacuuucaugacgcagaaaacccgggacgcccuggauaaccucgcuguauugcacacagccgaagcaggaggucgcgcguacaaucaugcccuguccgagcuaccggagacucuggaaacccuccuucuguuaacauugcuggcuaccgugacuggcgggaucuuucucuuccugaugaguggaagaggcauagguaagaugacgcuugggaugugcugcauuaucaccgccagcauccugcucugguaugcacagauucagccccacuggaucgcugccucgauaauuuuggaguuuuuccugaucguuuuacuaauuccagaaccugagaagcaaaggacaccccaggacaaccagcugacuuacgucgugaucgcaauacucaccguggucgccgcuacaauggcgaaugaaaugggcuuucuugagaaaaccaagaaagaccugggauugggcucuaucgccacucagcaaccagaguccaacauucuggauaucgaccuccggccugcaagcgcuuggacacuguacgccguugccacgaccuucgugacucccaugcuucgacauucaauugaaaauaguucuguaaacgugucccucacagcaaucgcuaaucaggccaccguccugaugggguugggaaaggguuggccgcugagcaaaauggauauuggcgugccauuacuagcgaucggguguuauucacagguuaacccuauaacccugacagcugcccuccuucuguugguggcacacuacgccauuaucggacccggccugcaggcuaaggcaacuagagaggcccaaaagcgcgcggcugccgguaucaugaaaaauccaacggucgacgggauuaccguaauagaucucgaccccaucccuuaugauccgaaguuugaaaaacagcugggccaggugaugcuuuuaauucugugcguuacacaagugcucaugaugaggacuaccugggcauugugugaggcccugacacuagcuaccggacccaucaguacucugugggaaggcaacccagggcgguucuggaauacgacaauugccgucagcauggcaaacaucuuucguggauccuaccucgcuggcgccggucuucuguucucuauaaugaagaauaccacuaacaccagaagggggacaggaaacaugggcgagacuuugggugagaaauggaaaagccgccugaaugcgcucggcaaauccgaauuucagaucuauaagaagucagggauucaggagguggaccggacccuggccaaagaaggaaucaagcgaggcgagacagaucaccaugcagucucuagagggagugcuaaauuaaggugguucguggagcgcaacaugguuacgccugaaggaaaggugguagaccuuggcugcgguagagggggauggucguacuauuguggcggucugaaaaaugugagagaggucaagggccucaccaaagggggacccggccacgaggaaccuauuccaaugagcacuuacggguggaaccuaguucgucugcaguccggaguggaugucuuuuucaucccaccugaaaaaugcgacacauugcugugugauauaggcgagucuucaccaaaucccaccguggaggccgguaggacucuccggguacuuaaccugguggaaaauugguugaacaauaacacacaauucugcauuaagguucugaauccguacaugccuagcgugaucgagaaaauggaagcacuccagcgcaaguaugggggagcuuuaguccgaaacccacuguccagaaauaguacccaugagauguacugggugucuaacgccagcggcaauaucgucucauccgugaacaugauuaguaggaugcuuauaaaccgguuuacgaugcgccacaaaaaggccaccuaugaacccgacguugaccugggcagcgggacaagaaauaucggaauugagucugagaucccuaaccuagauauuaucgguaagaggauagagaaaaucaagcaggagcaugaaacuuccuggcacuacgaccaggaucacccauauaaaaccugggcguaccauggcucauaugagacaaagcaaacugggagcgcuucgucuaugguaaauggagugguccgacuccugaccaaacccugggacguguugccgacaguuacccagauggcaaugacugauacgacaccuuucggccagcagcggguguuuaaggaaaaggucgacacccguacucaagagcccaaagaggguaccaagaaacugaugaagauuacagccgaauggcucuggaaagagcuugggaagaaaaagacgccaagaauguguacccgcgaagaguucacuaggaaggugcggaguaacgcugcccugggagcaaucuuuacagaugagaauaaauggaaguccgccagagaagcuguagaggacagccgcuucugggaauuaguggauaaagagaggaaccugcacuuggaaggcaagugcgagaccuguguuuacaauaugaugggcaaacgagagaagaagcucggggaauuuggaaaagcgaaggguucacgggccauuugguacauguggcugggcgcaagauuccuagaguuugaagcucuuggguuccugaacgaggaccauugguuuuccagggaaaauucucucagcggagucgagggcgagggucugcacaaauugggguauauccugcgcgaugugaguaagaaagaaggaggcgccauguacgcagacgacacugccggcugggauacacguauuacccucgaggaccuuaagaacgaagagauggugacaaaucacauggaaggggagcauaagaaacuggcugaggccauauucaaguuaacuuaucagaacaaagucguucgggugcagagaccuacccccaggggaacgguaauggauaucauuucccgccgagaccaacgggguagcggccagguggggaccuacggacugaauacauuuacuaacauggaagcgcaguugaucagacagauggagggcgaaggugucuucaagaauauccaacaccucaccgugacagaggagguugcagugcagaacuggcuggccagggucgggcgcgaaagacuaucucggauggcuauuucaggagaugacugcgugguaaaaccacuugaugacagguucgccaacgcacugacugcucucaaugauaugggcaagauacguaaggacauccagcagugggagcccaguaaaggcuggaacgauuggacccaaguuccuuuuugcucccaucacuuccaugaacugauuaugaaggacgggcgaguguuggucgugccaugucgcaaucaggaugaguuaaucgguagagcccggauuagccagggagcuggcuggucucugagggaaacggccugccucgggaaaucguaugcacagauguggucacuuauguacuuucaccgcagagaccugcggcuagcggccaacgcuaucuguagcgccgugccgucccacuggguccccacaaguaggaccacuuggucuauacaugcaaagcacgaguggaugacaaccgaggacaugcugacuguuuggaaucgaguguggauccgugaaaacccuuggauggaggauaaaaccccaguagaaagcugggaggaaauucccuaucucggaaagagagaggaccaauggugcggcuccuugaucggucugacaucacgcgcuacgugggccaagaauauucaggcagccaucaaccaggugcggagucuuauagggaaugaggaauacaccgauuacaugccuucuaugaaaagguucagacgcgaggaagaggaagcgggaguccugugguga

SEQ ID NO: 14826 - RNA, 9876 nt, Artificial Sequence
  derived and/or modified CDS sequence (opt3) from DENV-2__EU482645__SS-prME
agcgccggcaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagaaggugcucauuuucauccugcugacugcuguugcaccaucuaugacaaugcggugcauagggauuucgaaccgcgauuuuguggaaggagucucagguggcagcuggguggacaucguacucgagcacgggaguuguguuaccacuauggccaagaauaaacccacauuagauuucgaacugauuaagaccgaggcuaaacagccugccacgcuuagaaaguauugcaucgaagcgaaauugaccaacacaacuaccgaguccagguguccaacacaaggagagcccucucugaaggaagaacaggacaagcgguuugugugcaaacauagcauggucgaucgcggcugggguaauggguguggacuauucggcaagggcgggaucgugacuugcgcaauguuuaccugcaaaaagaacauggaaggaaaaauugugcagccugagaaucucgaauacacaauagucguuaccccacacuccggugaggagcaugccgugggcaacgacacugggaagcacggacaggaaaucaaaguaacgccgcaaucaaguauuacagaggcugaacugaccggcuaugguacugugaccauggaguguagcccccgaacagggcuugauuucaaugaaaugguccuguugcagauggagaacaaggccuggcucgugcacagacagugguuucuggacuuaccucugccauggcuccccggcgcagauaagcaggagucuaauuggauccaaaaagaaacccuuguuacuuucaagaacccucaugcuaaaaagcaggacguggucgugcugggaucccaggagggcgccaugcacacagcguugacgggggccaccgaaauacaaaugucaagcggaaaucuacuguuuacuggucaucucaaaugcaggcugcggauggacaaacuucagcugaagggcaugaguuacucuauguguacagggaaauucaagguaguuaaagagauugcagagacccagcacggaacaaucgugauccguguccaguaugaaggcgaugguuccccaugcaagauucccuucgagaucauggacuuggaaaaacgcuacgugcucgggagacugauuacugucaacccgauagugaccgagaaggauagcccuguuaacaucgaagcugagcccccauuuggcgacucguacauuaucaucggaguggagccuggccaauuaaagcugaauugguucaaaaaggggucuuccauuggacagauguuugaaacgaccaugaggggugccaaacggauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgaagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaauauaaguuucagcccgagaguccaagcaaauuggccuccgcuauccagaaggcccaggaagagggcauaugugguauucgcucugucacuagacucgagaaucugauguggaaacaaaucacacccgaauuaaaccacauucuggcagagaaugaaguuaagcuaaccaucaugacuggcgauauaaaagggaucaugcaggccggaaagaggucgcuccggccucagccaaccgagcugaaguacagcuggaaaacauggggcaaggcuaaaaugcuuuccacggaaucauauaaccagaccuucuugauugacgggccggagacugccgagugccccaauacaaaccgcgcauggaauagucuggaaguggaggauuacggauuuggcguguucaccacaaacaucuggcucaagcugaaagaaaagcaagacgcguuuugugacucuaaguuaaugagcgcugccauuaaagauaauagagcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucagcacaauuacaggccuggcuaccacacgcagauugcugguccauggcaucugggcaagcuagagauggacuucgauuuuugugacgggacaaccgugaucgucacugaagauugcggaaaccguggccccagccugcggaccacaacugccucugggaaacucauuaccgaguggugcugucgauccugcacacugccgccucuuagauauaggggagaggacggcuguugguacgguauggaaauacgcccauugaaggagaaagaagagaaucuggugaacucauuaguuacggcggggcacggacaaguggauaauuucagucucggcguacuggguauggcccuuuuucuggaagagauguugcggaccagagucggcacuaagcaugcuauccuccugguggcagugagcuucgucacacuaauuaccgggaacaugucguuuaaagaccugggaaggguugugguaauggugggcgccacuauggcugaugacaucgggacaggagucaccuaucucgcccugcuugcagcguucaaggugcgccccacguuugccgcuggcuugcuguuacgaaagcucacuuccaaagagcugaugaugaccacaauugguaucguucuucugucucagagcaccauaccugaaacugugcuagagcucacagaugcccuggcauuggggaugaugguccugaagaucgugcggaauauggaaaaauaccaguuagcuguuaccauuaugacaauccucugcgugcccaacgccgucauucugcagaaugcauggaagguaucauguacuauccuugccgugguuaguguguccccacuguugcucaccucuagccaacagaaaacggacuggauaccucuggcucuaacaauuaagggacugaaccccaccgcgaucuuccuuacuacccucucccguacaaauaaaaagagaucauggccacugaacgaggccaucauggcagucggcauggugagcauuuuggcuaguucucuguuaaagaaugacauaccgaugacuggcccucucguagccgggggacugcuuaccgugugcuauguccugacggguagguccgccgauuuggaacucgagcgcgcuacagacguuaaaugggaggaucaggcagaaaucagcggcucgucacccauucugucuaucaccauuagugaggacggguccaugagcaucaagaacgaagaggaggaacagacucuaacaauacugauccggaccggacuucucgugauuucuggccuguuuccaaucagcauucccaucacugccgcggcuugguacuugugggaggugaaaaagcaaagagccggugucuuaugggaugugccuuccccacccccuauggggaaagcagaacuggaggacggagccuauaggauaaagcagaagggcauucucggcuacucacagaucggggcuggaguuuacaaagaagguacauuccacaccauguggcauguaacgcgaggcgcagugcugaugcacaaggggaaacgcaucgagccgaguugggccgaugucaagaaagaccuuauuagcuauggaggcgguuggaagcuggagggggaauggaaggagggagaagaggugcagguuuuggcgcuagaaccaggcaaaaauccccgggcugugcaaacuaagccuggccuguuuaaaaccaacacagggaccaucggagccgucucucucgauuucuccccagguacaucaggcagucccauaauugacaagaaagggaaggugguaggacuguacggcaacggugucgugacuagaagcggggcauauguuuccgccaucgcucagaccgagaagucuauugaggauaauccugaaaucgaggacgauauauuuaggaaacgucgccuuacgauuauggacuuacacccgggagccggcaagacaaaacgguaccugcccgcaaucgugagagaagcuaucaagaggggccuccgaacuuugauucuggccccaacccgggucguggcggccgagauggaagaggcacuccgcgggcugccuaucagauaucagacacccgcuauuagggccgagcauaccggacgggaaauaguugaccuuaugugucacgcuacuuucaccaugcgacuguugucgccagugagagucccuaacuacaaucuaaucauuauggaugaggcacauuucacagaccccgccagcaucgccgcucgcgguuauaucucaacgaggguggaaaugggcgaggcggcagggauuuuuaugacugccaccccaccgggaucccgugauccuuucccccaaaguaacgcuccaauaaucgacgaggaacgggagauucccgaaagaucuuggaauagcggccacgaguggguaacagauuuuaaagguaagaccgugugguucguuccuuccaucaaggccgggaacgacauugcagccugccugaggaaaaauggaaagaaagucauccagcucucacgcaagacuuuugauucugaauacgugaaaacacgaaccaacgacugggauuucguggucacgacugacauaagcgagaugggcgcuaauuuuaaggcggagagaguaaucgauccacggagguguaugaaacccgugauuuuaacagacggcgaggaacgcguuauccuggccgggccuaugccggugacccauaguuccgcagcucagcguagaggacggauugguaggaacccaaagaaugaaaacgaccaguacaucuauaugggcgagccccuugaaaaugaugaggacugcgcccacuggaaggaggcaaaaaugcugcucgauaacauaaauaccccugaagggauuauccccagcauguucgagccagaacgcgagaaggucgacgccauugauggagaauaccgauugagaggcgaggcucggaaaacuuuuguggaccugaugaggcgcggugaucucccuguuuggcuggccuauaagguggcggcagaggggaucaacuacgccgacagaaggugguguuucgauggcaucaagaacaaucaaauccuugaagagaacgucgaaguggagauuuggacaaaggagggagaacggaagaaacuaaagccccguuggcuggacgcucgcaucuauucugauccauuggccuuaaaagaguuuaaggaguucgcugcaggccgaaaaucacugacccucaaucugauuacagagauggggagacuuccuacuuucaugacgcagaagaccagggacgcccuggauaaccucgcuguauugcacacagccgaagcaggaggucgggcguacaaucaugcccuguccgagcuaccggagacucuggaaacccuccuucuguuaacauugcuggcuaccgugacuggcgggaucuuucucuuccugaugaguggacgcggcauagguaagaugacgcuugggaugugcugcauuaucaccgccagcauccugcucugguaugcacagauucagccccacuggaucgcugccucgauaauuuuggaguuuuuccugaucguuuuacuaauuccagaaccugagaaacaaagaacaccccaggacaaccagcugacuuacgucgugaucgcaauacucaccguggucgccgcuacaauggcgaaugaaaugggcuuucuugagaagaccaaaaaggaccugggauugggcucuaucgccacucagcaaccagaguccaacauucuggauaucgaccucaggccugcaagcgcuuggacacuguacgccguugccacgaccuucgugacucccaugcuucggcauucaauugaaaauaguucuguaaacgugucccucacagcaaucgcuaaucaggccaccguccugaugggguugggaaaagguuggccgcugagcaagauggauauuggcgugccauuacuagcgaucggguguuauucacagguuaacccuauaacccugacagcugcccuccuucuguugguggcacacuacgccauuaucggacccggccugcaggcuaaggcaacucgagaggcccagaaaagagcggcugccgguaucaugaagaauccaacggucgacgggauuaccguaauagaucucgaccccaucccuuaugauccgaaauuugaaaagcagcugggccaggugaugcuuuuaauucugugcguuacacaagugcucaugaugcgcacuaccugggcauugugugaggcccugacacuagcuaccggacccaucaguacucugugggaaggcaacccagggagguucuggaauacgacaauugccgucagcauggcaaacaucuuucggggauccuaccucgcuggcgccggucuucuguucucuauaaugaaaaauaccacuaacacccguagagggacaggaaacaugggcgagacuuugggugagaaguggaaaagcaggcugaaugcgcucggcaaguccgaauuucagaucuauaagaaaucagggauucaggagguggaccgcacccuggccaaggaaggaaucaaacggggcgagacagaucaccaugcagucucucgagggagugcuaaguuaagaugguucguggagaggaacaugguuacgccugaaggaaaagugguagaccuuggcugcggucgcgggggauggucguacuauuguggcggucugaagaaugugcgggaggucaagggccucaccaaagggggacccggccacgaggaaccuauuccaaugagcacuuacggguggaaccuaguuagacugcaguccggaguggaugucuuuuucauacccccugaaaagugcgacacauugcugugugauauaggcgagucuucaccaaaucccaccguggaggccggucguacucucaggguacuuaaccugguggaaaauugguugaacaauaacacacaauucugcauuaaaguucugaauccguacaugccuagcgugaucgagaagauggaagcacuccagcggaaauaugggggagcuuuaguccgcaacccacugucccgaaauaguacccaugagauguacugggugucuaacgccagcggcaauaucgucucauccgugaacaugauuaguagaaugcuuauaaacagguuuacgaugcggcacaagaaggccaccuaugaacccgacguugaccugggcagcgggacacgcaauaucggaauugagucugagaucccuaaccuagauauuaucgguaaaagaauagaaaagaucaaacaggagcaugaaacuuccuggcacuacgaccaggaucacccauauaagaccugggcguaccauggcucauaugagacaaaacaaacugggagcgcuucgucuaugguaaauggaguggucaggcuccugaccaagcccugggacguguugccgacaguuacccagauggcaaugacugauacgacaccuuucggccagcagcgaguguuuaaggaaaaagucgacacccggacucaagagcccaaggaggguaccaaaaagcugaugaaaauuacagccgaauggcucuggaaggagcuugggaaaaagaagacgccacguauguguaccagagaagaguucacucgcaaagugaggaguaacgcugcccugggagcaaucuuuacagaugagaauaaguggaaauccgcccgggaagcuguagaggacagcagauucugggaauuaguggauaaggagcgcaaccugcacuuggaaggcaaaugcgagaccuguguuuacaauaugaugggcaagagggagaagaaacucggggaauuuggaaaggcgaaagguucacgagccauuugguacauguggcugggcgcacgguuccuagaguuugaagcucuuggguuccugaacgaggaccauugguuuuccagagaaaauucucucagcggagucgagggcgagggucugcacaaguugggguauauccugagggaugugaguaaaaaggaaggaggcgccauguacgcagacgacacugccggcugggauacacgcauuacccucgaggaccuuaagaacgaagagauggugacaaaucacauggaaggggagcauaaaaagcuggcugaggccauauucaaauuaacuuaucagaacaaggucguucgugugcagcggccuacccccagaggaacgguaauggauaucauuuccaggcgcgaccaacgagguagcggccagguggggaccuacggacugaauacauuuacuaacauggaagcgcaguugauccggcagauggagggcgaaggugucuucaaaaauauccaacaccucaccgugacagaggagguugcagugcagaacuggcuggccagagucgggagggaacgccuaucuagaauggcuauuucaggagaugacugcgugguaaagccacuugaugaccgguucgccaacgcacugacugcucucaaugauaugggcaagauaaggaaagacauccagcagugggagcccaguaagggcuggaacgauuggacccaaguuccuuuuugcucccaucacuuccaugaacugauuaugaaagacgggcguguguuggucgugccaugucgaaaucaggaugaguuaaucggacgcgccagaauuagccagggugcuggcuggucucugcgggaaacggccugccucgggaagucguaugcacagauguggucacuuauguacuuucacaggcgcgaccugagacuagcggccaacgcuaucuguagcgccgugccgucccacuggguccccacaagucggaccacuuggucuauacaugcaaaacacgaguggaugacaaccgaggacaugcugacuguuuggaauaggguguggauccgagaaaacccuuggauggaggauaagaccccaguagaaagcugggaggaaauucccuaucucggaaagcgugaggaccaauggugcggcuccuugaucggucugacaucaagagcuacgugggccaaaaauauucaggcagccaucaaccaggugcgcagucuuauagggaaugaggaauacaccgauuacaugccuucuaugaagcgguucaggagagaggaagaggaagcgggaguccugugguga

SEQ ID NO: 14827 - RNA, 9876 nt, Artificial Sequence
  derived and/or modified CDS sequence (opt3) from DENV-2__EU482646__SS-prME
agcgcaggcaugaucauuaugcugauccccaccgugauggcuuuccaccucaccacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuuaucugcaagcauagcaugguggaucgaggcugggguaauggguguggacuauucggcaaaggcgggauugucacuugcgcaauguuuaccugcaagaaaaacauggaaggaaagauagugcagccugagaaucucgaauacacaaucguggucaccccacacuccggugaggagcaugccguuggcaacgacacugggaaacacggaaaggaaauuaaagugacgccgcagucaaguaucacagaggcugaacugaccggcuaugguacuguaaccauggaguguagccccagaacagggcuugauuucaaugaaauggugcuguugcaaauggagaacaaggccuggcucguccacaggcagugguuucuggacuuaccucugccauggcuccccggcgcagauaagcaggagucuaauuggauacagaaagaaacccuugugacuuucaagaacccucaugcuaaaaagcaagacguugugguccugggaucccaggagggcgccaugcacacagcguugacgggggccaccgaaauucagaugucaagcggaaaucuacuguuuacuggucaucucaaaugccggcugcguauggacaaacuucaacugaagggcaugaguuacucuauguguacagggaaauucaaggugguaaaagagaucgcagagacccagcacggaacaaucguuauucgcgugcaguaugaaggcgaugguuccccaugcaagauccccuucgagauuauggacuuggagaagagauacguccucgggaggcugauaacugugaacccgaucgucaccgagaaggauagcccugugaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacaaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggcccaggaagagggcauuugugguaucagaucugugacuaggcucgagaaucugauguggaaacagauuacacccgaauuaaaccacauccuggcagagaaugaagucaagcuaaccauaaugacuggcgauaucaaagggauuaugcaagccggaaagcggucgcuccgcccucagccaaccgagcugaaguacagcuggaaaacauggggcaaggcuaaaaugcuuuccacggaaucauauaaccagaccuucuugaucgacgggccggagacugccgagugccccaauacaaacagagcauggaauagucuggaaguugaggauuacggauuuggcguguucaccacaaacauuuggcucaagcugaaagaaaagcaggacgcguuuugugacucuaaguuaaugagcgcugccaucaaagauaauagggcagugcaugccgacauggguuauuggauagaguccgcucugaacgauacuuggaagauugagaaagccucauucaucgaaguaaagaauugccacuggccuaaaagccauacccuuuggucuaacggggucuuggaguccgaaaugaucauuccaaagaaccucgcaggacccgugagucaacacaauuaccguccuggcuaccacacgcagaucgcugguccauggcaucugggcaagcuagagauggacuucgauuuuugugacgggacaaccguuauugugacugaagauugcggaaaccggggccccagccugcgaaccacaacugccucugggaaacucauaaccgaguggugcuguagauccugcacacugccgccucuuagguaucgcggagaggacggcuguugguacgguauggaaauccggccauugaaggagaaagaagagaaucuggucaacucauuagugacggcggggcacggacagguugauaauuucagucucggcgugcuggguauggcccuuuuucuggaagagauguugagaaccaggguaggcacuaagcaugcuauucuccuggucgcagugagcuucgugacacuaaucaccgggaacaugucguuuaaagaccugggacgcgucguugugaugguaggcgccacuauggcugaugacauugggaugggagugacauaucucgcccugcuugcagcguucaagguccgacccaccuuugccgcuggcuugcuguuacggaagcucacguccaaagagcugaugaugacuaccaucgguauagugcuucugucucaaagcacaaucccugaaaccguucuagagcucacugaugcccuggcauuggggaugauggugcugaagauuguccguaauauggaaaaauaccaguuagcugugacaaucauggccauucucugcguucccaacgcagugauccugcagaaugccuggaaggucucauguaccauacuugcuguagugaguguuuccccacuguugcucacaucuagccagcagaagacugacuggauuccucuggcgcuaaccaucaagggacugaaccccacggccaucuuccuuacaacccucuccagaacuaauaaaaagaggucauggccacugaacgaggcaauuauggcugugggcauggucagcauauuggccaguucucuguuaaagaaugacaucccgaugaccggcccucucguggccgggggacugcuuacaguaugcuaugugcugacuggucgcuccgcugauuuggaacucgagcgggcaaccgacgucaaaugggaggaucaggccgaaauuagcggcucgucacccauccugucuauuacgaucagugaggacggguccaugagcauaaagaacgaagaggaggaacagacacuaaccauccugauuagaacuggacuucucguuaucucuggccuguuuccaauuagcauccccauaacagcggcugccugguacuugugggaggugaaaaagcagagggccgguguguuaugggaugucccuuccccacccccuauggggaaagccgaacuggaggacggagcuuaucgaauuaagcaaaagggcauccucggcuacucacagaucggggcaggaguguacaaagaagguaccuuccacacuauguggcauguuacacgcggcgccguacugaugcacaaggggaaacggauugagccgaguugggcggaugugaagaaagaccuuaucagcuauggaggcgguuggaagcuggagggggaauggaaggagggagaagagguccagguguuggcucuagaaccaggcaaaaaucccagagccguucagaccaagccuggccuguuuaaaacgaacacugggaccauaggagcagugucucucgauuucuccccagguacaucaggcagucccauuaucgacaagaaagggaaggucgugggacuguacggcaacgguguagucaccaggagcggggccuauguguccgcuauugcccaaacagagaagucuaucgaggauaauccugaaauagaggacgauauuuuucguaaacgccggcuuacuaucauggacuuacacccgggagcaggcaagaccaaaagauaccugcccgcuaucguuagggaagccauuaagcgaggccuccggacguugauccuggcgccaacacgcguggucgccgcagagauggaagaggcucucagagggcugccuauuagguaucagacucccgccauacgggcugagcauaccggacgagaaaucguggaccuuaugugucacgcaacauucaccaugagacuguugucgccaguucgcgugccuaacuacaaucuaauuaucauggaugaggcccauuucacugaccccgccagcaucgcugcgagggguuauauuucaacccgugucgaaaugggcgaggcagccgggauauuuaugacagcuacgccaccgggaucccgggauccuuucccccagaguaacgccccaaucauugacgaggaaagagagauccccgaaaggucuuggaauagcggccacgagugggugacugauuuuaaagguaagaccguaugguucgugccuuccauuaaggcagggaacgacaucgccgcuugccugcgcaaaaauggaaagaaaguuauacaacucucacgaaagacauuugauucugaauacgucaaaaccagaacuaacgacugggauuucguggugacaaccgacaucagcgagaugggcgcgaauuuuaaggccgagcgggucauugauccaaggcgcuguaugaaacccguaaucuuaacggacggcgaagaacgugugauucuggcagggccuaugccgguuacucauaguuccgcugcccagagacggggaaggaucggucgcaacccaaagaaugaaaacgaccaguacauauauaugggcgagccccuugaaaaugaugaggacugcgcacacuggaaggaggccaaaaugcugcucgauaacauuaauacaccugaagggaucauucccagcauguucgagccagaacgagagaagguggacgcuaucgauggagaauacagauugcggggcgaggccaggaaaaccuuugucgaccugaugcgcagaggugaucucccuguguggcuggcguauaagguugcagccgaggggauaaacuacgcugacaggcggugguguuucgauggcaucaaaaacaaucagauucuugaagagaacguggaagucgagaucuggaccaaggagggagaacguaagaaacuaaagccccgcuggcuggacgcccgaauuuauucugauccauuggcuuuaaaagaguuuaaggaguucgcagccggcagaaaaucacugacucucaaucugaucacagagauggggaggcuuccuaccuucaugacacaaaagacucgggacgcucuggauaaccucgccguguugcacacggcagaagcgggaggucgcgccuacaaucaugcucuguccgagcuaccggagacccuggaaacacuccuucuguuaacuuugcuggccaccguaacaggcgggauauuucucuuccugaugaguggaagaggcauugguaagaugacccuugggaugugcugcaucacuacggcaagcauccugcucugguaugcucagauucagccccacuggaucgccgcaucgauaauuuuggaguuuuuccugaucguguuacuaauuccagaaccugagaaacagaggacaccccaagacaaccagcugacauacguugucaucgccauacucacugugguggcugcgaccauggccaaugaaaugggcuuucuugagaagacuaaaaaggaccugggauugggcucuaucgcaacccagcagccagaguccaacauucuggauaucgaccuccggccugcuagcgccuggacucuguacgccgucgcaacaacguucguuacccccaugcuucgacauucaauugaaaauaguucugugaacguaucccucacugcuaucgccaaucaagcgacagugcugaugggguugggaaaagguuggccgcugagcaagauggauauuggcgucccauuacuagcuaucggguguuauucacaggugaacccuauaacccugaccgccgcacuccuucuguugguugcccacuacgcuauuaucggacccggccugcaggcaaaggccacaagagaggcgcagaaacgcgcugccgcagguaucaugaagaauccaacuguggacgggauuacggucauagaucucgaccccaucccuuaugauccgaaauuugaaaagcaacugggccagguaaugcuuuuaauucugugcgugacccagguucucaugaugaggacaacuugggccuugugugaggcucugacccuagccacaggacccaucaguacccugugggaaggcaacccagggcgguucuggaauacuacgauugcagugagcauggcuaacaucuuucguggauccuaccucgccggcgcgggucuucuguucucuauaaugaaaaauacaaccaacacuagaagggggaccggaaacaugggcgagacauugggugagaaguggaaaagccgccugaaugcccucggcaaguccgaauuucaaaucuauaagcggucagggauucaggaggucgaccgaacucuggcaaaagaaggaaucaagagaggcgagaccgaucaccaugcugugucuagggggagugccaaauuacgcugguucgucgagcggaacauggugacaccugaaggaaagguuguggaccuuggcugcgguagagggggauggucguacuauuguggcggucugaaaaauguacgugaggugaagggccucacgaaagggggacccggccacgaagaaccuauuccaaugagcaccuacggguggaaccuagucaggcugcaguccggaguugauguguuuuucauacccccugaaaaaugcgacacuuugcugugugauauaggcgagucuucaccaaaucccacagucgaggcaggucggacccuccgcgugcuuaaccugguagaaaauugguugaacaauaacacucaguucugcauuaaggugcugaauccguacaugccuagcguuaucgagaaaauggaagcucuccaacgaaaguaugggggagccuuagugagaaacccacuguccaggaauaguacacaugagauguacugggucucuaacgccagcggcaauaucgugucauccgucaacaugauuagucggaugcuuauaaaccgcuuuaccaugagacacaaaaaggcgacguaugaacccgacguggaccugggcagcgggaccaggaauaucggaauugagucugagaucccuaaccuagauauuaucgguaagcgaauagagaaaaucaagcaggagcaugaaacauccuggcacuacgaccaggaucacccauauaaaacuugggcuuaccauggcucauaugagaccaagcagacagggagcgcaucgucuaugguuaauggaguagugcggcuccugacuaaacccugggacgucuugccgaccgugacacaaauggccaugaccgauacuacgccuuucggccagcagcguguuuuuaaggaaaagguggacacaagaacccaggagcccaaagaggguacuaagaaacugaugaagauuaccgcugaauggcucuggaaagagcuugggaagaaaaagacaccacgcauguguacgagggaagaguucacccggaaggucagaaguaacgccgcacugggagccaucuuuacugaugagaauaaauggaaguccgcucgcgaagcgguggaggacagcagguucugggaauuaguagauaaagagcgaaaccugcacuuggaaggcaagugcgagacauguguguacaauaugaugggcaaacgggagaagaagcucggggaauuuggaaaagccaaggguucaagagcaauuugguacauguggcugggcgcuagguuccuagaguuugaagcccuuggguuccugaacgaggaccauugguuuucccgcgaaaauucucucagcggaguugagggcgagggucugcacaaauugggguauauccugcgugaugucaguaagaaagaaggaggcgcaauguacgccgacgacaccgcuggcugggauacucggauuacacucgaggaccuuaagaacgaagagauggugaccaaucacauggaaggggagcauaagaaacuggccgaggcgauauucaaguuaacauaucaaaacaaaguggucagaguucagaggccuacuccccgcggaaccgugauggauaucauuucccgacgggaccagagagguagcggccaaguagggacguacggacugaauaccuuuacaaacauggaagcacaguugaucaggcagauggagggcgaagguguguucaagaauauccagcaccucacugucaccgaggagguggccguucaaaacuggcuggcucgcguggggagagaacggcuaucuaggauggccauuucaggagaugacugcgucgugaaaccacuugaugaccguuucgcaaacgcucugacagcccucaaugauaugggcaagauacgaaaggacauccagcagugggagcccaguaaaggcuggaacgauuggacucagguaccuuuuugcucccaucacuuccaugaacugauuaugaaggacgggcgcguuuugguggucccauguagaaaucaagaugaguuaaucggacgggcuaggauuagccagggugccggcuggucucugcgcgaaaccgcaugccucgggaaaucguaugcgcagauguggucacuuauguacuuucacagacgggaccugaggcuagccgcuaacgccaucuguagcgcagugccgucccacugggugcccacgagucgaacaaccuggucuauacaugcuaagcacgaguggaugacuacagaggacaugcugaccgucuggaaucguguuuggaucagagaaaacccuuggauggaggauaaaacuccaguggaaagcugggaggaaauucccuaucucggaaagcgcgaggaccaguggugcggcuccuugaucggucugaccucacgggccacaugggcaaagaauauucaagccgcgaucaaccagguaaggagucuuauagggaaugaggaauacacggauuacaugccuucuaugaaaagauuccgccgggaggaagaggaagcuggagugcugugguga

SEQ ID NO: 14828 - RNA, 9876 nt, Artificial Sequence
  derived and/or modified CDS sequence (opt3) from DENV-2__EU482647__SS-prME
agcgcaggaaugaucauuaugcugauccccaccgugauggcuuuccaccucacuacucggaacggggaaccucauaugaucgucggcauucaggaaaaggguaaaucccuucuguuuaagacggaggacggaguuaauaugugcaccuugauggcaauggauuuaggggaacugugugaggacacgaucacuuacaaaugcccauuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaaugaagaacaaggccuggcucgugcacaggcagugguuucuggacuuaccucugccauggcuccccggcgcagauaaacaggagucuaauuggauccagaaggagacccuuguuacuuucaaaaacccucaugcuaagaaacaagacguggucgugcugggaucccaggaaggcgccaugcacacagcguugacgggggccaccgagauacagaugucaagcggaaaucuacuguuuacuggucaucucaagugccggcugcguauggacaaacuucaacugaaaggcaugaguuacucuauguguacagggaaguucaaaguaguuaaggaaauugcagagacccagcacggaacaaucgugauccgcguccaguaugagggcgaugguuccccaugcaaaauucccuucgaaaucauggacuuggagaagagauacgugcucgggaggcugauuacugucaacccgauagugaccgaaaaggauagcccuguuaacaucgaggcugaacccccauuuggcgacucguacauuaucaucggaguggagccuggccaguuaaaacugaauugguucaagaaagggucuuccauuggacaaauguuugagacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaagaacugaagugcgggucaggaaucuucauuacggacaacgugcacacauggaccgagcaguauaaauuucaacccgaaaguccaagcaaguuggccuccgcuauccagaaagcccaggaggaaggcauaugugguauuagaucugucacuaggcucgagaaucugauguggaagcagaucacacccgaguuaaaccacauucuggcagaaaaugagguuaaacuaaccaucaugacuggcgauauaaaggggaucaugcaagccggaaagcggucgcuccgcccucagccaaccgaacugaaauacagcuggaagacauggggcaaagcuaagaugcuuuccacggagucauauaaccagaccuucuugauugacgggccggaaacugccgagugccccaauacaaacagagcauggaauagucuggagguggaagauuacggauuuggcguguucaccacaaacaucuggcucaaacugaaggagaagcaggacgcguuuugugacucuaaauuaaugagcgcugccauuaaggauaauagggcaguacaugccgacauggguuauuggaucgaauccgcucugaacgauacuuggaaaauagagaaggccucauucauugaggucaaaaauugccacuggccuaagagccauacccuuuggucuaacgggguguuggaauccgagaugaucaucccaaagaaccucgcaggacccguuagucaacacaauuaccguccuggcuaccacacgcagauugcugguccauggcaucugggcaaacuagaaauggacuucgauuuuugugacgggacaaccgugaucgucacugaggauugcggaaaccggggccccagccugcgaaccacaacugccucugggaagcucauuaccgaauggugcuguagauccugcacacugccgccucuuagguaucgcggagaggacggcuguugguacgguauggagauacggccauugaaagaaaaggaggaaaaucuggugaacucauuaguuacggcggggcacggacagguggauaauuucagucucggcguacuggguauggcccuuuuucuggaggaaauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaggugcgacccaccuuugccgcuggcuugcuguuacggaaacucacguccaaggagcugaugaugacuaccauugguaucguucuucugucucaaagcacaauaccugagaccgugcuagaacucacugaugcccuggcauuggggaugaugguccugaaaaucgugcguaauauggagaaguaccaguuagcuguuacaauuauggccauccucugcgugcccaacgcagucauucugcagaaugccuggaaaguaucauguaccauccuugcugugguuaguguguccccacuguugcucacaucuagccagcaaaagacugacuggauaccucuggcgcuaaccauuaaaggacugaaccccacggccaucuuccuuacaacccucuccagaacuaauaagaagaggucauggccacugaacgaagcaaucauggcugucggcauggugagcauuuuggccaguucucugcuaaagaaugacauaccgaugaccggcccucucguagccgggggacugcuuacagugugcuauguccugacuggucgcuccgcugauuuggagcucgaacgggcaaccgacguuaagugggaggaucaggccgagaucagcggcucgucacccauucugucuaucacgauuagugaagacggguccaugagcaucaaaaacgaggaagaggagcagacacuaaccauacugaucagaacuggacuucucgugauuucuggccuguuuccaaucagcauucccaucacagcggcugccugguacuugugggaagugaagaaacagagggccggugucuuaugggaugugccuuccccacccccuauggggaaggccgagcuggaagacggagcuuaucgaauaaagcaaaaaggcauucucggcuacucacagaucggggcaggaguuuacaaggaggguaccuuccacacuauguggcauguaacacgcggcgccgugcugaugcacaaagggaagcggaucgaaccgaguugggcggaugucaaaaaggaccuuauuagcuauggaggcgguuggaagcuggagggggaguggaaagaaggagaggaagugcagguuuuggcucuagagccaggcaagaaucccagagccgugcagaccaaaccuggccuguuuaagacgaacacugggaccaucggagcagucucucucgauuucuccccagguacaucaggcagucccauaauugacaaaaaggggaaggugguaggacuguacggcaacggugucgugaccaggagcggggccuauguuuccgcuaucgcccaaacagaaaaaucuauugaggauaauccugagaucgaagacgauauauuucguaagcgccggcuuacuauuauggacuuacacccgggagcaggcaaaaccaagagauaccugcccgcuaucgugagggaggccaucaaacgaggccuccggacguugauucuggcgccaacacgcgucguggccgcagaaauggaggaagcucucagagggcugccuaucagguaucagacucccgccauucgggcugagcauaccggacgagagauaguugaccuuaugugucacgcaacauucaccaugagacuguugucgccagugcgcgucccuaacuacaaucuaaucauuauggaugaagcccauuucacugaccccgccagcaucgcugcgagggguuauaucucaacccguguggagaugggcgaagcagccgggauuuuuaugacagcuacgccaccgggaucccgggauccuuucccccagaguaacgccccaauaaucgacgaggagagagaaauucccgagaggucuuggaauagcggccacgaauggguaacugauuuuaaggguaagaccgugugguucguuccuuccaucaaagcagggaacgacauugccgcuugccugcgcaagaauggcaagaaggucauccaacucucacgaaaaacauuugauucugaguacgugaagaccagaacuaacgacugggauuucguggucacaaccgacauaagcgaaaugggcgcgaauuuuaaagccgagcggguaaucgauccaaggcgcuguaugaagcccgugauuuuaacggacggcgaggaacguguuauccuggcagggccuaugccggugacucauaguuccgcugcccagagacggggaaggauuggucgcaacccaaagaaugagaacgaccaguacaucuauaugggcgaaccccuugagaaugaugaagacugcgcacacuggaaagaggccaagaugcugcucgauaacauaaauacaccugaggggauuauccccagcauguucgaaccagagcgagaaaaagucgacgcuauugauggagaguacagauugcggggcgaagccaggaagaccuuuguggaccugaugcgcagaggugaucucccuguuuggcuggcguauaaaguggcagccgaggggaucaacuacgcugacaggcggugguguuucgauggcauaaagaacaaucagauccuugaggaaaacgucgagguggaaauuuggaccaaggagggagagcguaaaaagcuaaaaccccgcuggcuggacgcccgaaucuauucugauccauuggcuuuaaaggaauuuaaagaguucgcagccggcagaaagucacugacucucaaucugauuacagaaauggggaggcuuccuaccuucaugacacaaaagacucgggacgcucuggauaaccucgccguauugcacacggcagaggcgggaggucgcgccuacaaucaugcucuguccgaacuaccggagacccuggagacacuccuucuguuaacuuugcuggccaccgugacaggcgggaucuuucucuuccugaugaguggaagaggcauagguaaaaugacccuugggaugugcugcauuaucacugcaagcauccugcucugguaugcucagauucagccccacuggaucgccgcaucgauaauuuuggaauuuuuccugaucguuuuacuaauuccagagccugaaaagcagaggacgccccaagacaaccagcugaccuacgucgugaucgccauacucacaguggucgcugcgacuauggccaaugagaugggcuuucuugagaagaccaagaaagaccugggauugggcucuaucgcaacacagcagccagaguccaacauucuggauaucgaccuccggccugcuagcgccuggacccuguacgccguugcaacuacauucgugacgcccaugcuucgacauucaauugagaauaguucuguaaacgugucccucaccgcuaucgccaaucaagcgacuguccugaugggguugggaaaggguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaagccaccagagaagcgcagaagcgcgcugccgcagguaucaugaaaaauccaacagucgacgggauuacuguaauagaucucgaccccaucccuuaugauccgaaguuugagaaacaacugggccaggugaugcuuuuaauucugugcguuacacaggugcucaugaugaggaccacaugggccuugugugaagcucugacucuagccaccggacccaucaguacacugugggagggcaacccagggcgguucuggaauaccacuauugcagucagcauggcuaacaucuuucguggauccuaccucgccggcgcgggucuucuguucucuauaaugaagaauacgacaaacaccagaagggggacuggaaacaucggcgaaaccuugggugagaaauggaaaagccgccugaaugcccucggcaaguccgaguuucaaacauauaaaaagucagggauucaggaaguggaccggacucuggcaaaagagggaaucaagcgaggcgaaaccgaucaccaugcugucucuagagggagugccaaauuaaggugguucguggagcgcaacaugguuacaccugagggaaaggugguagaccuuggcugcgguagagggggauggucguacuauuguggcggucugaagaaugugagagaagucaaaggccucacgaaagggggacccggccacgaggaaccuauuccaaugagcaccuacggguggaaccuaguucgucugcaguccggaguggaugucuuuuucauacccccugagaaaugcgacacuuugcugugugauauaggcgaaucuucaccaaaucccacaguggaggcagguaggacccuccggguacuuaaccugguggagaauugguugaacaauaacacucaguucugcauuaagguucugaauccguacaugccuagcgugaucgagaaaauggaggcucuccaacgcaaguaugggggagccuuaguccgaaacccacuguccagaaauaguacacaugaaauguacugggugucuaacgccagcggcaauaucgucucauccgugaacaugauuaguaggaugcuuauaaaccgguuuaccaugcgccacaagaaagcgacguaugagcccgacguugaccugggcagcgggaccagaaauaucggaauugaaucugagaucccuaaccuagauauuaucgguaagaggauagagaaaaucaagcaggaacaugagacauccuggcacuacgaccaggaucacccauauaaaacuugggcuuaccauggcucauaugaaaccaagcagacagggagcgcaucgucuaugguaaauggagugguccgacuccugacuaagcccugggacguguugccgaccguuacacaaauggccaugaccgauacuacgccuuucggccagcagcggguguuuaaagagaaggucgacacacguacccaggaacccaaagaggguacuaagaaacugaugaagauuaccgcugaguggcucuggaaagaacuugggaagaagaaaacaccaagaauguguacgcgcgaggaguucaccaggaaggugcggaguaacgccgcacugggagccaucuuuacugaugagaauaaauggaaguccgcuagagaggcgguagaagacagccgcuucugggaguuaguggauaaagaaaggaaccugcacuuggagggcaagugcgaaacauguguuuacaauaugaugggcaagcgagagaaaaagcucggggaguuuggaaaagccaaggguucacgggcaauuugguacauguggcugggcgcuagauuccuagaauuugaggcccuuggguuccugaacgaagaccauugguuuuccagggaaaauucucucagcggagucgaaggcgagggucugcacaaauugggguauauccugcgcgaugugaguaagaaggagggaggcgcaauguacgccgacgacaccgcuggcugggauacucguauuacacucgaagaccuuaaaaacgaggaaauggugaccaaucacauggagggggaacauaagaaacuggccgaggcgauauucaaguuaacauaucaaaacaaagucguucgggugcagagaccuacucccaggggaaccguaauggauaucauuucccgccgagaccagcgggguagcggccaaguggggacguacggacugaauaccuuuacaaacauggaggcacaguugaucagacagauggaaggcgagggugucuucaagaauauccagcaccucacugugaccgaagagguugccgugcaaaacuggcuggcuagggucgggcgcgagagacuaucucggauggccauuucaggagaugacugcgugguaaagccacuugaugacagguucgcaaacgcucugacagcccucaaugauaugggcaaaauacguaaggacauccagcagugggaacccaguaaaggcuggaacgauuggacucagguuccuuuuugcucccaucacuuccaugagcugauuaugaaggacgggcgaguguuggucgugccaugucgcaaucaagaugaauuaaucgguagagcucggauuagccagggagccggcuggucucugagggagaccgcaugccucgggaaaucguaugcgcagauguggucacuuauguacuuucaccgcagagaccugcggcuagccgcuaacgccaucuguagcgcagugccgucccacuggguccccacgaguaggacaaccuggucuauacaugcuaagcacgaauggaugacuacagaggacaugcugaccguuuggaaucgaguguggauccgugagaacccuuggauggaagauaagacuccaguagagagcugggaagagauucccuaucucggaaaaagagaagaccaguggugcggcuccuugaucggucugaccucacgcgccacaugggcaaagaauauucaagccgcgaucaaccaggugcggagucuuauagggaaugaggaguacacggauuacaugccuucuaugaaaagguucagacgcgaagaggaagaggcuggaguccugugguga

SEQ ID NO: 14829 - RNA, 9876 nt, Artificial Sequence
  derived and/or modified CDS sequence (opt3) from DENV-2__EU482648__SS-prME
accgccggagugaucauuaugcugauacccacagcuauggcauuccaccucacuacgaggaacggggagccucauaugaucgucgggaggcaggaaaaggguaaaagccuucuguuuaagaccgaggacggaguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguggcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugcguugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaagcagccugcaacccuucggaaauauugcaucgaagccaaguugacaaacacuaccacagagagucgcuguccaacucaaggagagcccucccugaaugaagaacaggacaaacgauuuguuugcaagcauucuaugguggauagaggcugggguaacggguguggacuauucggcaagggcgggaucgucacaugcgcuauguuuacaugcaaaaagaauauggaaggaaaaauugugcagccugagaaccucgaauacaccauagugaucacuccacacagcggugaggagcaugccgucggcaaugacacggggaagcacggaaaagaaauuaagaucacaccgcaguccucaauaaccgaggcagaacugacuggcuaugguaccguuacaauggaguguagucccaggaccgggcuugauuucaacgaaauggugcuguugcaaauggaggacaaggcuuggcucguacaccggcagugguuucuggauuuaccucugccauggcuccccggcgccgacacucagggaagcaauuggauucagaaggagacacuugugacguucaagaacccucaugcgaaaaagcaagacgucgugguucugggcucucaggaaggggccaugcacaccgcauugacuggagcuacagagauccagauguccucagguaaucuacuguuuaccggccaucucaaaugccgucugcgcauggauaaacuucaacugaaagggaugagcuacaguauguguacaggaaaguucaagaucgugaaagaaauugccgagacucagcacggcaccaucgucauuagagugcaguaugagggugacgggucuccaugcaagauacccuucgaaaucauggauuuggagaaaaggcauguacucggccggcugauuacgguuaacccgaucgugaccgaaaaggacuccccugucaacaucgaggcugaacccccauuuggagauagcuacauuauaaucggcguggagccugggcaguuaaaacugaauugguucaagaagggaucgucuauuggucaaauguuugagacaacuaugcgaggcgccaaacgcauggcaauccuaggggacaccgccugggauuucggaucccucggcggugucuuuacaucaauugggaaggcucugcaccagguguucggcgcgaucuacggagcagccuuuaguggcguuagcuggacuaugaaaauacuuaucggggcuauuaucaccuggauuggaaugaacuccagaucuacgagcuugucagugagucugguacucgucggcgugaucacacuguaucuuggugccaugguucaggcagacuccggguguguggucagcuggaagaauaaagaacugaagugcggaucuggcauauucauuaccgauaacgugcacacuuggacagagcaguacaaguuucaacccgaaucaccaaguaaauuggccagcgcuauccagaaggcccaugaggaagguauuuguggcaucagguccguaacccggcucgagaaucugauguggaaacagauaacucccgaguuaaaccacauccugucugaaaaugaggugaagcuaaccauuaugacaggggacaucaaaggaauuaugcaggcaggcaagcgcucgcucagaccucaaccaacggaacugaaauauagcuggaagaccugggggaaggcgaaaaugcuuuccacugagucacauaaccagacauucuugaucgauggaccggaaaccgcugagugccccaauacaaacagggccuggaauagucuggagguugaagacuacggcuuuggugucuucacuaccaacauauggcucaagcugcgugagaaacaggacguguuuugugauucuaaguuaaugagcgcagccauuaaagacaaucgggcugugcacgccgauaugggguauuggaucgaauccgcacugaacgacacguggaagauggagaaggcuucauucaucgaggucaaaagcugccacuggccuaagucucauacacuuugguccaauggaguuuuggaaagugagaugauuaucccaaaaucauucgccggccccgugucucagcacaacuaccgaccugguuauuacacccaaacugcgggcccauggcaucucgggaagcuggaaauggauuuugacuucugugagggaaccacagugguagucacugaagauugcggcaacagagggcccucccuaaggaccacaacggccucaggaaaacugauuaccgaguggugcugucgcaguugcacucucccgccucugcgguacagaggcgaggacgguuguugguaugggauggaaauaaggccacuuaaggagaaggaagagaauuuggugaacagccugguuacagcuggacacggccagaucgauaauuuuucguuaggugugcucggcauggcacuguuccuugaagagaugcugcgcacccgagucgggacuaaacaugccauuuugcucguggcuguuuccuuuaugacacugaucaccggaaacaugucuuuccgggaccuaggccgugugaugguaauggucggggccacgaugacugaugacauuggaaugggcgugaccuaccuggcacuccuggcggccuuuaaggugagacccacauucgcugccggucuuuugcugaggaaauuaaccagcaaggagcucaugauggcaacuaucgggauagcucugcuuucacagaguacaaucccugaaaccauucuggagcuaacagaugcccucgcacugggaaugauggucuugaaaaucguucgcaauauggaaaaguaucaacuggccgugacuauuauggcuaucuccugcguacccaacgcggugauauuacagaaugccuggaaggucucuuguaccauucucgcagcugugagcguuuccccacugcuucugacgucaagccagcagaaagccgacuggaucccuuuggcccucacaaucaagggccugaaccccaccgcuauuuuucuaacuacccugagucggacaucuaaaaagagauccuggccacuuaaugaggcaauaauggccgugggcauggucagcauccucgcgucgucacuguugaaaaacgacauuccgaugacugggccucugguggcuggagguuuacucaccguuugcuacgugcugacgggcaggucugccgaucuugaacuggagcgagcaacagacgucaagugggaggaucaagccgaaaucaguggguccagccccauuuugucuaucaccauaagcgaggacggauccaugucaaucaaaaaugaagaggaggaacagacucucacaauucugauccgcaccggccuacugguaauuaguggucuuuucccagugagcauccccauaacugcugcagccugguaucucugggagguuaagaagcagcgggcgggggugcugugggaugucccuucuccacccccugugggaaaagcugaauuggaggacggcgccuacagaauuaagcagaaaggcaucuuaggguauucccaaaucggagcugguguauacaaggaaggcacauuucacaccauguggcacgugacgagaggggcaguccugaugcaucguggaaaacgcauugagccgucaugggcagauguuaagaaggaccucaucaguuacggcgguggguggaaacuggagggagaauggaaggagggcgaagagguacaggugcuugcccuggaaccaggcaaaaacccccgggcaguccagacuaagccuggguuguucaaaaccaauacaggaaccauaggugcugugagccuagauuuuuccccaggcacaucugggucgcccauuguugacagaaagggaaagguagugggccuguaugguaacggggucgugacuaggagcggagccuacguuucagcgaucgcccagaccgagaaauccauugaggauaauccugaaaucgaggacgauauauuccgaaagaaacggcucacgauuauggaccugcacccgggcgcaggcaagacaaaacgcuaucuucccgcuaucgugagagaagccaucaagaggggguuacggacucugauucucgcuccaacccgagucguggcagccgagauggaagaggccuugagaggacugccuauccgcuaccaaacacccgcuauuagggcggagcauaccggucgugaaauaguagaccucaugugucacgcaacuuucaccaugcggcugcuuaguccagucagagugccuaacuauaaccugaucauuauggaugaggcccauuuuacagaccccgcuucuaucgccgcaaggggcuacaucagcacgcgcguugaaaugggggaggccgcuggaauuuucaugacugcgaccccaccgggcucccgagauccuuuuccccagucaaaugccccaauaaucgacgaggaaagagagauucccgaacggucuuggaacagcggucacgagugggugacagauuucaaggggaaaaccgucugguuugugccuaguaucaaggcaggaaaugacauugcugccugcuugaggaaaaacggcaagaaaguuauccagcuaucccgcaagacuuucgauagcgaauaugugaagacacguaccaaugacugggauuuugucgugacgacugacauaucugagaugggcgcaaacuucaaagccgagagaguaaucgauccacggagguguaugaagcccgugauucugacagacggggaagaacgcguuauccucgcuggaccuaugccggucacccacucauccgccgcgcaacgaagaggucggauuggcaggaaucccaaaaacgaaaaugaccaguacaucuacaugggggagcccuuagaaaacgaugaggacugcgcacauuggaaggaggccaaaaugcugcuugauaauauaaacaccccugaaggaauuauccccaguauguuugagccagaacgcgagaagguggacgcuauugauggcgaauauagacugaggggugaggcccggaaaacuuucguggaccucaugcgucgcggggauuugccugucuggcuggcuuaccgaguagcagccgagggcaucaauuaugcugacagaaggugguguuuugauggagugaagaacaaucagauacucgaagagaacguugaaguggagaucuggacaaaggagggcgaacggaaaaagcugaaaccccgcuggcuugacgccagaauuuacagcgauccacuagcacugaaggaguucaaagaguucgcggccgggaggaagucguugaccuuaaaccugaucacagagaugggacggcucccuacuuuuaugacgcagaaggcucgagacgcccuggauaaucuugcaguccugcacaccgcugaagccgguggcagagcauauaaccaugcccucucugaguugccggagacacuggaaacucuacugcuccuuacccuguuagcuacagugaccgggggaauuuucuuguuucugauguccggcaaagguguugggaagaugacucucggcaugugcugcaucauaacggcgagcauucugcuuugguacgcccaaauccagccccacuggaucgcagcuucaauuauccuggaguucuuucucauaguguugcugauuccagaaccugagaaacagcgcaccccacaggacaaucaauuaacauaugucgugaucgccauucuaacuguaguggccgcaaccauggcuaacgaaaugggauuccuggagaagaccaaaaaggaccucggccuugggaguaucgccacccaggagccagaaucuaauauacuggauaucgacuugaggccugcguccgcuuggacucuguacgccguugcaacaacguuugucacccccaugcuccggcacagcauugagaacucaagugugaaugugagccugacugccaucgcuaaccaggcaacaguccuuaugggacucgguaagggcuggccgcuguccaaaauggauauugggguuccauugcuggccaucggauguuacucucaggugaauccuauuaccuuaaccgcggcucuacugcuccuuaucgcccauuaugcaauaauuggccccggucugcaagccaaggcuacacgugaagcccagaaaagagcagcugccgggaucaugaagaacccaacuguagacggcaucacggugauugauuuggaccccauaccuuacgauccgaaauucgagaagcagcugggacaggucaugcuccugauccuuugcgugacccaaguuuuaaugaugaggacaacuugggcgcugugugaagcccucaccuuggcaacaggccccauuagcacccugugggaggggaauccaggacgcuuuuggaacacuacgaucgcuguguccauggccaauauuuuccggggcucauaucuagccggugcugggcugcucuuuucuaucaugaagaacacaaccaauacucgaagaggaaccggcaacauaggugagacacuuggcgaaaaauggaagaguaggcugaaugccuuggggaaaucggaguuccagaucuacaagaaaagcggcauucaggaagucgaccgcacucuggccaaggagggcaucaaaagaggggaaaccgaucaccaugcgguauccagaggaucugcuaagcuccguugguuuguggaaaggaacaugguuacaccugagggcaagguggucgaccuggguugcgggcggggaggcuggucauauuacugugguggccuuaaaaacgugcgcgaagucaaggggcuaacgaaaggaggccccgggcacgaggaaccuauuccaaugagcaccuauggauggaaucuggugcgacuccaauccggcguugauguguucuucacucccccugagaagugcgacacacuacugugugauaucggugagaguucuccaaaccccaccauagaagcagggagaacuuugaggguacugagccucguggagaauuggcuuaacaaugacacacaguuuugcauuaaaguccugaacccguacaugccuucaguuaucgaaaagauggagaccuugcagcggaaguacggaggcgcccuggugcgcaauccacucuccagaaacaguacgcaugaaauguauugggucagcaaugcuaccggcaacaucgugucuuccguaaauaugauuucaaggauguuaauaaaccgauucacaaugaaacacaagaaagccacuuacgagcccgacguggaucuggggagcggaacccggaauaucgguauugagucggaaaucccuaaccuugacauuaucggcaagcguauagagaaaaucaagcaggaacacgagacaucuuggcauuaugaucaagaccacccauacaagacuugggcauaucaugggaguuacgaaaccaaacagacaggauccgccagcucaaugguuaauggcguggucagacugcuaaccaagcccugggauguggucccgauggugacucagauggcuaugacggacacaaccccuuuuggucagcaacgcguuuucaaagagaagguagauacuaggacccaggagcccaaagaagggacaaagaagcucaugaaaauuacggcggaguggcuguggaaggaauugggcaaaaagaaaaccccacggauguguacuagagaggaguuuacacgcaaggugagguccaacgccgcacugggcgcuaucuucaccgacgaaaacaaauggaagucugcccgagaggcagucgaagauagccgguuuugggagcucguggacaaggaaagaaaucuucaccuggagggcaaaugcgagacuuguguuuauaacaugauggggaagagggagaaaaaguuaggagaguucgguaaagccaagggcagucgcgcuauuugguacauguggcugggggccagauuuuuggaguucgaggcgcucggauuucugaaugaagaucacugguucucccgggagaacagccuaucuggcguggagggugaagggcuucauaagcugggauacauccucagagacgucagcaaaaaggagggcggcgcaauguaugccgacgauacagcugggugggacaccaggauuacacuggaagauuugaaaaaugaggaaauggugacuaaccacauggagggagagcauaagcgccuggccgaagcaauauuuaaacucaccuaccagaauaagguagugcgaguucagcggccuacgcccagagguaccgucauggacaucauuaguaggcgcgaucaaagaggcuccggacaggugggaacauauggccuuaacacuuucaccaauauggaggcucagcugauccggcaaauggaaggugaggggaucuucaagagcauucagcacuuaacagugacugaggaaauagccguccagaacuggcuggcuaggguuggacgugagcgauugucucgcauggccaucucgggcgacgauugcgugguaaaaccacucgacgauagauuugcaucagcgcugaccgcccuaaaugacaugggcaaggugcggaaagauauucagcaaugggaacccagcaagggguggaacgacuggacgcaggucccuuucugcucccaucacuuucacgagcuuaucaugaaagauggaagggugcugguugugccaugucgcaaucaggacgaacucauugguagagcucggaucagucagggcgccggguggucucugaaggagacagcaugcuugggaaagagcuacgcucaaaugugguccuuaauguauuuccauaggcgagaccugcgucucgccgcaaacgccauauguucagcggucccgagucacugggugcccaccucuagaacuacauggagcauccaugcuaaacacgaguggaugaccacugaagauaugcuuaccguauggaaucgcguuuggauucaggagaacccuuggauggaagacaagacaccaguggaguccugggaagagguccccuaccugggcaaacgggaggaucaguggugcgguucacuaaucgggcugacgagcagggccaccugggcaaagaacauucagacugccaucaaucaagugagaucucucauaggaaacgaagaguauacagacuacaugccuuccaugaaacgcuuucggagggaagaggaagaggcuggcguguugugguga

SEQ ID NO: 14830 - RNA, 9876 nt, Artificial Sequence
  derived and/or modified CDS sequence (opt3) from DENV-2__EU482649__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuauagcaccaucuaugacaaugcgcugcauugggaucucgaacagagauuuuguugaaggagugucagguggcagcugggucgacauugugcucgagcacgggaguuguguaaccacuauggccaagaauaagcccacauuagauuucgaacugaucaaaaccgaggcuaagcagccugccacgcuuaggaaauauugcaucgaagcgaaguugaccaacacaacuaccgagucccgguguccaacacaaggagagcccucucugaaagaagagcaggacaagcgcuuuguuugcaagcauagcaugguggaucgaggcugggguaauggguguggacuauucggcaaaggcgggauugucacuugcgcaauguuuaccugcaagaaaaacauggaaggaaagauagugcagccugagaaucucgaauacacaaucguggucaccccacacuccggugaggagcaugccguuggcaacgacacugggaaacacggaaaggaaauuaaagugacgccgcagucaaguaucacagaggcugaacugaccggcuaugguacuguaaccauggaguguagccccagaacagggcuugauuucaaugaaauggugcuguugcaaauggagaacaaggccuggcucguccacaggcagugguuucuggacuuaccucugccauggcuccccggcgcagauaagcaggagucuaauuggauacagaaagaaacccuugugacuuucaagaacccucaugcuaaaaagcaagacguugugguccugggaucccaggagggcgccaugcacacagcguugacgggggccaccgaaauucagaugucaagcggaaaucuacuguuuacuggucaucucaaaugccggcugcguauggacaagcuucaacugaagggcaugaguuacucuauguguacagggaaauucaaggugguaaaagagaucgcagagacccagcacggaacaaucguuauucgcgugcaguaugaaggcgaugguuccccaugcaagauccccuucgagauuauggacuuggaaaaaagauacguccucgggaggcugauaacugugaacccgaucgucaccgagaaggauagcccugugaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacuaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggcccaggaagagggcauuugugguaucagaucugugacuaggcucgagaaucugauguggaaacagauuacacccgaauuaaaccacauccuggcagagaaugaagucaagcuaaccauaaugacuggcgauaucaaagggauuaugcaagccggaaagcggucgcuccgcccucagccaaccgagcugaaguacagcuggaaaacauggggcaaggcuaaaaugcuuuccacggaaucauauaaccagaccuucuugaucgacgggccggagacugccgagugccccaauacaaacagagcauggaauagucuggaaguugaggauuacggauuuggcguguucaccacaaacauuuggcucaagcugaaagaaaagcaggacgcguuuugugacucuaaguuaaugagcgcugccaucaaagauaauagggcagugcaugccgacauggguuauuggauagaguccgcucugaacgauacuuggaagauugagaaagccucauucaucgaaguaaagaauugccacuggccuaaaagccauacccuuuggucuaacggggucuuggaguccgaaaugaucauuccaaagaaccucgcaggacccgugagucaacacaauuaccguccuggcuaccacacgcagaucgcugguccauggcaucugggcaagcuagagauggacuucgauuuuugugacgggacaaccguuauugugacugaagauugcggaaaccggggccccagccugcgaaccacaacugccucugggaaacucauaaccgaguggugcuguagauccugcacacugccgccucuuagguaucgcggagaggacggcuguugguacgguauggaaauccggccauugaaggagaaagaagagaaucuggucaacucauuagugacggcggggcacggacagguugauaauuucagucucggcgugcuggguauggcccuuuuucuggaagagauguugagaaccaggguaggcacuaagcaugcuauucuccuggucgcagugagcuucgugacacuaaucaccgggaacaugucguuuaaagaccugggacgcgucguugugaugguaggcgccacuauggcugaugacauugggaugggaguguccuaucucgcccugcuugcagcguucaagguccgacccacauuugccgcuggcuugcuguuacggaagcucaccucuaaagagcugaugaugacgacuaucgguauagugcuucugagccaaucaaccaucccugaaacaguucuagagcucaccgaugcccuggcauuggggaugauggugcugaagauuguccguaauauggaaaaauaccaguuagcugugacuaucauggccauucucugcguucccaacgcagugguccugcagaaugccuggaagguaaguuguacaauccuugcugugguuuccgugucuccacuguugcucaccagcucccagcaaaaaacagacuggauaccucuggcgcuaacuauuaagggacugaaccccaccgccaucuuccuuacgacacucucaagaaccaauaaaaagaggagcuggccacugaacgaggcaaucauggcugucggcauggugaguauuuuggccucuucccuguuaaagaaugacauaccgaugacuggcccucucguagccgggggacugcuuaccgugugcuauguccugacaggucgcagcgcugauuuggaacucgagcgggcaacugacguuaaaugggaggaucaggccgaaaucucgggcucaucucccauucugaguaucaccauuuccgaggacgggagcaugucuaucaagaacgaagaggaggaacagacgcuaacaauacugaucagaaccggacuucucgugauuagcggccuguuuccaaucuccauucccaucacugcggcugccugguacuugugggaggugaaaaagcagagggcaggugucuuaugggaugugccuucaccacccccuauggggaaagccgaacuggaggacggagcuuaucgaauaaagcaaaagggcauucucggcuacagucagaucggggcaggaguuuacaaagaagguacauuccacaccauguggcauguaacucgcggcgccgugcugaugcacaaggggaaacggaucgagccgagcugggcggaugucaagaaagaccuuauuucuuauggaggcgguuggaagcuggagggggaauggaaggagggagaagaggugcagguuuuggcucuagaaccaggcaaaaaucccagagccgugcagacaaagccuggccuguuuaaaaccaacacggggacuaucggagcagucucccucgauuucucaccagguaccaguggcagccccauaauugacaagaaagggaaggugguaggacuguacggcaacggugucgugacaagguccggggccuauguuucugcuaucgcccaaaccgagaagucgauugaggauaauccugaaaucgaggacgauauauuucguaaacgccggcuuacaauuauggacuuacacccgggagcaggcaagacuaaaagauaccugcccgcuaucgugagggaagccaucaagcgaggccuccggaccuugauucuggcgccaacgcgcgucguggccgcagagauggaagaggcucucagagggcugccuaucagguaucagacacccgccauuaaagcugagcauacuggacgggaaauaguugaccuuaugugucacgcaaccuucacaaugcgacuguugagcccagugagagucccuaacuacaaucuaaucauuauggaugaggcccauuucaccgaccccgccucaaucgcugcgcgcgguuauaucuccacuaggguggaaaugggcgaggcagccgggauuuuuaugaccgcuacaccaccgggaagucgugauccuuucccccagucuaacgccccaauaaucgacgaggaacgggagauucccgaaagaagcuggaauuccggccacgaguggguaacggauuuuaaggguaagacugugugguucguuccuucaaucaaagcagggaacgacauugccgcuugccugaggaagaauggaaaaaaggucauccaacucucucgcaaaaccuuugauagcgaauacgugaagacacgaaccaacgacugggauuucguggucacuacagacauaagugagaugggcgcgaauuuuaaagccgagagaguaaucgauccacggagguguaugaagcccgugauuuuaaccgacggcgaagagcgcguuauccuggcagggccuaugccggugacgcauuccagcgcugcccagcguagaggacggauugguaggaacccaaagaaugaaaacgaccaguacaucuauaugggcgagccccuugaaaaugaugaggacugcgcacacuggaaagaggccaagaugcugcucgauaacauaaauacuccugaagggauuauccccucuauguucgagccagaacgcgagaaagucgacgcuauugauggagaauaccgauugagaggcgaggcccggaagacauuuguggaccugaugaggcgcggugaucucccuguuuggcuggcguauaaaguggcagccgaggggaucaacuacgcugacagaaggugguguuucgauggcauaaagaacaaucagauccuugaagagaacgucgaaguggagauuuggaccaaggagggagaacggaaaaagcuaaaaccccguuggcuggacgcccgcaucuauucagauccauuggcuuuaaaggaguuuaaagaauucgcagccggccgaaagucccugacccucaaucugauuacugagauggggagacuuccuacauucaugacccaaaagacaagggacgcucuggauaaccucgccguauugcacacugcagaagcgggaggucgggccuacaaucaugcucugagugagcuaccggagacgcuggaaacccuccuucuguuaacauugcuggccacugugaccggcgggaucuuucucuuccugaugagcggacgcggcauagguaaaaugacacuugggaugugcugcauuaucaccgcaucgauccugcucugguaugcucagauucagccccacuggaucgccgcaucuauaauuuuggaguuuuuccugaucguuuuacuaauuccagaaccugagaagcagagaacuccccaagacaaccagcugacguacgucgugaucgccauacucaccguggucgcugcgacaauggccaaugaaaugggcuuucuugagaaaacuaagaaagaccugggauugggcuccaucgcaacccagcagccagagagcaacauucuggauaucgaccucaggccugcuucagccuggacacuguacgccguugcaaccacuuucgugacacccaugcuucggcauaguauugaaaauucuuccguaaacgugagccucacggcuaucgccaaucaagcgaccguccugaugggguugggaaaggguuggccgcugucaaagauggauauuggcgugccauuacuagcuaucggguguuauagucagguuaacccuauaacucugacagccgcacuccuucuguugguggcccacuacgcuauuaucggacccggccugcaggcaaaagccacccgagaggcgcagaagagagcugccgcagguaucaugaaaaauccaaccgucgacgggauuacaguaauagaucucgaccccaucccuuaugauccgaaguuugaaaaacaacugggccaggugaugcuuuuaauucugugcguuacucaggugcucaugaugcgcacgaccugggccuugugugaggcucugacacuagccacuggacccaucagcacccugugggaaggcaacccagggagguucuggaauacaaccauugcagucuccauggcuaacaucuuucggggaucuuaccucgccggcgcgggucuucuguucagcauaaugaagaauacuacgaacacacguagagggaccggaaacaucggcgagacuuugggugagaaauggaaguccaggcugaaugcccucggcaagucagaauuucaaauuuauaaaaagucugggauccaggagguggaccgcacccuggcaaaagaaggaauuaagcggggcgagacagaucaccaugcugucagucgagggucggccaaauuaagaugguucguggagaggaacaugguuacuccugaaggaaaggugguagaccuuggcugcggucgcgggggauggagcuacuauuguggcggucugaagaaugugcgggaggucaaaggccucaccaaggggggacccggccacgaagagccuaucccaauguccacauacggguggaaccuaguuagacugcagucuggaguggaugucuuuuucauacccccugaaaaaugcgacacguugcugugugauauuggcgagucaagcccaaaucccaccguggaggcaggucguacucucaggguacuuaaccugguggaaaauugguugaacaauaacacacaguucugcaucaagguucugaauccguacaugccuuccgugaucgagaaaauggaagcucuccaacggaaguaugggggagccuuaguccgcaacccacugagucgaaauucuacccaugagauguacugggugagcaacgccucaggcaauauugucuccagugugaacaugauaagcagaaugcuuaucaacagguuuacuaugcggcacaagaaagcgacauaugaacccgacguugaccugggcucugggacccgcaauauuggaaucgaguccgagauuccuaaccuagauaucauagguaagagaaucgaaaaaauuaagcaggagcaugaaacgucauggcacuacgaccaggaucacccauauaaaaccugggcuuaccauggcagcuaugagacaaagcagacugggucggcaucuaguaugguaaauggaguggucaggcuccugaccaagcccugggacguguugccgacaguuacucaaauggccaugaccgauacaaccccuuucggccagcagcgaguguuuaaagaaaaggucgacacucggacgcaggagcccaaagaggguacaaagaaacugaugaagaucaccgcugaauggcucuggaaagagcuugggaagaagaaaacuccacguauguguaccagagaagaguucacacgcaaggugagguccaacgccgcacugggagccauuuuuacggaugagaauaaauggaagagcgcucgggaagcgguagaggacucaagauucugggaauuaguggauaaagagcgcaaccugcacuuggaaggcaagugcgagaccuguguuuacaauaugaugggcaagagggagaaaaagcucggggaauuuggaaaagccaaggguucccgagcaaucugguacauguggcugggcgcucgguuccuagaguuugaagcccuuggguuccugaacgaggaccauugguuuucuagagaaaauagccucaguggagucgagggcgagggucugcacaaauugggguauauucugagggauguguccaagaaggaaggaggcgcaauguacgccgacgacacugcuggcugggauacacgcauaacccucgaggaccuuaaaaacgaagagauggugacuaaucacauggaaggggagcauaagaaacuggccgaggcgaucuucaaguuaacauaucaaaacaaagucguucgugugcagcggccuacccccagaggaacaguaauggauauuaucagcaggcgcgaccagcgagguucuggccaaguggggacuuacggacugaauaccuuuacgaacauggaagcacaguugauccggcagauggagggcgaaggugucuucaagaauauucagaaccucaccgugacagaggagguugccgugcaaaacuggcuggcuagagucgggagggaacgccuaucaagaauggccauaaguggagaugacugcgugguaaagccacuugaugaccgguucgcaaaugcucugacugcccucaacgauaugggcaaaaucaggaaggacauucagcagugggagcccuccaaaggcuggaaugauuggacccagguuccuuuuugcagccaccauuuccacgaacugaucaugaaggacgggcguguguuggucgugccaugucgaaaccaagaugaguuaauuggacgcgcuagaaucucucagggugccggcuggucgcugcgggaaacagcaugccucgggaaaucauaugcgcagauguggagccuuauguacuuucauaggcgcgaccugagacuagccgcuaaugccauauguuccgcagugccgagucacuggguccccacuucucggaccacguggagcauccacgcuaagcaugaguggaugacaaccgaggacaugcugacuguuuggaacaggguguggauucgagaaaauccuuggauggaggauaagacaccaguagaauccugggaggaaauccccuaucucggaaaacgugaggaccaguggugcggcucauugauuggucugaccaguagagccacuugggcaaagaacauccaagccgcgauaaaucaggugcgcucucuuauugggaacgaggaauacaccgauuacaugccuagcaugaaacgguucaggagagaggaagaggaagcuggaguccugugguga

SEQ ID NO: 14831 - RNA, 9876 nt, Artificial Sequence
  derived and/or modified CDS sequence (opt3) from DENV-2__EU482650__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucagagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccaacagaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaagugggaggaucaggccgaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagcggcugccugguacuugugggaggugaagaaacaaagggcaggugucuuaugggaugugccuuccccacccccuauggggaaggccgaacuggaggacggagcuuaucgaauaaaacagaagggcauucucggcuacucacagaucggggcaggaguuuacaaggaagguaccuuccacacuauguggcauguaacacgcggcgccgugcugaugcacaaagggaagcggaucgagccgaguugggcggaugucaaaaaggaccuuauuagcuauggaggcgguuggaaacuggagggggaauggaaggagggagaagaggugcagguuuuggcucuagaaccaggcaagaaucccagagccgugcaaaccaaaccuggccuguuuaagacgaacacugggaccaucggagcagucucucucgauuucuccccagguacaucaggcagucccauaauugacaaaaaggggaaagugguaggacuguacggcaacggugucgugaccaggagcggggccuauguuuccgcuaucgcccagacagagaagucuauugaggauaauccugaaaucgaggacgauauauuucguaagcgccggcuuacuauuauggacuuacacccgggagcaggcaaaaccaagagauaccugcccgcuaucgugagggaagccaucaaacgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccaaaguaacgccccaauaaucgacgaggaaagagagauucccgaaaggucuuggaauagcggccacgaguggguaacugauuuuaaggguaaaaccgugugguucguuccuuccaucaaggcagggaacgacauugccgcuugccugcgcaagaauggaaaaaaggucauccagcucucacgaaaaacauuugauucugaauacgugaagaccagaacuaacgacugggauuucguggucacaaccgacauaagcgagaugggcgcgaauuuuaaagccgagcggguaaucgauccaaggcgcuguaugaagcccgugauuuuaacggacggcgaagagcguguuauccuggcagggccuaugccggugacucauaguuccgcugcccagagacggggaaggauuggucgcaacccaaaaaaugaaaacgaccaguacaucuauaugggcgagccccuugaaaaugaugaggacugcgcacacuggaaggaggccaagaugcugcucgauaacauaaauacaccugaagggauuauccccagcauguucgagccagaacgagagaaagucgacgcuauugauggagaauacagauugcggggcgaggccaggaagaccuuuguggaccugaugcgcagaggugaucucccuguuuggcuggcguauaaaguggcagccgaggggaucaacuacgcugacaggcggugguguuucgauggcauaaagaacaaucaaauccuugaagagaacgucgaaguggagauuuggaccaaagagggagaacguaagaagcuaaaaccccgcuggcuggacgcccgaaucuauucugauccauuggcuuuaaaggaguuuaaagaauucgcagccggcagaaagucacugacucucaaucugauuacagagauggggaggcuuccuaccuucaugacacagaaaacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaagcaaaggacgccccaggacaaccagcugaccuacgucgugaucgccauacucacaguggucgcugcgacuauggccaaugaaaugggcuuucuugagaaaaccaagaaagaccugggauugggcucuaucgcaacacagcaaccagaguccaacauucuggauaucgaccuccggccugcuagcgccuggacccuguacgccguugcaacuacauucgugacgcccaugcuucgacauucaauugaaaauaguucuguaaacgugucccucaccgcuaucgccaaucaggcgacuguccugaugggguugggaaaggguuggccgcugagcaaaauggauauuggcgugccauuacuagcuaucggguguuauucacagguuaacccuauaacacugaccgccgcacuccuucuguugguggcccacuacgcuauuaucggacccggccugcaggcaaaggccaccagagaggcgcaaaagcgcgcugccgcagguaucaugaaaaauccaacagucgacgggauuacuguaauagaucucgaccccaucccuuaugauccgaaguuugaaaaacagcugggccaggugaugcuuuuaauucugugcguuacgcaagugcucaugaugaggaccacaugggccuugugugaggcucugacucuagccaccggacccaucaguacacugugggaaggcaacccagggaaguucuggaauaccacuauugcagucagcauggcuaacaucuuucggggauccuaccucgccggcgcgggucuucuguucucuauaaugaaaaauacgacaaacacccguagagggacuggaaacaugggcgagaccuugggugagaaguggaaaagcaggcugaauacacucggcaaguccgaauuucagaucuauaagaaaucagggauucaggagguggaccgcacucuggccaaggaaggaaucaaacggggcgagaccgaucaccaugcagucucucgagggagugcuaaguuaagaugguucguggagaggaacaugguuacaccugaaggaaaagugguagaccuuggcugcggucgcgggggauggucguacuauuguggcggucugaagaaugugcgggaggucaagggccucacgaaagggggacccggccacgaagagccuauuccaaugagcaccuacggguggaaccuaguuagacugcaguccggaguggaugucuuuuucauccccccugaaaagugcgacacuuugcugugugauauaggcgagucuucaccaaaucccacaguggaggccggucguacccucaggguacuuaaccugguggaaaauugguugaacaauaacacucaauucugcauuaaaguucugaauccguacaugccuagcgugaucgagaagauggaagcacuccagcggaaauaugggggagcuuuaguccgcaacccacugucccgaaauaguacacaugagauguacugggugucuaacgccagcggcaauaucgucucauccgugaacaugauuaguagaaugcuuauaaacagguuuaccaugcggcacaagaaggccacguaugaacccgacguugaccugggcagcgggacccgcaauaucggaauugagucugagaucccuaaccuagauauuaucgguaaaagaauagaaaagaucaaacaggagcaugaaacauccuggcacuacgaccaggaucacccauauaagacuugggcguaccauggcucauaugagaccaaacaaacagggagcgcuucgucuaugguaaauggaguggucaggcuccugacuaagcccugggacguguugccgaccguuacacagauggcaaugaccgauacuacgccuuucggccagcagcgaguguuuaaggaaaaagucgacacacggacccaagagcccaaggaggguacuaaaaagcugaugaaaauuaccgccgaauggcucuggaaggagcuugggaaaaagaagacaccacguauguguacgagagaagaguucacccgcaaagugaggaguaacgcugcccugggagcaaucuuuacugaugagaauaaguggaaauccgcccgggaagcuguagaggacagcagauucugggaauuaguggauaaggagcgcaaccugcacuuggaaggcaaaugcgagacauguguuuacaauaugaugggcaagagggagaagaaacucggggaauuuggaaaggcgaaagguucacgagccauuugguacauguggcugggcgcacgguuccuagaguuugaagcucuuggguuccugaacgaggaccauugguuuuccagagaaaauucucucagcggagucgagggcgagggucugcacaaguugggguauauccugagggaugugaguaaaaaggaaggaggcgccauguacgcagacgacaccgccggcugggauacucgcauuacacucgaggaccuuaagaacgaagagauggugaccaaucacauggaaggggagcauaaaaagcuggcugaggccauauucaaauuaacauaucagaacaaggucguucgugugcagcggccuacucccagaggaaccguaauggauaucauuuccaggcgcgaccaacgagguagcggccagguggggacguacggacugaauaccuuuacaaacauggaagcgcaguugauccggcagauggagggcgaaggugucuucaaaaauauccaacaccucacugugaccgaggagguugcagugcagaacuggcuggccagagucgggagggaacgccuaucuagaauggcuauuucaggagaugacugcgugguaaagccacuugaugaccgguucgccaacgcacugacagcucucaaugauaugggcaagauaaggaaagacauccagcagugggagcccaguaagggcuggaacgauuggacucaaguuccuuuuugcucccaucacuuccaugaacugauuaugaaagacgggcguguguuggucgugccaugucgaaaucaggaugaguuaaucggacgcgccagaauuagccagggugcuggcuggucucugcgggaaaccgccugccucgggaagucguaugcacagauguggucacuuauguacuuucacaggcgcgaccugagacuagcggccaacgcuaucuguagcgccgugccgucccacuggguccccacgagucggacaaccuggucuauacaugcaaaacacgaguggaugacuacagaggacaugcugaccguuuggaauaggguguggauccgagaaaacccuuggauggaggauaagacuccaguagaaagcugggaggaaauucccuaucucggaaagcgugaggaccaauggugcggcuccuugaucggucugaccucaagagcuacaugggccaaaaauauucaggcagccaucaaccaggugcgcagucuuauagggaaugaggaauacacggauuacaugccuucuaugaagcgguucaggagagaggaagaggaagcgggaguccugugguga

SEQ ID NO: 14832 - RNA, 9876 nt, Artificial Sequence
  derived and/or modified CDS sequence (opt3) from DENV-2__EU482651__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaagcuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggaaaaaagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacuaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaggcugaaggaaaaacaggacgcguuuugugacucuaaguuaaugagcgcugccauuaaggauaaucgugcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucaacacaauuaccggccuggcuaccacacgcagauuacagguccauggcaucugggcaagcuagagauggacuucgauuuuugugacgggaccacugugaucgucaccgaagauugcggaaaccgaggccccagccugagaacaacuaccgcuucugggaagcucauuacagaguggugcuguagguccugcacgcugccgccucuucgcuaucggggagaggacggcuguugguacgguauggaaauaagaccauugaaagagaaggaagagaaucuggugaacucauuaguuaccgccgggcacggacagguggauaauuucagucucggcguacuggguauggcgcuuuuucuggaagagauguugaggacucgcgucggcacaaaacaugccauccuccuggugaccgugagcuucgucacucuaauuacagggaacaugucguuuaaggaccugggacgaguugugguaauggugggcgcuaccauggcagaugacaucgggaugggagucacguaucucgcccugcuugcugccuucaaagugcggcccacuuuugcagcgggcuugcuguuacguaagcucaccuccaaggagcugaugaugacaaccauugguaucguucuucugucucaaagcacuauaccugaaacagugcuagagcucaccgaugcccuggcuuuggggaugaugguccugaaaaucgugagaaauauggaaaaguaccaguuagccguuacaauuauggcaauccucugcgugcccaacgcugucguacugcagaaugccuggaaagugucauguacuauucuugcaguugugagugucuccccacuguugcucaccucuagccagcaaaagacggacuggaucccucuggcccuaacaauaaaaggacugaaccccaccgcuauuuuccuuacuacccucuccaggacaaauaagaaacgcucauggccacugaacgaggcgaucauggccgugggcaugguaagcaucuuggcaaguucucuguuaaagaaugacauuccgaugacuggcccucucguggcugggggacugcuuaccgucugcuauguucugacgggucgguccgccgauuuggaacucgagagagccacagacgugaagugggaggaucaggcugaaauaagcggcucgucacccauccugucuauuaccaucagugaggacggguccaugagcauuaaaaacgaagaggaggaacagacucuaacaauccugauaaggaccggacuucucgugaucucuggccuguuuccaauuagcauccccauuacugcagccgcgugguacuugugggaggucaagaaacagcgagcugguguguuaugggauguuccuuccccacccccuauggggaaggccgaacuggaggacggagcauaucgcaucaaacaaaagggcauacucggcuacucacagauuggggccggaguauacaaggaagguacauuccacaccauguggcaugugacgcggggcgcuguccugaugcacaaagggaagagaaucgagccgaguugggcagaugugaaaaaggaccuuaucagcuauggaggcgguuggaaacuggagggggaauggaaggagggagaagagguucagguguuggcccuagaaccaggcaagaaucccagggcgguccagacuaaaccuggccuguuuaagaccaacacagggaccauuggagcugugucucucgauuucuccccagguacaucaggcagucccaucauagacaaaaaggggaaaguagucggacuguacggcaacggugugguuacucguagcggggccuauguguccgcaauugcccaaaccgagaagucuaucgaggauaauccugaaauugaggacgauaucuuucgcaagcggagacuuacgauaauggacuuacacccgggagcuggcaaaacaaagagguaccugcccgccauuguccgagaagcaaucaaacggggccuccgcacuuugauccuggcuccaaccagagugguugccgcggagauggaagaggcccucagggggcugccuauucgguaucagacacccgcaaucaaggcugagcauaccggacgagaaauuguggaccuuaugugucacgccacuuucaccaugagacuguugucgccaguccgcgugccuaacuacaaucuaauaaucauggaugaggcucauuucacagaccccgcaagcauugccgccagggguuauaucucaacgcguguagaaaugggcgaggcugcggggaucuuuaugacugcaaccccaccgggaucccgggauccuuucccccagaguaacgccccaauuauagacgaggaaagagagauccccgaaaggucuuggaauagcggccacgagugggugacagauuuuaaagguaagaccguuugguucgucccuuccauuaaggcugggaacgacaucgccgcaugccugcgcaaaaauggaaagaaagugauucaacucucacgaaagacuuuugauucugaauacgugaaaacaagaaccaacgacugggauuucgucguaacgacugacaucagcgagaugggcgccaauuuuaaggcugagcgggugauagauccaaggcgcuguaugaaacccguuaucuuaacagacggcgaagagcgugugauucuggcggggccuaugccggucacccauaguuccgccgcacagagacggggaaggaucggucgcaacccaaagaaugaaaacgaccaguacauuuauaugggcgagccccuugaaaaugaugaggacugcgcucacuggaaggaggccaaaaugcugcucgauaacaucaauaccccugaagggauaauucccagcauguucgagccagaacgagagaagguggacgcaaucgauggagaauacagauugcggggcgaggccaggaaaacuuuuguugaccugaugcgcagaggugaucucccuguguggcuggcuuauaaggucgccgcggaggggauuaacuacgcagacaggcggugguguuucgauggcaucaaaaacaaucagauacuugaagagaacguggaaguagagaucuggacaaaggagggagaacguaagaaacuaaagccccgcuggcuggacgcccgaauuuauucugauccauuggcuuuaaaagaguuuaaggaauucgccgcuggcagaaaaucacugacccucaaucugaucacagagauggggaggcuuccuacuuucaugacgcaaaagacccgggacgcacuggauaaccucgccguguugcacacagcugaagccggaggucgcgcauacaaucaugcgcuguccgagcuaccggagacucuggaaacccuccuucuguuaacauugcuggccaccguuacuggcgggauuuuucucuuccugaugaguggaagaggcaucgguaagaugacgcuugggaugugcugcauaauuaccgcuagcauccugcucugguaugcccagauccagccccacuggauugcagcuucgaucauauuggaguuuuuccugauugucuuacuaaucccagaaccugagaaacagaggacaccccaagacaaccagcugacuuacguggugauugccauccucaccgucguugcagccacaauggcuaaugaaaugggcuuucuugagaagaccaaaaaggaccugggauugggcucuauagcgacucagcagccagaguccaacauccuggauauugaccuccggccugccagcgcauggacacuguacgcuguggccacgaccuucguaacucccaugcuucgacauucaaucgaaaauaguucugugaacgucucccucacagccauugcaaaucaagcuaccgugcugaugggguugggaaaagguuggccgcugagcaagauggauaucggcguuccauuacuagccauuggguguuauucacaggugaacccuaucacccugacagcggcucuccuucuguuggucgcccacuacgcaauaauuggacccggccugcaggccaaggcuacuagagaggcacagaaacgcgccgcggcugguaucaugaagaauccaacgguagacgggaucaccgugauugaucucgaccccauaccuuaugauccgaaauuugaaaagcaacugggccagguuaugcuuuuaauccugugcgugacacagguccucaugaugaggacuaccugggccuugugugaggcacugacacuagccaccggacccauuaguacucugugggaaggcaacccagggcgguucuggaauacgacaaucgcugugagcauggccaacauuuuucguggauccuaccucgcaggcgcuggucuucuguucucuaucaugaaaaauaccacuaacaccagaagggggacaggaaacauaggcgagacuuugggugagaaguggaaaagccgccugaaugcccucggcaaguccgaauuucaaaucuauaagaaaucagggauucaggaggucgaccggacccuggcgaaggaaggaaucaaacgaggcgagacagaucaccaugccgugucuagagggagugcaaaguuaaggugguucguugagcgcaacauggugacgccugaaggaaaaguaguggaccuuggcugcggucgggggggauggucguacuauuguggcggucugaagaaugucagagagguuaagggccucaccaaagggggacccggccacgaagagccuauuccaaugagcacuuacggguggaaccuagugcgucugcaguccggagucgauguguuuuucauccccccugaaaagugcgacacauugcugugugauauaggcgagucuucaccaaaucccaccguagaggcugguaggacucuccgggugcuuaaccugguugaaaauugguugaacaauaacacacaguucugcauuaaagugcugaauccguacaugccuagcgucaucgagaagauggaagcccuccaacgcaaauaugggggagcauuagugcgaaacccacuguccagaaauaguacccaugagauguacugggucucuaacgcuagcggcaauaucgugucauccguuaacaugauuaguaggaugcuuauaaaccgguuuacgaugcgccacaagaaggccaccuaugaacccgacguagaccugggcagcgggacaagaaauaucggaauugagucugagaucccuaaccuagauauuaucgguaaaaggauagaaaagaucaaacaggagcaugaaacuuccuggcacuacgaccaggaucacccauauaagaccugggccuaccauggcucauaugagacaaaacagacugggagcgcgucgucuauggugaauggagucgugcgacuccugaccaagcccugggacguuuugccgacagugacccaaauggcuaugacugauacgacaccuuucggccagcagcgggucuuuaaggaaaaaguggacacccguacucaggagcccaaggaggguaccaaaaagcugaugaaaauuacagcagaauggcucuggaaggagcuugggaaaaagaagacgccaagaauguguacccgcgaagaguucacuaggaaaguacggaguaacgccgcucugggagccaucuuuacagaugagaauaaguggaaauccgcaagagaagccguggaggacagccgcuucugggaauuaguugauaaggagaggaaccugcacuuggaaggcaaaugcgagaccugugucuacaauaugaugggcaagcgagagaagaaacucggggaauuuggaaaggcuaaagguucacgggcgauuugguacauguggcugggcgccagauuccuagaguuugaagcacuuggguuccugaacgaggaccauugguuuuccagggaaaauucucucagcggaguggagggcgagggucugcacaaguugggguauauccugcgcgaugugaguaaaaaggaaggaggcgcuauguacgccgacgacacugcaggcugggauacacguauuacccucgaggaccuuaagaacgaagagauggucacaaaucacauggaaggggagcauaaaaagcuggccgaggcuauauucaaauuaacuuaucaaaacaagguugugcggguacagagaccuacccccaggggaacggugauggauaucauuucccgccgagaccagcgggguagcggccaagucgggaccuacggacugaauacauuuacuaacauggaagcccaguugaucagacagauggagggcgaagguguguucaaaaauauccagcaccucaccguuacagaggagguggcgguccaaaacuggcuggcaaggguggggcgcgaaagacuaucucggauggccauuucaggagaugacugcguaguuaagccacuugaugacagguucgcuaacgcccugacugcacucaaugauaugggcaagauacguaaagacauccagcagugggagcccaguaagggcuggaacgauuggacccaggugccuuuuugcucccaucacuuccaugaacugauuaugaaagacgggcgagucuugguggugccaugucgcaaucaagaugaguuaaucggaagagcucggauuagccagggugccggcuggucucugagggaaacggcuugccucgggaagucguaugcccagauguggucacuuauguacuuucaccgcagagaccugcggcuagcagcgaacgccaucuguagcgcugucccgucccacuggguucccacaaguaggaccacuuggucuauacaugccaaacacgaguggaugacaaccgaggacaugcugacuguguggaaucgaguauggauccgugaaaacccuuggauggaggauaagaccccaguggaaagcugggaggaaauucccuaucucggaaagagagaggaccaguggugcggcuccuugaucggucugacaucacgcgcaacgugggcuaaaaauauucaagccgcaaucaaccagguccggagucuuauagggaaugaggaauacaccgauuacaugccuucuaugaagagguucagacgcgaggaagaggaagccggagugcugugguga

SEQ ID NO: 14833 - RNA, 9876 nt, Artificial Sequence
  derived and/or modified CDS sequence (opt3) from DENV-2__EU482652__SS-prME
agcgcaggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuuuguguacagggaaguucaaaguaguuaaggagauugcagagacccagcacggaacaaucgugauccgcguccaguaugaaggcgaugguuccccaugcaaaauucccuucgagaucauggaccucgaaaagagauacgugcuggggagguuaauuacugucaacccgauagugaccgagaaagauagcccuguuaacaucgaagcugagcccccauuuggcgacucguacauuaucaucggaguggagccuggccaacugaagcuaaauugguucaagaaagggucuuccauuggacagauguuugaaacgaccaugcggggugccaagcgaauggcuauacucggcgauacagccugggacuucgggucacugggaggcguauuuacaaguaucgguaaagcacuucaucaggucuucggggccauuuauggcgcugcguuuagcggaguguccuggaccaugaagaucuugauuggcguuaucauaacauggaucgggaugaacucucgcagcacuucacugagugugucccucguccuggugggaauuguaacccuuuaccugggcgugaugguucaggcagauagcgguugugucgugucuuggaaaaauaaggaguugaagugcgggucaggaaucuucauuacggacaacgugcacacauggaccgaacaauauaaauuucagcccgagaguccaagcaagcucgccuccgcuauccagaaagcccaggaagagggcauaugugguauuagaucugucacuaggcuggagaauuuaauguggaagcaaaucacacccgaacugaaccacauucuagcagagaaugaaguuaaacucaccaucaugacuggcgauauaaaggggaucaugcaggccggaaaacggucgcugcgcccucagccaaccgagcuuaaguacagcuggaagacauggggcaaagcuaagauguuguccacggaaucauauaaccagaccuuccugauugacgggccggagacugccgagugccccaauacaaacagagcauggaauagucucgaaguggaggauuacggauuuggcguguucaccacaaacaucuggcugaaauuaaaggaaaaacaagacgcguuuugugacucuaagcugaugagcgcugccauuaaggauaauagggcaguacaugccgacauggguuauuggaucgaguccgcucuuaacgauacuuggaaaauagagaaggccucauucauugaagucaaaaauugccacuggccuaagagccauaccuuguggucuaacggggugcucgaguccgaaaugaucauccccaagaaccuggcaggacccguuagucagcacaauuaccguccuggcuaccacacgcagauugcugguccauggcaucuaggcaagcuggagauggacuucgauuuuugugacgggacaaccgugaucgucacugaagauugcggaaaccggggccccagccuccgaaccacaacugccucugggaagcugauuaccgaguggugcuguagauccugcacacuuccgccuuugagguaucgcggagaggacggcuguugguacgguauggaaauacggccacugaaagagaaggaagagaauuuagugaacucacucguuacggcggggcacggacaaguggauaauuucagucugggcguacuugguauggcccuguuuuuggaagagaugcucagaaccagggucggcacuaaacaugcuauccugcuaguggcagugagcuucgucacacugauuaccgggaacaugucguuuaaggaccucggacgcguugugguaauggugggcgccacuaugacagaugacaucgggaugggagucaccuaucuggcucuuuuggccgcauucaaagugcgacccacguuugcggccggccuguuacuccggaagcugacuuccaaggagcuuaugaugaccacaauugguaucguucugcuaucucagagcgcuauaccugaaaccgugcucgagcugacugaugccuuggcacuggggaugauggucuuaaaaaucgugcguaauauggaaaaguaccagcucgcuguuacaauuauggccauccugugcgugcccaacgcagucauucuucagaaugccuggaaaguaucauguaccauccuggcugugguuaguguguccccauugcuccugacaucuagccaacagaagacugacuggauaccucuagcgcugaccauuaaaggacuuaaccccacggccaucuuccucacaacccuguccagaacuaauaagaaaaggucauggccauugaacgaggcaaucauggcugucggcauggugagcauucuggccaguucuuuacucaagaaugacauaccgaugaccggcccucugguagccgggggacuucugacagugugcuaugucuugacuggucgcuccgcugaucucgaacuggagcgggcaaccgacguuaagugggaggaucaggccgaaaucagcggcucgucacccauucuaucuaucacgauuagugaggacggguccaugagcaucaaaaacgaagaggaggaacagacacugaccauacuuaucagaacuggacuccuggugauuucuggcuuguuuccaaucagcauucccaucacagcggcugccugguacuuaugggaggugaagaaacaaagggccgguguccugugggaugugccuuccccacccccuauggggaaggccgaacucgaggacggagcuuaucgaauaaaacagaagggcauucugggcuacucacagaucggggcaggaguuuacaaggaagguaccuuccacacuauguggcauguaacacgcggcgccgugcuuaugcacaaagggaagcggaucgagccgaguugggcggaugucaaaaaggaccugauuagcuauggaggcgguuggaaauuggagggggaauggaaggagggagaagaggugcagguucuagcucuggaaccaggcaagaaucccagagccgugcaaaccaaaccuggccucuuuaagacgaacacugggaccaucggagcagucucucuggauuucuccccagguacaucaggcagucccauaauugacaaaaaggggaaagugguaggacuuuacggcaacggugucgugaccaggagcggggccuauguuuccgcuaucgcccagacagagaagucuauugaggauaauccugaaaucgaggacgauauauuucguaagcgccgguuaacuauuauggaccugcacccgggagcaggcaaaaccaagagauaccuccccgcuaucgugagggaagccaucaaacgaggcuugcggacgcugauucucgcgccaacacgcgucguggccgcagagauggaagaggcucugagagggcuuccuaucagguaucagacucccgccauucgggcugagcauaccggacgagaaauaguugaccugaugugucacgcaacauucaccaugagauugcuaucgccagugcgcgucccuaacuacaaucugaucauuauggaugaggcccauuucacugaccccgccagcaucgcugcgagggguuauaucucaacccguguggaaaugggcgaggcagccgggauuuuuaugacagcuacgccaccgggaucccgggauccuuucccccaaaguaacgccccaauaaucgacgaggaaagagagauucccgaaaggucuuggaauagcggccacgaguggguaacugauuuuaaggguaaaaccgugugguucguuccuuccaucaaggcagggaacgacauugccgcuugccuccgcaagaauggcaagaaggucauccaguuaucacgaaaaacauuugauucugaauacgugaagaccagaacuaacgacugggauuucguggucacaaccgacauaagcgagaugggcgcgaauuuuaaagccgagcggguaaucgauccaaggcgcuguaugaagcccgugauucugacggacggcgaagaacguguuauccuugcagggccuaugccggugacucauaguuccgcugcccagagacggggaaggauuggucgcaaccccaaaaaugaaaacgaccaguacaucuauaugggcgagccccuggaaaaugaugaggacugcgcacacuggaaggaggccaagaugcucuuggauaacauaaauacaccugaagggauuauccccagcauguucgagccagaacgagagaaagucgacgcuauugauggagaauacagacugcggggcgaggccaggaagaccuuuguggaccucaugcgcagaggugaucugccuguuuggcuugcguauaaaguggcagccgaggggaucaacuacgcugacaggcggugguguuucgauggcauaaagaacaaucaaauccuagaagagaacgucgaaguggagauuuggaccaaagagggagaacguaagaagcugaaaccccgcugguuggacgcccgaaucuauucugauccauuagcucugaaggaguuuaaagaguucgcagccggcagaaagucacucacucugaaucuuauuacagagauggggaggcugccuaccuucaugacacagaaaacucgggacgcucucgauaacuuggccguacugcacacggcagaagcgggaggucgcgccuacaaucaugcucuauccgagcugccggagacccucgaaacacuucuguuauugacucugcucgccaccgugacaggcgggaucuuucuguuccuuaugaguggaagaggcauagguaagaugacccuggggaugugcugcauuaucacugcaagcacgcucuugugguaugcucagauccagccccacuggauugccgcaucgaucauacuggaguuuuucuuaauuguucuacugaucccagaaccugagaagcaaaggaccccacaggacaaccagcucacauacgucgugauugccauccuuacuguggucgcugcgaccauggccaaugaaaugggcuuucuggagaaaacaaagaaagacuugggacugggcucuauagcaacccagcaaccagaguccaacauccucgauauugaccugcggccugcuagcgccuggacucuuuacgccguugcaacaacguucgugacccccaugcuccgacauucaaucgaaaauaguucuguaaacgugucccugacugcuauugccaaucaggcgacagucuugauggggcugggaaaggguuggccguuaagcaaaauggauaucggcgugccacuacuggcuauuggguguuauucacagguuaacccuaucacccucaccgccgcacuucuguugcugguggcccacuacgcuauaauuggacccggccuccaggcaaaggccacaagagaggcgcaaaagcgcgcugccgcagguaucaugaaaaauccaacugucgacgggaucacgguaauugaucuggaccccauaccuuaugauccgaaguuugaaaaacagcuuggccaggugauguuacugauccucugcguuacccaaguguugaugaugaggacaacuugggcccugugugaggcucuaacccuggccacaggacccauuaguacccucugggaaggcaacccagggcgguucuggaauacuacgaucgcagucagcauggcuaacauuuuucguggauccuaccuugccggcgcgggucuguuguucucuaucaugaagaauacaaccaacacuagaagggggaccggaaacaugggcgagacacugggugagaaauggaaaagccgccucaaugcccugggcaaauccgaauuucagauauauaagaagucagggauccaggagguggaccggacuuuagcaaaagaaggaauuaagcgaggcgagaccgaucaccaugcugucucuagagggagugccaaacuuaggugguucguggagcgcaacaugguuacaccugaaggaaaggugguagaccugggcugcgguagagggggauggucguacuauuguggcggucucaaaaaugugagagaggucaagggccuaacgaaagggggacccggccacgaagaaccuaucccaaugagcaccuacggguggaaccugguucguuugcaguccggaguggaugucuuuuucauucccccugaaaaaugcgacacucugcucugugauaucggcgagucuucaccaaaucccacaguggaggcagguaggacccuucggguacugaacuugguggaaaauuggcugaacaauaacacucaauucugcauaaagguucucaauccguacaugccuagcgugauugagaaaauggaggcuuuacagcgcaaguaugggggagcccugguccgaaacccacuuuccagaaauaguacacaugagauguacugggugucuaacgccagcggcaauaucgucucauccgugaacaugaucaguaggaugcugauuaaccgguuuaccaugcgccacaaaaaggcgacguaugaacccgacguugaccuaggcagcgggaccagaaauauaggaaucgagucugagauuccuaaccucgauaucauugguaagaggaucgagaaaauaaagcaggagcaugaaacauccuggcacuacgaccaggaucacccauauaaaacuugggcuuaccauggcucauaugagaccaagcaaacagggagcgcaucgucuaugguaaauggagugguccgacuguugacuaaacccugggacgugcugccgaccguuacacagauggccaugaccgauacuacgccuuucggccagcagcggguguuuaaggaaaaggucgacacacguacccaagagcccaaagaggguacuaagaaacucaugaagaucaccgcugaauggcuuuggaaagagcuggggaagaaaaagacaccaagaauguguacgcgcgaagaguucaccaggaaggugcggaguaacgccgcauuaggagccauuuuuacugaugagaauaaauggaaguccgcuagagaagcgguagaggacagccgcuucugggaacugguggauaaagagaggaacuugcaccucgaaggcaagugcgagacauguguuuacaauaugaugggcaaacgagagaagaagcugggggaauuuggaaaagccaaggguucacgggcaaucugguacauguggcuaggcgcuagauuccuugaguuugaagcccugggguuccucaacgaggaccauugguuuuccagggaaaauucucugagcggagucgagggcgaggguuugcacaaacugggguauauucuccgcgaugugaguaagaaagaaggaggcgcaauguacgccgacgacaccgcuggcugggauacucguaucacacuugaggaccugaagaacgaagagauggugaccaaucacauggaaggggagcauaagaaauuagccgaggcgauuuucaagcugacauaucagaacaaagucguucgggugcagagaccuacucccaggggaaccguaauggauauaaucucccgccgagaccaacgggguagcggccagguggggacguacggauugaauaccuuuacaaacauggaagcacagcucauuagacagauggagggcgaaggugucuucaagaauauccaacaccugacugugaccgaggagguugccgugaaaaacuggcuagcuagggucgggcgcgaaagacuuucucggauggccaucucaggagaugacugcgugguaaagccacuggaugacagguucgcaaacgcucucacagcccugaaugauaugggcaagauucguaaagacauacagcagugggagcccaguaagggcuggaacgauuggacucagguuccuuuuugcucccaucacuuccaugaauugaucaugaaagacgggcgaguguuagucgugccaugucgcaaucaagaugagcugauugguagagcucggaucagccagggagccggcuggucucucagggaaaccgcaugccuugggaagucguaugcgcagauguggucacugauguacuuucaccgcagagaccuacggcuggccgcuaacgccauuuguagcgcagugccgucccacuggguccccacgaguaggacaaccuggucuauccaugcuaaacacgaguggaugacuacagaggacaugcucaccguuuggaaucgaguguggauacgugaaaacccuuggauggaggauaagacuccaguagaaagcugggaggaaauccccuauuugggaaagagagaggaccaguggugcggcucccugauuggucuuaccucacgcgccacaugggccaaaaauauccaagccgcgauuaaccaggugcggagucugaucgggaaugaggaauacgcugauuacaugccuucuaugaagagguucagacgcgaggaagaggaagccggaguccucugguga

SEQ ID NO: 14834 - RNA, 9876 nt, Artificial Sequence
  derived and/or modified CDS sequence (opt3) from DENV-2__EU482653__SS-prME
agcgcaggaaugaucauuaugcugauaccaaccgugauggcuuuccaccucacuacuagaaacggggaaccucauaugaucgucgguauucaagaaaagggaaaaucccuucuguuuaagacggaagacggcguuaauaugugcaccuugauggcaauggauuuaggggaacugugugaagacacuaucacuuacaaaugcccacuucucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucgugacggacaacguccacacauggaccgaacaguauaaguuucaacccgagaguccaagcaaauuggccuccgcuauucagaaggcccaggaagagggcaucugugguauaagaucuguuacuaggcucgagaaucugauguggaaacagauuacacccgaauuaaaccacauccuggcagagaaugaagugaagcuaaccauuaugacuggcgauaucaaagggauaaugcaagccggaaagcggucgcuccgcccucagccaaccgagcugaaguacagcuggaaaacauggggcaaggcuaaaaugcuuuccacggaaucacauaaccagaccuucuugaucgacgggccggagacugccgagugccccaauacaaacagagcauggaauagucuggaaguggaggauuauggauuuggcguauucaccacaaacauuuggcucaggcugaaggaaaaacaggacgcguuuugugacucuaaguuaaugagcgcugccaucaaggauaaucgugcaguccacgccgacauggguuacuggauugaguccgcucugaacgauacuuggaaaaucgagaaggccucauucauagaagugaaaaauugccauuggccuaagagccacacccuuuggucuaacgggguuuuggaguccgaaaugauuauccccaagaaccucgcaggacccgugagucaacacaauuaucggccuggcuaccauacgcagaucgcugguccauggcaccugggcaagcuagagauggacuucgauuuuugugacgggacaaccgucauugugacugaagauugcggaaaccgaggccccagccugagaaccacaacugccucugggaagcucaucaccgaguggugcuguagguccugcacacugccgccucuucgcuaccggggagaggacggcuguugguaugguauggaaauuagaccauugaaagagaaggaagagaaucugguuaacucauuagugacggcggggcauggacagguagauaauuucagucucggcguccuggguauggcccuuuuucuggaagagauguugaggacccgcgugggcacuaaacacgcuauacuccugguggcagucagcuucguuacacuaaucaccgggaacaugucguuuaaggaccugggacgagugguagugauggucggcgccacuauggcugaugacauugggaugggagugacauaccucgcccugcuugcagcguucaaaguucggcccaccuuugccgcuggcuugcuguuacguaagcucacguccaaggagcugaugaugacuaccaucgguauugugcuucugucucaaagcacaaucccugaaaccguccuagagcucacugaugcccuggcauuggggaugauggugcugaaaauaguuagaaauauggaaaaguaucaguuagcugugacaaucauggccauucucugcguccccaacgcaguaauccugcagaaugccuggaaagugucauguaccauucuugcuguugugagugucuccccacuguugcucacaucuagccagcaaaagacugacuggaucccucuggcgcuaaccauaaaaggacugaaccccacggccauuuuccuuacaacccucuccaggacuaauaagaaacgcucauggccacugaacgaggcaaucauggcugugggcaugguaagcaucuuggccaguucucuguuaaagaaugacauuccgaugaccggcccucucguggccgggggacugcuuacagucugcuacguucugacuggucgguccgcugauuuggaacucgagagagcaaccgacgugaagugggaggaucaggccgaaauaagcggcucgucacccauccugucuauuacgaucagugaggacggguccaugagcauuaaaaacgaagaggaggaacagacacuaaccauccugauaaggacuggacuucucgugaucucuggccuguuuccaauuagcauccccauuacagcggcugccugguauuugugggaggucaagaaacagcgagccgguguguuaugggauguuccuuccccacccccuauggggaaggccgaacuggaggacggagcuuaccgcaucaaacaaaagggcauauucggcuauucacagauuggggcaggaguauacaaggaagguaccuuucauacuauguggcacgugacacggggcgccguccucaugcacaaagggaagagaaucgagccgaguugggcggaugugaaaaaggaccugaucagcuacggaggcgguuggaaacuugagggggaauggaaggagggagaagagguucaggugcuggcuuuggaaccaggcaagaaucccagggccguccagaccaaaccuggccuauucaagacgaacacugggaccauuggagcagugucucuggauuuuuccccagguacaucaggcagucccaucauagacaaaaaggggaaaguagucggacucuauggcaacggugugguuacccguagcggggccuacguguccgcuauugcccaaacagagaagucuaucgaggauaauccugaaauugaggacgauaucuuccgcaagcggagacugacuauaauggaccuucauccgggagcaggcaaaaccaagagguauuuacccgcuauuguccgagaagccaucaaacggggccugcgcacgcucaucuuggcgccaacaagagugguugccgcagagauggaagaggcucugagggggcucccuauucgguaccagacucccgccauccgagcugagcacaccggaagagaaauuguggaccugaugugucaugcaacauucaccaugcgccuucugucgccagucagggugccuaacuauaauuugauaaucauggaugaggcccacuuuacugaccccgccagcauugcugcgcgugguuacaucucaacccggguagaaaugggcgaggcagccgggaucuucaugacagcuacgccaccgggauccagagauccuuuuccccagaguaacgccccaauuauagacgaggaaagggagauccccgaacgcucuuggaauagcggccaugagugggugacugauuucaaggguaaaaccguuugguuugucccuuccauuaaggcagggaacgacaucgccgcuugccuacgaaagaauggcaagaaggugauucaacugucaagaaaaacauucgauucugaauaugugaagacccggacuaacgacugggauuuugucguaacaaccgacaucagcgagaugggcgcgaauuucaaagccgagagggugauagauccacgccguuguaugaagcccguuauccucacggacggcgaagagagagugauuuuagcagggccuaugccggucacucacaguuccgcugcccagcggaggggacgcaucggucgaaaccccaagaaugaaaacgaccaguacauuuacaugggcgagccccuggaaaaugaugaggacugcgcacacuggaaggaggccaagaugcuucuggauaacaucaauacaccugaagggauaauucccagcauguuugagccagaaagagagaaaguggacgcuaucgauggagaauaucggcucaggggcgaggcccgcaagaccuucguugacuugaugagaaggggugaucugccuguguggcucgcguacaaagucgcagccgaggggauuaacuaugcugaccggcguugguguuuugauggcaucaagaacaaucagauacuggaagagaacguggaaguagagaucuggaccaaagagggagaacgcaagaaacuuaaaccccgauggcuagacgccagaauuuacucugauccacuggcuuugaaggaguucaaagaguucgcagccggcaggaagucauuaacucugaaucucaucacagagauggggcggcugccuaccuuuaugacacagaaaacucgcgacgcucuugauaaccuggccgugcuccauacggcagaagcgggagguagagccuauaaucacgcuuuguccgagcugccggagacccuagaaacacugcuccuucugacuuuauuggccaccguuacaggcgggauuuuccuguuucucaugaguggaaggggcaucgguaagaugacccuggggaugugcugcauaauuacugcaagcauccuucugugguacgcucagauccagccccauuggauugccgcaucgaucauacucgaguucuuuuugauuguccuguuaaucccagaaccugagaagcagcggacgccccaagacaaccagcuaaccuauguggugauugccauccugacagucguugcugcgacuauggccaaugaaaugggcuuccucgagaaaaccaagaaagaccuuggacugggcucuauagcaacacagcagccagaguccaacaucuuggauauugaccugcgaccugcuagcgccuggacccucuacgccguggcaacuacauuuguaacgcccaugcugagacacucaaucgaaaauaguucugugaacgucucccuuaccgcuauugccaaucaagcgacugugcucauggggcugggaaaggguuggccguugagcaaaauggauaucggcguuccacuguuagcuauuggguguuacucacaggugaacccuaucacacuaaccgccgcacugcuccuucuggucgcccacuaugcuauaauuggacccggcuugcaggcaaaggccacccgcgaggcgcagaagagggcugccgcagguaucaugaaaaauccaacaguagacgggaucacugugauugaucuggaccccauaccuuacgauccgaaguucgaaaaacaacucggccagguuaugcugcuuaucuuaugcgugacgcagguccugaugaugcggaccacaugggcccucugugaggcuuugacucuggccaccggacccauuaguacacuaugggaaggcaacccagggcguuuuuggaauaccacuaucgcagugagcauggcuaacauuuucagaggauccuaucuggccggcgcgggucuccuauuuucuaucaugaagaauacgacaaacgccaggcgcgggaccggaaacaugggcgagacucugggugagaaauggaaaagccgguugaaugcacugggcaaauccgaguuccaaauauacaagaagucagggauccaggaggucgaccgaacccucgcuaaagaaggaauuaagagaggcgagacagaucaucacgccgugucuagggggagugcaaaacugcgcugguuuguugagcggaacauggugacuccugaaggaaagguaguggacuuaggcugcgguagagggggauggucguauuacuguggcggucuuaaaaauguccgugagguuaagggccugaccaaagggggacccggccaugaagaaccuaucccaaugagcacauauggguggaaccucgugaggcuacaguccggagucgauguguucuucauucccccugaaaaaugcgacacgcuguugugugauaucggcgagucuucaccaaaucccaccguagaggcuggucggacucugcgcgugcucaaccuuguugaaaauuggcugaacaauaacacacaguuuugcauaaagguguugaauccguacaugccuagcgucauugagaaaauggaagcccugcaacgaaaguacgggggagcccucgugagaaacccauuauccaggaauaguacccacgagauguauugggucucuaacgcgagcggcaauaucgugucauccguuaacaugaucagucggaugcugauuaaccgcuucacuaugagacauaaaaaggcuacauacgaacccgacguagaccuuggcagcgggaccaggaauauaggaaucgagucugagauuccuaaccuggauaucauugguaagcgaaucgagaaaauaaagcaggagcacgaaacguccuggcacuaugaccaggaucauccauacaaaaccugggcauaucacggcucauacgagacaaagcagacugggagcgccucgucuauggugaauggagucgugcggcuacucaccaaacccugggacguucugccgacagugacucaaauggcuaugaccgauacaaccccuuuuggccagcagcgugucuucaaggaaaagguggacacuagaacgcaggagcccaaagaggguacaaagaaauugaugaagaucaccgccgaauggcuguggaaagagcucgggaagaaaaagacuccacgcauguguaccagggaagaguuuacacggaagguaagaaguaacgcagcccuuggagcuauuuucacggaugagaauaaauggaaguccgcgcgcgaagccguggaggacagcagguuuugggaacugguugauaaagagcgaaacuuacaucuggaaggcaagugcgagaccugugucuauaauaugaugggcaaacgggagaagaaguugggggaguucggaaaagcaaaggguucaagagcuaucugguacauguggcucggcgccagguuucuggaguucgaagcacuaggguuucuuaacgaggaccacugguucucccgcgaaaauucucugagcggaguggagggcgagggucuccacaaacugggguacauuuugcgugaugugaguaagaaagaaggaggcgccauguaugcugacgacacugccggcugggauacacggaucacccuggaggaccucaagaacgaagagauggucacuaaucauauggaaggggagcacaagaaacuugcggaggcaauuuuuaagcugacauaccaaaacaaaguugugagaguacagaggccuaccccacgcggaacagugauggauauaaucucccgacgggaccagagagguagcggccaagucgggacuuauggauuaaauaccuucacgaacauggaagcccagcugauuaggcagauggagggcgaagguguguucaagaauauccagcauuugaccguuacagaggagguggcuguccaaaacuggcucgcccgcguggggagagaacggcugucuaggauggcaaucucaggagaugacugcguaguuaaaccacuagaugaccguuuugcuaacgcccuuacugcucugaaugauaugggcaagauucgaaaggacauacagcagugggagcccaguaaaggcuggaacgauuggacccaggugccuuucugcucccaccauuuucacgaacucaucaugaaggacgggcgcguccugguggugccauguagaaaucaagaugaguugauuggacgggccaggaucagccagggugcaggcuggucuuuacgcgaaacagcgugccuggggaaaucguacgcccagauguggucacucauguauuuccacagacgggaccuuaggcuggcugccaacgcaauuuguagcgcugucccgucccauuggguucccacaagucgaaccacguggucuauccacgccaagcaugaguggaugacaaccgaggacaugcuaacuguguggaaucguguauggauaagagaaaacccuuggauggaggauaaaacaccaguggaaagcugggaggaaauccccuaccugggaaagcgcgaggaccaguggugcggcucccucauugguuugaccucacgggcaacuugggccaagaauauccaagcggcuauuaaccaggucaggagucugaucgggaaugaggaauauaccgauuacaugccuucuaugaaaagauuucgccgggaggaagaggaagccggagugcuuugguga

SEQ ID NO: 14835 - RNA, 9876 nt, Artificial Sequence
  derived and/or modified CDS sequence (opt3) from DENV-2__EU482654__SS-prME
agcgccggaaugaucauuaugcugauaccaaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaaaugaccaucaugacuggcgauauaaaggggaucaugcaggccggaaaacggucgcuacgcccucagccaaccgagcucaaguacagcuggaagacauggggcaaagcuaagaugcuguccacggaaucauauaaccagaccuuccuuauugacgggccggagacugccgagugccccaauacaaacagagcauggaauaguuuggaaguggaggauuacggauuuggcguguucaccacaaacaucuggcugaaacucaaggaaaaacaagacgcguuuugugacucuaagcugaugagcgcugccauuaaggauaauagggcaguacaugccgacauggguuauuggaucgaguccgcuuuaaacgauacuuggaaaauagagaaggccucauucauugaagucaaaaauugccacuggccuaagagccauacccuguggucuaacggggugcuugaguccgaaaugaucauccccaagaacuuggcaggacccguuagucagcacaauuaccguccuggcuaccacacgcagauugcugguccauggcaucucggcaagcuggagauggacuucgauuuuugugacgggacaaccgugaucgucacugaagauugcggaaaccggggccccagccuacgaaccacaacugccucugggaagcugauuaccgaguggugcuguagauccugcacacucccgccucugagguaucgcggagaggacggcuguugguacgguauggaaauacggccacuuaaagagaaggaagagaauuuggugaacucacugguuacggcggggcacggacaaguggauaauuucaguuuaggcguacucgguauggcccuguuucuugaagagaugcugagaaccagggucggcacuaaacaugcuaucuugcucguggcagugagcuucgucacacugauuaccgggaacaugucguuuaaggaccuaggacgcguugugguaauggugggcgccacuauggcugaugacaucgggaugggagucacauaucuggcccuccuggcagcguucaaagugcgacccaccuuugccgcuggccuuuugcugcggaaguuaacguccaaggagcucaugaugacuaccauugguaucguucugcuuucucagagcacaauaccugaaaccgugcuggagcuaacugaugcccucgcacuggggaugauggucuugaaaaucgugcguaauauggaaaaguaccagcuggcuguuacaauuauggccaucuuaugcgugcccaacgcagucauucuccagaaugccuggaaaguaucauguaccauccuggcugugguuaguguguccccacuucuguugacaucuagccaacagaagacugacuggauaccucucgcgcugaccauuaaaggacuaaaccccacggccaucuuccugacaacccuuuccagaacuaauaagaaaaggucauggccacucaacgaggcaaucauggcugucggcauggugagcauucuggccaguucuuugcugaagaaugacauaccgaugaccggcccuuuaguagccgggggacuccugacagugugcuauguccuuacuggucgcuccgcugaucuggaauuggagcgggcaaccgacguuaagugggaggaucaggccgaaaucagcggcucgucacccauucucucuaucacgauuagugaggacggguccaugagcaucaaaaacgaagaggaggaacagacacugaccauacuaaucagaacuggacugcuugugauuucuggccucuuuccaaucagcauucccaucacagcggcugccugguaccugugggaggugaagaaacaaagggccggugucuugugggaugugccuuccccacccccuauggggaaggccgaauuagaggacggagcuuaucgaauaaaacagaagggcauucugggcuacucacagaucggggcaggaguuuacaaggaagguaccuuccacacuauguggcauguaacacgcggcgccgugcucaugcacaaagggaagcggaucgagccgaguugggcggaugucaaaaaggaccugauuagcuauggaggcgguuggaaacuugagggggaauggaaggagggagaagaggugcagguucuggcuuuggaaccaggcaagaaucccagagccgugcaaaccaaaccuggccuauuuaagacgaacacugggaccaucggagcagucucucuggauuucuccccagguacaucaggcagucccauaauugacaaaaaggggaaagugguaggacucuacggcaacggugucgugaccaggagcggggccuauguuuccgcuaucgcccagacagagaagucuauugaggauaauccugaaaucgaggacgauauauuucguaagcgccggcugacuauuauggaccuucacccgggagcaggcaaaaccaagagauacuuacccgcuaucgugagggaagccaucaaacgaggccugcggacgcucauuuuggcgccaacacgcgucguggccgcagagauggaagaggcucugagagggcucccuaucagguaucagacucccgccauucgggcugagcauaccggacgagaaauaguugaccugaugugucacgcaacauucaccaugagacuucugucgccagugcgcgucccuaacuacaauuugaucauuauggaugaggcccauuucacugaccccgccagcaucgcugcgagggguuauaucucaacccguguggaaaugggcgaggcagccgggauuuuuaugacagcuacgccaccgggaucccgggauccuuucccccaaaguaacgccccaauaaucgacgaggaaagagagauucccgaaaggucuuggaauagcggccacgaguggguaacugauuuuaaggguaaaaccgugugguucguuccuuccaucaaggcagggaacgacauugccgcuugccuacgcaagaauggcaagaaggucauccagcugucacgaaaaacauuugauucugaauacgugaagaccagaacuaacgacugggauuucguggucacaaccgacauaagcgagaugggcgcgaauuuuaaagccgagcggguaaucgauccaaggcgcuguaugaagcccgugauucucacggacggcgaagaacguguuaucuuagcagggccuaugccggugacucauaguuccgcugcccagagacggggaaggauuggucgcaaccccaagaaugaaaacgaccaguacaucuauaugggcgagccccuggaaaaugaugaggacugcgcacacuggaaggaggccaagaugcuucuggauaacauaaauacaccugaagggauuauccccagcauguucgagccagaacgagagaaagucgacgcuauugauggagaauacagacuccggggcgaggccaggaagaccuuuguggacuugaugcgcagaggugaucugccuguuuggcucgcguauaaaguggcagccgaggggaucaacuacgcugacaggcggugguguuucgauggcauaaagaacaaucaaauccuggaagagaacgucgaaguggagauuuggaccaaagagggagaacguaagaaacuuaaaccccgcuggcuagacgcccgaaucuauucugauccacuggcuuugaaggaguuuaaagaguucgcagccggcagaaagucauuaacucugaaucucauuacagagauggggaggcugccuaccuucaugacacagaaaacucgggacgcucuugauaaccuggccguacuccacacggcagaagcgggaggucgcgccuacaaucaugcuuuguccgagcugccggagacccuagaaacacugcuccuucugacuuuauuggccaccgugacaggcgggaucuuucuguuccucaugaguggaagaggcauagguaagaugacccuggggaugugcugcauuaucacugcaagcauccuucugugguaugcucagauucagccccacuggaucgccgcaucgauaauucucgaguuuuucuugaucguucuguuaauuccagaaccugagaagcaaaggacgccccaggacaaccagcuaaccuacgucgugaucgccauacugacaguggucgcugcgacuauggccaaugaaaugggcuuucucgagaaaaccaagaaagaccuuggacugggcucuaucgcaacacagcaaccagaguccaacauuuuggauaucgaccugcggccugcuagcgccuggacccucuacgccguugcaacuacauucgugacgcccaugcugcgacauucaauugaaaauaguucuguaaacgugucccuuaccgcuaucgccaaucaggcgacuguccucauggggcugggaaaggguuggccguugagcaaaauggauauuggcgugccacuguuagcuaucggguguuauucacagguuaacccuauaacacuaaccgccgcacugcuccuucugguggcccacuacgcuauuaucggacccggcuugcaggcaaaggccaccagagaggcgcaaaagcgcgcugccgcagguaucaugaaaaauccaacagucgacgggauuacuguaauagaucuggaccccaucccuuaugauccgaaguuugaaaaacagcucggccaggugaugcugcuuauuuuaugcguuacgcaagugcugaugaugaggaccacaugggcccucugugaggcuuugacucuggccaccggacccaucaguacacuaugggaaggcaacccagggcgguucuggaauaccacuauugcagucagcauggcuaacaucuuucguggauccuaccuggccggcgcgggucuccuuuucucuauaaugaagaauacgacaaacaccagaagggggacuggaaacaugggcgagacccugggugagaaauggaaaagccgcuugaauacacugggcaaauccgaauuucagaucuauaagaagucagggauucaggagguggaccggacucucgccaaagaaggaaucaagcgaggcgagaccgaucaccaugcagucucuagagggagugcuaaacugaggugguucguggagcgcaacaugguuacaccugaaggaaaggugguagacuuaggcugcgguagagggggauggucguacuauuguggcggucuuaaaaaugugagagaggucaagggccugacgaaagggggacccggccacgaggaaccuauuccaaugagcaccuacggguggaaccucguucgucuacaguccggaguggaugucuuuuucaucccaccugaaaaaugcgacacucuguugugugauauaggcgagucuucaccaaaucccacaguggaggccgguaggacccugcggguacucaaccuuguggaaaauuggcugaacaauaacacucaauucugcauuaagguuuugaauccguacaugccuagcgugaucgagaaaauggaagcacugcagcgcaaguaugggggagcucucguccgaaacccauuauccagaaauaguacacaugagauguacugggugucuaacgccagcggcaauaucgucucauccgugaacaugauuaguaggaugcugauaaaccgguuuaccaugcgccacaaaaaggccacguaugaacccgacguugaccuuggcagcgggaccagaaauaucggaauugagucugagacaccuaaccuggauaucauugguaagaggaucgagaaaauaaagcaggagcaugaaacuuccuggcacuacgaccaggaucacccauauaaaaccugggcguaccauggcucauaugagacaaagcaaacugggagcgcuucgucuaugguaaauggagugguccgacuacucaccaaacccugggacgugcugccgacaguuacccagauggcaaugacugauacgacaccuuucggccagcagcggguguuuaaggaaaaggucgacacccguacucaagagcccaaagaggguaccaagaaauugaugaagaucacagccgaauggcuguggaaagagcucgggaagaaaaagacgccaagaauguguacccgcgaagaguucacuaggaaggugcggaguaacgcugcccuuggagcaauuuuuacagaugagaauaaauggaaguccgccagagaagcuguagaggacagccgcuucugggaacugguggauaaagagaggaacuuacaccuggaaggcaagugcgagaccuguguuuacaauaugaugggcaaacgagagaagaaguugggggaauuuggaaaagcgaaggguucacgggccaucugguacauguggcucggcgcaagauuccuggaguuugaagcucuaggguuccuuaacgaggaccauugguuuuccagggaaaauucucugagcggagucgagggcgagggucuccacaaacugggguauauuuugcgcgaugugaguaagaaagaaggaggcgccauguacgcagacgacacugccggcugggauacacguaucacccuggaggaccucaagaacgaagagauggugacaaaucacauggaaggggagcauaagaaacuugcugaggccauuuucaagcugacuuaucagaacaaagucguucgggugcagagaccuacccccaggggaacgguaauggauauaaucucccgccgagaccaacgggguagcggccagguggggaccuacggauuaaauacauuuacuaacauggaagcgcagcugauuagacagauggagggcgaaggugucuucaagaauauccaacacuugaccgugacagaggagguugcagugcagaacuggcucgccagggucgggcgcgaaagacugucucggauggcuaucucaggagaugacugcgugguaaaaccacuagaugacagguucgccaacgcacuuacugcucugaaugauaugggcaagauucguaaggacauacagcagugggagcccaguaaaggcuggaacgauuggacccaaguuccuuuuugcucccaucacuuccaugaacucaucaugaaggacgggcgagugcuggucgugccaugucgcaaucaggaugaguugauugguagagcacggaucagccagggagcuggcuggucuuuaagggaaacggccugccuggggaaaucguaugcacagauguggucacucauguacuuucaccgcagagaccuucggcuggcggccaacgcuauuuguagcgccgugccgucccacuggguccccacaaguaggaccacuuggucuauccaugcaaagcacgaguggaugacaaccgaggacaugcuaacuguuuggaaucgaguguggauacgugaaaacccuuggauggaggauaaaaccccaguagaaagcugggaggaaauccccuaucugggaaagagagaggaccaauggugcggcucccucauugguuugacaucacgcgcuacgugggccaagaauauccaggcagccauuaaccaggugcggagucugaucgggaaugaggaauacaccgauuacaugccuucuaugaaaagguucagacgcgaggaagaggaagcgggaguccuuugguga

SEQ ID NO: 14836 - RNA, 9876 nt, Artificial Sequence
  derived and/or modified CDS sequence (opt3) from DENV-2__EU482656__SS-prME
agcgcaggaaugaucauuaugcugauaccaaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaagacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucgugacggacaacguccacacauggaccgaacaguauaaguuucaacccgagaguccaagcaaauuggccuccgcuauucagaaggcccaggaagagggcaucugugguauaagaucuguuacuaggcucgagaaucugauguggaaacagauuacacccgaauuaaaccacauccuggcagagaaugaagugaagcuaaccauuaugacuggcgauaucaaagggauaaugcaagccggaaagcggucgcuccgcccucagccaaccgagcugaaguacagcuggaaaacauggggcaaggcuaaaaugcuuuccacggaaucacauaaccagaccuucuugaucgacgggccggagacugccgagugccccaauacaaacagagcauggaauagucuggaaguggaggauuauggauuuggcguauucaccacaaacauuuggcucaagcugaaagaaaagcaggacgcguuuugugacucuaaguuaaugagcgcugccaucaaagauaauagggcaguccacgccgacauggguuacuggauugaguccgcucugaacgauacuuggaagaucgagaaagccucauucauagaagugaagaauugccauuggccuaaaagccacacccuuuggucuaacgggguuuuggaguccgaaaugauuaucccaaagaaccucgcaggacccgugagucaacacaauuaucguccuggcuaccauacgcagaucgcugguccauggcaccugggcaagcuagagauggacuucgauuuuugugacgggacaaccgucauugugacugaagauugcggaaaccggggccccagccugcgaaccacaacugccucugggaaacucaucaccgaguggugcuguagauccugcacacugccgccucuuagguaccgcggagaggacggcuguugguaugguauggaaauucggccauugaaggagaaagaagagaaucugguuaacucauuagugacggcggggcauggacagguagauaauuucagucucggcguccuggguauggcccuuuuucuggaagagauguugagaaccagggugggcacuaagcacgcuauacuccugguggcagucagcuucguuacacuaaucaccgggaacaugucguuuaaagaccugggacgcgugguagugauggucggcgccacuauggcugaugacauugggaugggagugacauaccucgcccugcuugcagcguucaagguucgacccaccuuugccgcuggcuugcuguuacggaagcucacguccaaagagcugaugaugacuaccaucgguauugugcuucugucucaaagcacaaucccugaaaccguccuagagcucacugaugcccuggcauuggggaugauggugcugaagauaguucguaauauggaaaaauaucaguuagcugugacaaucauggccauucucugcguccccaacgcaguaauccugcagaaugccuggaaggugucauguaccauucuugcuguugugagugucuccccacuguugcucacaucuagccagcagaagacugacuggaucccucuggcgcuaaccauaaagggacugaaccccacggccauuuuccuuacaacccucuccagaacuaauaaaaagaggucauggccacugaacgaggcaaucauggcugugggcaugguaagcaucuuggccaguucucuguuaaagaaugacauuccgaugaccggcccucucguggccgggggacugcuuacagucugcuacguucugacuggucgcuccgcugauuuggaacucgagcgggcaaccgacgugaaaugggaggaucaggccgaaauaagcggcucgucacccauccugucuauuacgaucagugaggacggguccaugagcauuaagaacgaagaggaggaacagacacuaaccauccugauaagaacuggacuucucgugaucucuggccuguuuccaauuagcauccccauuacagcggcugccugguauuugugggaggucaaaaagcagagggccgguguguuaugggauguuccuuccccacccccuauggggaaagccgaacuggaggacggagcuuaccgaaucaagcaaaagggcauacucggcuauucacagauuggggcaggaguauacaaagaagguaccuuccauacuauguggcacgugacacgcggcgccguccugaugcacaaggggaaacggaucgagccgaguugggcggaugugaagaaagaccuuaucagcuacggaggcgguuggaagcuggagggggaauggaaggagggagaagagguucagguguuggcucuagaaccaggcaaaaaucccagagccguccagaccaagccuggccuguuuaaaacgaacacugggaccauuggagcagugucucucgauuucuccccagguacaucaggcagucccaucauagacaagaaagggaagguagucggacuguauggcaacggugugguuaccaggagcggggccuacguguccgcuauugcccaaacagagaagucuaucgaggauaauccugaaauugaggacgauaucuuucguaaacgccggcuuacuauaauggacuuacauccgggagcaggcaagaccaaaagauaucugcccgcuauugucagggaagccaucaagcgaggccuccggacguugauccuggcgccaacacgcgugguugccgcagagauggaagaggcucucagagggcugccuauuagguaccagacucccgccauccgggcugagcacaccggacgagaaauuguggaccuuaugugucaugcaacauucaccaugagacuguugucgccaguccgcgugccuaacuauaaucuaauaaucauggaugaggcccacuucacugaccccgccagcauugcugcgagggguuacaucucaacccguguagaaaugggcgaggcagccgggaucuuuaugacagcuacgccaccgggaucccgggauccuuucccccagaguaacgccccaauucuggacgaggaaagagagauacccgaaaggucuuggaauagcggccaugagugggugacugauuuugaagguaaaaccguuugguucgucccuuccaucaaggcagggaacgacauugccgcuugccuccgcaagaauggcaagaaggugauccaauuaucacgaaaaacauuugauucugaguaugugaagaccagaacuaacgacugggauuucgucguaacaaccgacauuagcgagaugggcgcgaauuuuaaagccgaacgggugaucgauccaaggcgcuguaugaagcccguuauacugacggacggcgaggaacgugugauccuugcagggccuaugccggucacucacaguuccgcugcccagagacggggaaggauuggucgcaaccccaaaaaugagaacgaccaguacaucuacaugggcgaaccccuggagaaugaugaggacugcgcacacuggaaggaagccaagaugcucuuggauaacauuaauacaccugaggggaucauacccagcauguucgaaccagagcgagaaaaaguggacgcuauugauggagaguauagacugcggggcgaggccaggaagaccuuuguugaccucaugcgcagaggugaucugccuguguggcuugcguacaaagucgcagccgaagggaucaacuaugcugacaggcggugguguuucgauggcauuaagaacaaucagauccuagaggaaaacguggagguagagauauggaccaaagaaggagagcguaagaagcugaaaccccgcugguuggacgcccgaaucuacucugauccauuagcucugaaggaauuuaaagaguucgcagccggcagaaagucacucacucugaaucuuauuacagaaauggggaggcugccuaccuucaugacacagaaaacucgggacgcucucgauaacuuggccgugcugcauacggcagaggcgggaggucgcgccuauaaucacgcucuauccgagcugccggaaacccucgagacacuucuguuauugacucugcucgccaccguuacaggcgggaucuuucuguuccuuaugaguggaagaggcauugguaagaugacccuggggaugugcugcaucauaacugcaagcauucucuugugguacgcucagauccagccccauuggaucgccgcaucgauuauccuggaauuuuucuuaauaguccuacugauuccagagccugaaaagcagaggacgccccaagacaaccagcucaccuauguggugaucgccauucuuacagucguugcugcgacuauggccaaugagaugggcuuucuggagaaaaccaagaaagacuugggacugggcucuguggcaacacagcagccagaauccaacauccucgauauagaccugcggccugcuagcgccuggacccuuuacgccguagcaacuacauucgugacgcccaugcuccgacacucaaucgagaauaguucugucaacgugucccugaccgcuauugccaaucaagcgacuguuuugauggggcugggaaaggguuggccguuaagcaaaauggauaucggcgugccacuacuggcuauuggguguuacucacaggucaacccuaucacacucaccgccgcacuucuguugcugguagcccacuaugcuauuaucggacccggccuccaggcaaaggccaccagagaagcgcagaagcgcgcugccgcagguauaaugaaaaauccaacaguggacgggauuacuguuaucgaucuggaccccaucccuuacgauccgaaguuugagaaacaacuuggccaggugauguuacugauucucugcgucacacagguguugaugaugaggaccacaugggcccugugugaagcucuaacucuggccaccggacccauaaguacacucugggagggcaacccagggcgguucuggaauaccacuaucgcagucagcauggcuaacauuuuucguggauccuaucuugccggcgcgggucuguuguucucuaucaugaagaauacgacaaacaccagaagggggacuggaaacaugggcgagacccugggugaaaaauggaaaagccgccucaaugcccugggcaaauccgaguuucaaauuuacaagaagucagggauccaggaaguggaccggacauuagcaaaagagggaauaaagcgaggcgagacugaucaucacgcuguuucuagagggagugccaaacuuaggugguucguggaacgcaacaugguaaccccugagggaaagguggucgaccugggcugcgguagagggggauggucguauuacuguggcggucucaaaaauguuagagaagugaagggccuaacaaaagggggacccggccaugaggaaccuaucccaaugagcacguauggguggaaccugguccguuugcaguccggaguggauguauuuuucauucccccugagaaaugcgacacccugcucugugauaucggcgagucuucaccaaaucccacuguggaagcagguaggacacuucggguucugaacuugguggagaauuggcugaacaauaacacccaguucugcauuaagguccucaauccguacaugccuagcgugaucgagaaaauggaggcuuuacaacgcaaguacgggggagcccugguccgaaacccacuuuccagaaauaguacucacgaaauguauugggugucuaacgccagcggcaauauaguuucauccguaaacaugauuaguaggaugcugaucaaccgguuuacaaugcgccauaaaaaggcgaccuacgagcccgacguggaccuaggcagcgggacgagaaauaucggaauugagucugaaauaccuaaccucgauaucauugguaagaggaucgagaaaauuaagcaggaacacgagaccuccuggcacuaugaccaggaucauccauacaaaacaugggcuuaucacggcucauacgaaacuaagcagaccgggagcgcaucgucuauggucaauggagugguucgacuguugacaaaacccugggacgugcugccgacugucacccaaauggccaugacagauaccacuccuuucggccagcagcggguguuuaaggagaagguagacacgcguacacaggagcccaaagaagguaccaagaaacucaugaagaucacugcugaguggcuuuggaaagaacuggggaagaaaaagaccccaagaauguguacacgcgaggaguucacgaggaaggugcggaguaacgccgcauuaggagccauauuuaccgaugaaaauaaauggaaguccgcuagagaggcgguugaagacagccgcuucugggagcuggucgauaaagaaaggaacuugcaucucgagggcaagugcgagacuuguguguauaauaugaugggcaaacgagaaaagaagcugggggaguuuggaaaagccaaggguucacgggcaaucugguacauguggcuaggcgcuagauuccuugaauuugaggcccugggguuccucaacgaagaccacugguuuuccagggaaaauucucugagcggaguggagggcgaagguuugcacaaacugggguacauucuccgcgaugucaguaagaaagagggaggcgcaauguaugccgacgacacagcuggcugggauacccguaucacucuugaagaccugaagaacgaggaaaugguuacaaaucauauggagggggagcacaagaaauuagccgaagcgauuuucaagcugaccuaccaaaacaaagugguacgggugcagagaccuacacccaggggaacugucauggauaucauuucccgccgagaccagcgggguagcggccaaguggggaccuauggauugaauacguuuaccaacauggaggcacagcucauaagacagauggaaggcgaggguguuuucaagaauauccagcaucugacagugacugaggaagucgccgugcaaaacuggcuagcuaggguagggcgcgagagacuuucucggauggccauuucaggagaugacugcguugugaaaccacuggaugacagguucgcaaacgcucucaccgcccugaaugauaugggcaagauccguaaggacauccagcagugggaacccaguaaaggcuggaacgauuggacacaggucccuuuuugcucccaccauuuccacgaguugauuaugaaggacgggcgaguguuaguggucccaugucgcaaucaagaugaacugauaggacgggcucggaucagccagggugccggcuggucucucagggagacugcaugccuugggaaaucguacgcgcagauguggucacugauguauuuucaccgcagagaccuacggcuggccgcuaacgccauuuguagcgcaguuccgucccauugggugcccaccaguaggacgacauggucuauccacgcuaagcaugaguggaugaccacugaagacaugcucacaguauggaaucgaguguggauucgugagaacccuuggauggaagauaaaaccccagucgagagcugggaagagauccccuacuugggaaagagagaggaccaguggugcggcucccugauaggucuuacuucacgcgccaccugggcaaagaauauccaagccgcgauuaaccaggugcggagucugaucgggaaugaagaguauacagauuacaugccuucuaugaaaagguucagacgcgaagaggaagaggcuggaguucucugguga

SEQ ID NO: 14837 - RNA, 9876 nt, Artificial Sequence
  derived and/or modified CDS sequence (opt3) from DENV-2__EU482657__SS-prME
agcgcaggaaugaucauuaugcugauaccaaccgugauggcuuuccaccucacuacuagaaacggggaaccucauaugaucgucgguauucaagaaaagggaaaaucccuucuguuuaagacggaagacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauaaugaggcauccuggcuucaccaucauggccgcaauucuggccuacacaaucggcaccacgcacuuucagcggguguugauuuucauccuccugacugcuguugcaccaucuaugacaaugcgcugcauagggauuucgaacagagauuuuguggaaggagucucagguggcagcuggguggacaucguacuggagcacgggaguuguguuaccacuauggccaagaauaagcccacacucgauuucgaauuaauuaaaaccgaggcuaagcagccugccacgcugaggaaauauugcaucgaagcgaaacuuaccaacacaacuaccgagucccgguguccaacacaaggagagcccucuuugaaagaagaacaggacaagcgcuuugugugcaagcauagcauggucgaucgaggcugggguaauggguguggacuguucggcaaaggcgggaucgugacuugcgcaauguuuaccugcaagaaaaacauggaaggaaagauugugcagccugagaaucuagaauacacaauagucguuaccccacacuccggugaggagcaugccgugggcaacgacacugggaaacacggaaaggaaaucaaaguaacgccgcagucaaguauuacagaggcugaacucaccggcuaugguacugugaccauggaguguagccccagaacagggcuggauuucaaugaaaugguccuucugcaaauggagaacaaggccugguuggugcacaggcagugguuucucgaccugccuuuaccauggcugcccggcgcagauaagcaggagucuaauuggauccagaaagaaacccucguuacuuucaagaacccucaugcuaaaaagcaagacguggucgugcuuggaucccaggagggcgccaugcacacagcgcugacgggggccaccgaaauacagaugucaagcggaaauuugcuauuuacuggucaucugaaaugccggcuccguauggacaagcugcaacuuaagggcaugaguuacucuauguguacagggaaauucaagguaguuaaagagauugcagagacccagcacggaacaaucgugauccgcguccaguaugaaggcgaugguuccccaugcaagauucccuucgagaucauggaccuggagaagagauacguguuggggaggcucauuacugucaacccgauagugaccgagaaggauagcccuguuaacaucgaagcugagcccccauuuggcgacucguacauuaucaucggaguggagccuggccagcugaaguuaaauugguucaaaaaggggucuuccauuggacaaauguuugaaacgaccaugcggggugccaaacgaauggcuauacugggcgauacagccugggacuucgggucacuaggaggcguauuuacaaguaucgguaaggcacuccaucaggucuucggggccauuuauggcgcugcguuuagcggaguguccuggaccaugaaaauccugauuggcguuaucauaacauggaucgggaugaacucucgcagcacuucacuuaguguguccuugguccuggugggaauuguaacccucuaccugggcgugaugguucaggcagauagcgguugugucgugucuuggaagaauaaggagcuuaaaugcgggucaggaaucuucauuacggacaacgugcacacauggaccgaacaguauaaguuucaacccgagaguccaagcaaacuggccuccgcuauccagaaggcccaggaagagggcauaugugguauuagaucugucacuagguuggagaaucucauguggaaacagaucacacccgaacugaaccacauuuuagcagagaaugaaguuaagcugaccaucaugacuggcgauauacgggggaucaugcaagccggaaaacgcucgcuaagaccucagccaaccgagcucaaguacagcuggaagacauggggcaaagcuaagaugcuguccacggaaucauauaaccagaccuuccuuauugacgggccggagacugccgagugccccaauacaaacagggcauggaauaguuuggaaguggaggauuacggauuuggcguguucaccacaaacaucuggcugaaacucaaggaaaaacaggacgcguuuugugacucuaagcugaugagcgcugccauuaaggauaaucgugcaguacaugccgacauggguuauuggauggaguccgcuuuaaacgauacuuggaaaaucgagaaggccucauucauagaagucaaaaauugccacuggccuaagagccauacccuguggucuaacggggugcuugaguccgaaaugauuauccccaagaacuuggcaggacccguuagucaacacaauuaccggccuggcuaccacacgcagaucgcugguccauggcaucucggcaagcuggagauggacuucgauuuuugugacgggacaaccgugauugucacugaagauugcggaaaccgaggccccagccuaagaaccacaacugccucugggaagcugaucaccgaguggugcuguagguccugcacacucccgccucugcgcuaucggggagaggacggcuguugguacgguauggaaauuagaccacuuaaagagaaggaagagaauuuggugaacucacugguuacggcggggcacggacagguggauaauuucaguuuaggcguacucgguauggcccuguuucuugaagagaugcugaggacccgcgucggcacuaaacaugcuauauugcucguggcagugagcuucgucacacugaucaccgggaacaugucguuuaaggaccuaggacgaguugugguaauggugggcgccacuauggcugaugacauugggaugggagucacauaucuggcccuccuggcagcguucaaagugcggcccaccuuugccgcuggccuuuugcugcguaaguuaacguccaaggagcucaugaugacuaccaucgguauuguucugcuuucucaaagcacaaucccugaaaccgugcuggagcuaacugaugcccucgcacuggggaugauggucuugaaaauagugagaaauauggaaaaguaccagcuggcuguuacaaucauggccauuuuaugcgugcccaacgcagucauccuccagaaugccuggaaaguaucauguaccauucuggcugugguuaguguguccccacuucuguugacaucuagccagcaaaagacugacuggaucccucucgcgcugaccauaaaaggacuaaaccccacggccauuuuccugacaacccuuuccaggacuaauaagaaacgcucauggccacucaacgaggcaaucauggcugucggcauggugagcauccuggccaguucuuugcugaagaaugacauuccgaugaccggcccuuuaguagccgggggacuccugacagugugcuauguccuuacuggucgguccgcugaucuggaauuggagagagcaaccgacguuaagugggaggaucaggccgaaauaagcggcucgucacccauccucucuauuacgaucagugaggacggguccaugagcauuaaaaacgaagaggaggaacagacacugaccauccuaauaaggacuggacugcuugugaucucuggccucuuuccaauuagcauccccauuacagcggcugccugguaccugugggaggugaagaaacagcgagccggugucuugugggaugugccuuccccacccccuauggggaaggccgaauuagaggacggagcuuaucgcaucaaacaaaagggcauacugggcuacucacagauuggggcaggaguuuacaaggaagguaccuuccacacuauguggcauguaacacggggcgccgugcucaugcacaaagggaagagaaucgagccgaguugggcggaugucaaaaaggaccugaucagcuauggaggcgguuggaaacuugagggggaauggaaggagggagaagaggugcagguucuggcuuuggaaccaggcaagaaucccagggccgugcagaccaaaccuggccuauuuaagacgaacacugggaccauuggagcagucucucuggauuucuccccagguacaucaggcagucccaucauagacaaaaaggggaaagugguaggacucuacggcaacggugucgugacccguagcggggccuauguuuccgcuauugcccaaacagagaagucuaucgaggauaauccugaaauugaggacgauaucuuucgcaagcggagacugacuauaauggaccuucacccgggagcaggcaaaaccaagagguacuuacccgcuauugugcgagaagccaucaaacggggccugcgcacgcucaucuuggcgccaacaagagucguggccgcagagauggaagaggcucugagggggcucccuauucgguaucagacucccgccauccgagcugagcauaccggaagagaaauuguugaccugaugugucacgcaacauucaccaugcgccuucugucgccagugagggucccuaacuacaauuugauaaucauggaugaggcccauuucacugaccccgccagcauugcugcgcgugguuauaucucaacccggguggaaaugggcgaggcagccgggaucuuuaugacagcuacgccaccgggauccagagauccuuucccccagaguaacgccccaauuauagacgaggaaagggagauccccgaacgcucuuggaauagcggccacgaguggguaacugauuuuaaggguaaaaccgugugguucguuccuuccauuaaggcagggaacgacaucgccgcuugccuacgaaagaauggcaagaaggucauucaacugucaagaaaaacauuugauucugaauacgugaagacccggacuaacgacugggauuucguggucacaaccgacaucagcgagaugggcgcgaauuuuaaagccgagaggguaauagauccacgccguuguaugaagcccgugauccucacggacggcgaagagagaguuauuuuagcagggccuaugccggugacucauaguuccgcugcccagcggaggggacgcaucggucgaaaccccaagaaugaaaacgaccaguacauuuauaugggcgagccccuggaaaaugaugaggacugcgcacacuggaaggaggccaagaugcuucuggauaacaucaauacaccugaagggauaauucccagcauguucgagccagaaagagagaaagucgacgcuaucgauggagaauaccggcucaggggcgaggcccgcaagaccuuuguggacuugaugagaaggggugaucugccuguuuggcucgcguauaaaguggcagccgaggggauuaacuacgcugaccggcguugguguuucgauggcaucaagaacaaucagauacuggaagagaacgucgaaguggagaucuggaccaaagagggagaacgcaagaaacuuaaaccccgauggcuagacgccagaauuuauucugauccacuggcuuugaaggaguuuaaagaguucgcagccggcaggaagucauuaacucugaaucucaucacagagauggggcggcugccuaccuucaugacacagaaaacucgcgacgcucuugauaaccuggccguacuccacacggcagaagcgggagguagagccuacaaucaugcuuuguccgagcugccggagacccuagaaacacugcuccuucugacuuuauuggccaccgugacaggcgggauuuuucuguuccucaugaguggaaggggcaucgguaagaugacccuggggaugugcugcauaauuacugcaagcacgcuucugugguaugcucagauccagccccacuggaucgccgcaucgauuauccucgaguuuuucuugauaguucuguuaauuccagaaccugagaagcagcggaccccacaagacaaccagcuaacauacgucgugaucgccauucugacuguggucgcugcgaccauggccaaugaaaugggcuuucucgagaaaacaaagaaagaccuuggacugggcucuaucgcaacccagcagccagaguccaacauauuggauaucgaccugcgaccugcuagcgccuggacucucuacgccguugcaacaacguucgugacccccaugcugagacauucaauugaaaauaguucuguaaacgugucccuuacugcuaucgccaaucaagcgacaguccucauggggcugggaaaggguuggccguugagcaaaauggauauuggcgugccacuguuagcuaucggguguuauucacagguuaacccuauuacccuaaccgccgcacugcuccuucugguggcccacuacgcuaucauaggacccggcuugcaggcaaaggccacacgcgaggcgcagaagagggcugccgcagguauuaugaaaaauccaacugucgacgggaucacgguaaucgaucuggaccccauuccuuaugauccgaaguuugaaaaacaacucggccaggugaugcugcuuauauuaugcguuacccaggugcugaugaugcggacaacuugggcccucugugaggcuuugacccuggccacaggacccaucaguacccuaugggaaggcaacccagggcguuucuggaauacuacgauugcagucagcauggcuaacaucuuuagaggauccuaccuggccggcgcgggucuccuuuucucuauuaugaagaauacaaccaacacuaggcgcgggaccggaaacaucggcgagacacugggugagaaauggaaaagccgguugaaugcccugggcaaauccgaauuucaaauauauaagaagucagggauccaggagguggaccgaacucucgcaaaagaaggaauuaagagaggcgagaccgaucaccaugcugucucuagggggagugccaaacugcgcugguucguggagcggaacaugguuacaccugaaggaaaggugguagacuuaggcugcgguagagggggauggucguacuauuguggcggucuuaaaaaugugcgugaggucaagggccugacgaaagggggacccggccacgaagaaccuaucccaaugagcaccuacggguggaaccucguuaggcuacaguccggaguggaugucuuuuucauucccccugaaaaaugcgacacucuguugugugauaucggcgagucuucaccaaaucccacaguggaggcaggucggacccugcgcguacucaaccuuguggaaaauuggcugaacaauaacacucaguucugcauaaagguuuugaauccguacaugccuagcgugauugagaaaauggaagcucugcaacgaaaguaugggggagcccucgucagaaacccauuauccaggaauaguacacaugagauguacugggugucuaacgccagcggcaauaucgucucauccgugaacaugaucagucggaugcugauuaaccgcuuuaccaugagacacaaaaaggcgacguaugaacccgacguugaccuuggcagcgggaccaggaauauaggaaucgagucugagauuccuaaccuggauaucauugguaagcgaaucgagaaaauaaagcaggagcaugaggcuuccuggcacuacgaccaggaucacccauauaaaacaugggcauaccauggcucauaugagacuaagcagaccgggagcgccucgucuaugguaaauggagugguccggcuacucacaaaacccugggacgugcugccgacuguuacccaaauggcuaugacagauaccacuccuuucggccagcagcguguguuuaaggaaaaggucgacacgagaacacaggagcccaaagaggguaccaagaaauugaugaagaucacugccgaauggcuguggaaagagcucgggaagaaaaagaccccacgcauguguacaagggaagaguucacgcggaaggugagaaguaacgcagcccuuggagcuauuuuuaccgaugagaauaaauggaaguccgcgcgcgaagccguagaggacagcagguucugggaacugguggauaaagagcgaaacuuacaccuggaaggcaagugcgagacuuguguuuacaauaugaugggcaaacgggagaagaaguugggggaauuuggaaaagcaaaggguucaagagcuaucugguacauguggcucggcgccagguuccuggaguuugaagcacuaggguuccuuaacgaggaccauugguuuucccgcgaaaauucucugagcggagucgagggcgagggucuccacaaacugggguauauuuugcgugaugugaguaagaaagaaggaggcgccauguacgcugacgacacagccggcugggauacccggaucacucuggaggaccucaagaacgaagagauggugacaaaucacauggaaggggagcauaagaaacuugcggaggcaauuuucaagcugaccuaucaaaacaaagucguuagagugcagaggccuacaccccgcggaacuguaauggauauaaucucccgacgggaccagagagguagcggccaaguggggaccuacggauuaaauacguuuaccaacauggaagcccagcugauuaggcagauggagggcgaaggugucuucaagaauauccagcacuugacagugacugaggagguugcugugcauaacuggcucgcccgcgucgggagagaacggcugucuaggauggcaaucucaggagaugacugcgugguaaaaccacuagaugaccguuucgcuaacgcccuuaccgcucugaaugauaugggcaagauucgaaaggacauacaacagugggagcccaguaaaggcuggaacgauuggacacagguuccuuuuugcucccaccauuuccacgaacucaucaugaaggacgggcgcgugcuggucgugccauguagaaaucaggaugaguugauuggacgggccaggaucagccaaggugcaggcuggucuuuacgcgaaacugcgugccuggggaaaucguaugcccagauguggucacucauguacuuucacagacgggaccuuaggcuggcugccaacgcaauuuguagcgcugugccgucccauuggguccccaccagucgaacgacauggucuauccacgccaagcaugaguggaugaccacugaggacaugcuaacaguuuggaaucguguguggauaagagaaaacccuuggauggaggauaaaaccccaguagaaagcugggaggaaauccccuaucugggaaagcgcgaggaccaguggugcggcucccucauugguuugacuucacgggcaaccugggccaagaauauccaggcggcuauuaaccaagugaggagucugaucgggaaugaggaauacacagauuacaugccuucuaugaaaagauuccgccgggaggaagaggaagccggaguccuuugguga

SEQ ID NO: 14838 - RNA, 9876 nt, Artificial Sequence
  derived and/or modified CDS sequence (opt3) from DENV-2__EU482658__SS-prME
agcgccggcaugaucauuaugcugauacccaccgugauggcuuuccaccucacuacuagaaacggggagccucauaugaucgucgguauucaagaaaaaggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacgugauaguccugggaucccaggagggcgccaugcacacagcguugacgggggccaccgaaauucagaugucaagcggaaaucuacuguuuacuggucaucucaaaugccggcugcguauggacaaacuucaacugaagggcaugaguuacucuauguguacagggaaauucaaggugguaaaagagaucgcagagacccagcacggaacaaucguuauucgcgugcaguaugaaggcgaugguuccccaugcaagauccccuucgagauuauggacuuggagaagagauacguccucgggaggcugauaacugugaacccgaucgucaccgagaaggauagcccugugaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacaaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggcccaggaagagggcauuugugguaucagaucugugacuaggcucgagaaucugauguggaaacagauuacacccgaauuaaaccacauccuggcagagaaugaagucaagcuaaccauaaugacuggcgauaucaaagggauuaugcaagccggaaagcggucgcuccgcccucagccaaccgagcugaaguacagcuggaaaacauggggcaaggcuaaaaugcuuuccacggaaucauauaaccagaccuucuugaucgacgggccggagacuacagagugccccaauaccaacagagccuggaauagucuggaaguugaggauuacggauuuggcguguucacaacuaacauuuggcucaagcugaaagaaaagcaggacgcauuuugugacucuaaguuaaugagcgcggcuaucaaagauaauagggccgugcaugcagacauggguuauuggauagaguccgcccugaacgauaccuggaagauugagaaggcuucauucaucgaaguaaagaauugccacuggccuaaaagccauacgcuuuggucuaacggggucuuggaguccgaaaugaucauuccaaagaaccucgccggacccgugagucaacacaauuaccguccuggcuaccacacacagaucgcagguccauggcaucugggcaagcuagagauggacuucgauuuuugugacgggaccacuguuauugugaccgaagauugcggaaaccggggccccagccugcgaacaacuaccgcuucugggaaacucauaacagaguggugcuguagauccugcacgcugccgccucuuagguaucgcggagaggacggcuguugguacgguauggaaauccggccauugaaggagaaagaagagaaucuggucaacucauuagugaccgccgggcacggacagguugauaauuucagucucggcgugcuggguauggcgcuuuuucuggaagagauguugagaacuaggguaggcacaaagcaugccauucuccuggucaccgugagcuucgugacucuaaucacagggaacaugucguuuaaagaccugggacgcgucguugugaugguaggcgcuaccauggcagaugacauugggaugggagugacguaucucgcccugcuugcugccuucaagguccgacccacuuuugcagcgggcuugcuguuacggaagcucaccuccaaagagcugaugaugacaaccaucgguauagugcuucugucucaaagcacuaucccugaaacaguucuagagcucaccgaugcccuggcuuuggggaugauggugcugaagauuguccguaauauggaaaaauaccaguuagccgugacaaucauggcaauucucugcguucccaacgcugugauccugcagaaugccuggaaggucucauguacuauacuugcaguagugaguguuuccccacuguugcucaccucuagccagcagaaaacggacuggauuccucuggcccuaacaaucaagggacugaaccccaccgcuaucuuccuuacuacccucuccagaacaaauaaaaagaggucauggccacugaacgaggcgauuauggccgugggcauggucagcauauuggcaaguucucuguuaaagaaugacaucccgaugacuggcccucucguggcugggggacugcuuaccguaugcuaugugcugacgggucgcuccgccgauuuggaacucgagcgggccacagacgucaaaugggaggaucaggcugaaauuagcggcucgucacccauccugucuauuaccaucagugaggacggguccaugagcauaaagaacgaagaggaggaacagacucuaacaauccugauuagaaccggacuucucguuaucucuggccuguuuccaauuagcauccccauaacugcagccgcgugguacuugugggaggugaaaaagcagagggcugguguguuaugggaugucccuuccccacccccuauggggaaagccgaacuggaggacggagcauaucgaauuaagcaaaagggcauccucggcuacucacagaucggggccggaguguacaaagaagguacauuccacaccauguggcauguuacgcgcggcgcuguacugaugcacaaggggaaacggauugagccgaguugggcagaugugaagaaagaccuuaucagcuauggaggcgguuggaagcuggagggggaauggaaggagggagaagagguccagguguuggcccuagaaccaggcaaaaaucccagagcgguucagacuaagccuggccuguuuaaaaccaacacagggaccauaggagcugugucucucgauuucuccccagguacaucaggcagucccauuaucgacaagaaagggaaggucgugggacuguacggcaacgguguagucacuaggagcggggccuauguguccgcaauugcccaaaccgagaagucuaucgaggauaauccugaaauagaggacgauauuuuucguaaacgccggcuuacgaucauggacuuacacccgggagcuggcaagacaaaaagauaccugcccgccaucguuagggaagcaauuaagcgaggccuccggacuuugauccuggcuccaacccgcguggucgccgcggagauggaagaggcccucagagggcugccuauuagguaucagacacccgcaauacgggcugagcauaccggacgagaaaucguggaccuuaugugucacgccacuuucaccaugagacuguugucgccaguucgcgugccuaacuacaaucuaauuaucauggaugaggcucauuucacagaccccgcaagcaucgccgccagggguuauauuucaacgcgugucgaaaugggcgaggcugcggggauauuuaugacugcaaccccaccgggaucccgggauccuuucccccagaguaacgccccaaucauugacgaggaaagagagauccccgaaaggucuuggaauagcggccacgagugggugacagauuuuaaagguaagaccguaugguucgugccuuccauuaaggcugggaacgacaucgccgcaugccugcgcaaaaauggaaagaaaguuauacaacucucacgaaagacuuuugauucugaauacgucaaaacaagaaccaacgacugggauuucguggugacgacugacaucagcgagaugggcgccaauuuuaaggcugagcgggucauugauccaaggcgcuguaugaaacccguaaucuuaacagacggcgaagaacgugugauucuggcggggccuaugccgguuacccauaguuccgccgcacagagacggggaaggaucggucgcaacccaaagaaugaaaacgaccaguacauauauaugggcgagccccuugaaaaugaugaggacugcgcucacuggaaggaggccaaaaugcugcucgauaacauuaauaccccugaagggaucauucccagcauguucgagccagaacgagagaagguggacgcaaucgauggagaauacagauugcggggcgaggccaggaaaacuuuugucgaccugaugcgcagaggugaucucccuguguggcuggcuuauaagguugccgcggaggggauaaacuacgcagacaggcggugguguuucgauggcaucaaaaacaaucagauucuugaagagaacguggaagucgagaucuggacaaaggagggagaacguaagaaacuaaagccccgcuggcuggacgcccgaauuuauucugauccauuggcuuuaaaagaguuuaaggaguucgccgcuggcagaaaaucacugacccucaaucugaucacagagauggggaggcuuccuacuuucaugacgcaaaagacccgggacgcacuggauaaccucgccguguugcacacagcugaagccggaggucgcgcauacaaucaugcgcuguccgagcuaccggagacucuggaaacccuccuucuguuaacauugcuggccaccguaacuggcgggauauuucucuuccugaugaguggaagaggcauugguaagaugacgcuugggaugugcugcaucaucaccgcuagcauucugcucugguaugcccagauccagccccacuggauagcagcuucgauuaucuuggaguuuuuccugauuguguuacuaaucccagaaccugagaaacagaggacaccccaagacaaccagcugacuuacguugucauagccauccucaccgugguggcagccacaauggcuaaugaaaugggcuuucuugagaagaccaaaaaggaccugggauugggcucuauugcgacucagcagccagaguccaacauccuggauauugaccuccggccugccagcgcauggacacuguacgcugucgccacgaccuucguuacucccaugcuucgacauucaaucgaaaauaguucugugaacguaucccucacagccauugcaaaucaagcuaccgugcugaugggguugggaaaagguuggccgcugagcaagauggauaucggcgucccauuacuagccauaggguguuauucacaggugaacccuauuacccugacagcggcucuccuucuguugguugcccacuacgcaaucaucggacccggccugcaggccaaggcuacuagagaggcacagaaacgcgccgcggcugguauuaugaagaauccaacgguggacgggauaaccgucaucgaucucgaccccauuccuuaugauccgaaauuugaaaagcaacugggccagguaaugcuuuuaauccugugcgugacacagguucucaugaugaggacuaccugggccuugugugaggcacugacacuagccaccggacccauuaguacucugugggaaggcaacccagggcgguucuggaauacgacaaucgcugugagcauggccaacauauuucguggauccuaccucgcaggcgcuggucuucuguucucuaucaugaaaaauaccacuaacaccagaagggggacaggaaacauuggcgagacuuugggugagaaguggaaaagccgccugaaugcccucggcaaguccgaauuucaaaucuauaagaaaucagggauucaggaggucgaccggacccuggcgaaggaaggaaucaaacgaggcgagacagaucaccaugccgugucuagagggagugcaaaguuaaggugguucgucgagcgcaacauggugacgccugaaggaaaaguuguggaccuuggcugcgguagagggggauggucguacuauuguggcggucugaagaauguaagagaggugaagggccucaccaaagggggacccggccacgaggaaccuauaccaaugagcacuuacggguggaaccuaguccgucugcaguccggaguugauguguuuuucauucccccugaaaagugcgacacauugcugugugauaucggcgagucuucaccaaaucccaccgucgaggcugguaggacucuccgggugcuuaaccugguagaaaauugguugaacaauaacacacaguucugcaucaaagugcugaauccguacaugccuagcguuauugagaagauggaagcccuccaacgcaaauaugggggagcauuagugcgaaacccacuguccagaaauaguacccaugagauguacugggucucuaacgcuagcggcaauauagugucauccgucaacaugaucaguaggaugcuuauuaaccgguuuacgaugcgccacaagaaggccaccuaugaacccgacguggaccugggcagcgggacaagaaauaucggaauugagucugagaucccuaaccuagauauaaucgguaaaaggauugaaaagaucaaacaggagcaugaaacuuccuggcacuacgaccaggaucacccauauaagaccugggccuaccauggcucauaugagacaaaacagacugggagcgcgucgucuaugguuaauggaguagugcgacuccugaccaagcccugggacgucuugccgacagugacccaaauggcuaugacugauacgacaccuuucggccagcagcggguuuuuaaggaaaaaguggacacccguacucaggagcccaaggaggguaccaaaaagcugaugaaaauuacagcagaauggcucuggaaggagcuugggaaaaagaagacgccaagaauguguacccgcgaagaguucacuaggaaaguccggaguaacgccgcucugggagccaucuuuacagaugagaauaaguggaaauccgcaagagaagccguggaggacagccgcuucugggaauuaguagauaaggagaggaaccugcacuuggaaggcaaaugcgagaccuguguguacaauaugaugggcaagcgagagaagaaacucggggaauuuggaaaggcuaaagguucacgggcgauuugguacauguggcugggcgccagauuccuagaguuugaagcacuuggguuccugaacgaggaccauugguuuuccagggaaaauucucucagcggaguugagggcgagggucugcacaaguugggguauauacugcgcgaugucaguaaaaaggaaggaggcgcuauguacgccgacgacacugcaggcugggauacacguaucacccucgaggaccuuaagaacgaagagauggugacaaaucacauggaaggggagcauaaaaagcuggccgaggcuauuuucaaauuaacuuaucaaaacaaggugguccggguucagagaccuacccccaggggaacggugauggauaucaucucccgccgagaccagcgggguagcggccaaguagggaccuacggacugaauacauuuacuaacauggaagcccaguugauuagacagauggagggcgaagguguguucaaaaauauacagcaccucaccgucacagaggagguggcgguucaaaacuggcuggcaaggguggggcgcgaaagacuaucucggauggccaucucaggagaugacugcgucgugaagccacuugaugacagguucgcuaacgcccugacugcacucaaugauaugggcaagauucguaaagacauccagcagugggagcccaguaagggcuggaacgauuggacccagguaccuuuuugcucccaucacuuccaugaacugauuaugaaagacgggcgaguuuugguggucccaugucgcaaucaagaugaguuaaucggacgggcucggauaagccagggugccggcuggucucugagggaaacggcuugccucgggaagucguaugcccagauguggucacuuauguacuuucaccgcagagaccugcggcuagcagcgaacgccaucuguagcgcugugccgucccacugggugcccacaaguaggaccacuuggucuauucaugccaaacacgaguggaugacaaccgaggacaugcugacugucuggaaucgaguuuggauccgugauaacccuuggauggaagacaagaccccaguggagagcugggaagagauucccuaucucggaaagagagaagaucaguggugcggcuccuugaucggucugacaucacgcgcaacgugggcuaaaaauauacaagccgcaauuaaccagguacggagucuuaucgggaaugaggaguacaccgacuacaugccuucuaugaagagguucagacgcgaagaggaagaggccggagugcugugguga

SEQ ID NO: 14839 - RNA, 9876 nt, Artificial Sequence
  derived and/or modified CDS sequence (opt3) from DENV-2__EU482659__SS-prME
agcgccggcaugauaauuaugcugauacccaccgugauggcuuuccaccucacuacuagaaacggggagccucauaugaucgucgguauucaagaaaaaggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacuacagagugccccaauaccaacagagccuggaauagucuggaaguggaggauuacggauuuggcguguucacaacuaacaucuggcucaagcugaaagaaaagcaggacgcauuuugugacucuaaguuaaugagcgcggcuauuaaagauaauagggccguacaugcagacauggguuauuggaucgaguccgcccugaacgauaccuggaagauagagaaggcuucauucauugaagucaagaauugccacuggccuaaaagccauacgcuuuggucuaacgggguguuggaguccgaaaugaucaucccaaagaaccucgccggacccguuagucaacacaauuaccguccuggcuaccacacacagauugcagguccauggcaucugggcaagcuagagauggacuucgauuuuugugacgggaccacugugaucgucaccgaagauugcggaaaccggggccccagccugcgaacaacuaccgcuucugggaaacucauuacagaguggugcuguagauccugcacgcugccgccucuuagguaucgcggagaggacggcuguugguacgguauggaaauacggccauugaaggagaaagaagagaaucuggugaacucauuaguuaccgccgggcacggacagguggauaauuucagucucggcguacuggguauggcgcuuuuucuggaagagauguugagaacuagggucggcacaaagcaugccauccuccugguggcugugagcuucgucacccuaauuacugggaacaugucguuuaaagaccugggacgcguugugguaauggugggcgcaacaauggccgaugacaucgggaugggagucaccuaucucgcucugcuugccgcauucaaggugcgacccacguuugcggccggcuugcuguuacggaagcucacuuccaaagagcugaugaugaccacaauugguaucguucuucugucucaaagcaccauaccugaaacugugcuagagcucacagaugcucuggccuuggggaugaugguccugaagaucgugcguaauauggaaaaauaccaguuagcaguuaccauuauggcuauccucugcgugcccaacgccgucauucugcagaaugcauggaagguaucauguacaauccuugccgugguuaguguguccccacuguugcucacuucuagccagcagaaaaccgacuggauaccucuggcucuaacgauuaagggacugaaccccacagcgaucuuccuuaccacucucuccagaaccaauaaaaagaggucauggccacugaacgaggccaucauggcagucggcauggugagcauuuuggcuaguucucuguuaaagaaugacauaccgaugacaggcccucucguagccgggggacugcuuacugugugcuauguccugaccggucgcuccgccgauuuggaacucgagcgggcuacggacguuaaaugggaggaucaggcagaaaucagcggcucgucacccauucugucuaucacaauuagugaggacggguccaugagcaucaagaacgaagaggaggaacagacccuaacuauacugaucagaacaggacuucucgugauuucuggccuguuuccaaucagcauucccaucaccgccgcggcuugguacuugugggaggugaaaaagcagagggccggugucuuaugggaugugccuuccccacccccuauggggaaagcagaacuggaggacggagccuaucgaauaaagcaaaagggcauucucggcuacucacagaucggggcuggaguuuacaaagaagguacuuuccacacaauguggcauguaacccgcggcgcagugcugaugcacaaggggaaacggaucgagccgaguugggccgaugucaagaaagaccuuauuagcuauggaggcgguuggaagcuggagggggaauggaaggagggagaagaggugcagguuuuggcgcuagaaccaggcaaaaaucccagagcugugcagacgaagccuggccuguuuaaaacuaacaccgggacaaucggagccgucucucucgauuucuccccagguaccucaggcagucccauaauugacaagaaagggaaggugguaggacuguacggcaacggugucgugacaaggagcggggcauauguuuccgccaucgcucaaacugagaagucuauugaggauaauccugaaaucgaggacgauauauuucguaaacgccggcuuaccauuauggacuuacacccgggagccggcaagacgaaaagauaccugcccgcaaucgugagggaagcuaucaagcgaggccuccggacauugauucuggccccaacucgcgucguggcggccgagauggaagaggcacucagagggcugccuaucagguaucagacccccgcuauucgggccgagcauacaggacgagaaauaguugaccuuaugugucacgcuaccuucacuaugagacuguugucgccagugcgcgucccuaacuacaaucuaaucauuauggaugaggcacauuucaccgaccccgccagcaucgccgcuagggguuauaucucaacacguguggaaaugggcgaggcggcagggauuuuuaugacggccacuccaccgggaucccgggauccuuucccccagaguaacgcuccaauaaucgacgaggaaagagagauucccgaaaggucuuggaauaccggccacgaguggguaacagauuuuaaagguaagaccgugugguucguuccuagcaucaaggccgggaacgacauugcagccugccugcgcaaaaauggaaagaaagucauccaacucucccgaaagacuuuugauucagaauacgugaaaacaagaaccaacgacugggauuucguggucacgacugacauaucugagaugggcgcuaauuuuaaggcggagcggguaaucgauccaaggcgcuguaugaaacccgugauuuuaacagacggcgaagaacguguuauccuggccgggccuaugccggugacccauagcagugcagcucagagacggggaaggauuggucgcaacccaaagaaugaaaacgaccaguacaucuauaugggcgagccccuugaaaaugaugaggacugcgcccacuggaaggaggcaaaaaugcugcucgauaacauaaauaccccugaagggauuauccccuccauguucgagccagaacgagagaaggucgacgccauugauggagaauacagauugcggggcgaggcuaggaaaacuuuuguggaccugaugcgcagaggugaucucccuguuuggcuggccuauaagguggcggcagaggggaucaacuacgccgacaggcggugguguuucgauggcaucaaaaacaaucagauccuugaagagaacgucgaaguggagauuuggacaaaggagggagaacguaagaaacuaaagccccgcuggcuggacgcucgaaucuauagcgauccauuggccuuaaaagaguuuaaggaguucgcugcaggcagaaaaucucugacccucaaucugauuacagagauggggaggcuuccuacuuucaugacgcaaaagacccgggacgcccuggauaaccucgcuguauugcacacagccgaagcaggaggucgcgcguacaaucaugcccugucagagcuaccggagacucuggaaacccuccuucuguuaacauugcuggcuaccgugacuggcgggaucuuucucuuccugauguccggaagaggcauagguaagaugacgcuugggaugugcugcauuaucaccgccaguauccugcucugguaugcacagauucagccccacuggaucgcugccagcauaauuuuggaguuuuuccugaucguuuuacuaauuccagaaccugagaaacagaggacaccccaagacaaccagcugacuuacgucgugaucgcaauacucaccguggucgccgcuacaauggcgaaugaaaugggcuuucuugagaagaccaaaaaggaccugggauugggcucgaucgccacucagcagccagagucuaacauucuggauaucgaccuccggccugcauccgcuuggacacuguacgccguugccacgaccuucgugacucccaugcuucgacauagcauugaaaauucaaguguaaacgugucucucacagcaaucgcuaaucaagccaccguccugaugggguugggaaaagguuggccgcuguccaagauggauauuggcgugccauuacuagcgaucggguguuauagccagguuaacccuauaacccugacagcugcccuccuucuguugguggcacacuacgccauuaucggacccggccugcaggcuaaggcaacuagagaggcccagaaacgcgcggcugccgguaucaugaagaauccaacggucgacgggauuaccguaauagaucucgaccccaucccuuaugauccgaaauuugaaaagcaacugggccaggugaugcuuuuaauucugugcguuacacaggugcucaugaugaggacuaccugggcauugugugaggcccugacacuagcuaccggacccaucucaacucugugggaaggcaacccagggcgguucuggaauacgacaauugccgucaguauggcaaacaucuuucguggaagcuaccucgcuggcgccggucuucuguucuccauaaugaaaaauaccacuaacaccagaagggggacaggaaacaucggcgagacuuugggugagaaguggaaaucucgccugaaugcgcucggcaagagcgaauuucaaauuuauaagaaauccgggauccaggagguggaccggacccuggccaaggaaggaauuaaacgaggcgagacagaucaccaugcagucucaagagggucugcuaaguuaaggugguucguggagcgcaacaugguuacgccugaaggaaaagugguagaccuuggcugcgguagagggggauggaguuacuauuguggcggucugaagaaugugagagaggucaagggccucaccaaagggggacccggccacgaggaaccuaucccaaugucgacuuacggguggaaccuaguucgucugcagagcggaguggaugucuuuuucauacccccugaaaagugcgacacauugcugugugauauuggcgaguccucuccaaaucccaccguggaggccgguaggacucuccggguacuuaaccugguggaaaauugguugaacaauaacacacaguucugcaucaaaguucugaauccguacaugccuucagugaucgagaagauggaagcacuccaacgcaaacaugggggagcuuuaguccgaaacccacugagcagaaauuccacccacgagauguauugggugaguaacgccucuggcaauauugucagcucagugaacaugauauccaggaugcuuaucaaccgguuuacgaugcgccauaagaaggccaccuacgaacccgacguugaccugggcagugggacaagaaauauuggaaucgagagcgagauuccuaaccuagauaucauagguaaaaggaucgaaaagauuaaacaggagcacgaaacuucuuggcacuaugaccaggaucauccauacaagaccugggcguaucacggcuccuacgagacaaaacagacugggucagcuagcucgaugguaaauggagugguccgacuccugaccaagcccugggacguguugccgacaguuacccaaauggcaaugacugauacgacaccuuucggccagcagcggguguuuaaggaaaaagucgacacccguacucaggagcccaaggaggguaccaaaaagcugaugaaaaucacagccgaauggcucuggaaggagcuugggaaaaagaagacgccaagaauguguacccgcgaagaguucacuaggaaagugcggucuaacgcugcccugggagcaauuuuuacagaugagaauaaguggaaaagugccagagaagcuguagaggacucccgcuucugggaauuaguggauaaggagaggaaccugcauuuggaaggcaaaugcgagaccuguguuuauaauaugaugggcaagcgagagaagaaacucggggaauuuggaaaggcgaaagguagccgggccaucugguacauguggcugggcgcaagauuccuagaguuugaagcucuuggguuccugaacgaggaccacugguuuucaagggaaaauucccucucuggagucgagggcgagggucugcacaaguugggguacauucugcgcgaugugagcaaaaaggaaggaggcgccauguaugcagacgacacugccggcugggauacacguauaacccucgaggaccuuaagaacgaagagauggugacaaaucauauggaaggggagcacaaaaagcuggcugaggccaucuucaaauuaacuuaccaaaacaaggucguucgggugcagagaccuacccccaggggaacgguaauggauauuaucagucgccgagaccagcgggguuccggccaaguggggaccuauggacugaauacauuuacuaacauggaagcgcaguugaucagacagauggagggcgaaggugucuucaaaaauauucagcaucucaccgugacagaggagguugcagugcaaaacuggcuggccagggucgggcgcgaaagacuaagccggauggcuauaucuggagaugacugcgugguaaagccacuugaugacagguucgccaacgcacugacugcucucaaugauaugggcaagauccguaaagacauucagcagugggagcccucaaagggcuggaacgauuggacccagguuccuuuuugcagucaccauuuccacgaacugaucaugaaagacgggcgaguguuggucgugccaugucgcaaucaagaugaguuaauuggacgggcccggaucucccagggugcuggcuggagccugagggaaacggccugccucgggaagucuuacgcacagauguggucgcuuauguauuuucaccgcagagaccugcggcuagcggccaacgcuauauguucagccgugccgagccauuggguccccacauccaggaccacuuggaguauccacgcaaaacaugaguggaugacaaccgaggacaugcugacuguuuggaaucgaguguggauucgugaaaacccuuggauggaggauaagaccccaguagaaucuugggaggaaauccccuaccucggaaagagagaggaccaguggugcggcagcuugauuggucugacaucccgcgcuacgugggccaaaaauauccaagcagccauaaaccaggugcggucacuuauuggggaugaggaauauaccgacuacaugccuaguaugaagagguucagacgcgaggaagaggaagcgggaguccugugguga

SEQ ID NO: 14840 - RNA, 9876 nt, Artificial Sequence
  derived and/or modified CDS sequence (opt3) from DENV-2__EU482661__SS-prME
agcgcaggaaugauaauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggccggugucuuaugggaugugccuuccccacccccuauggggaaagccgaacuggaggacggagcuuaucgaauaaagcaaaagggcauucucggcuacucacagaucggggcaggaguuuacaaagaagguaccuuccacacuauguggcauguaacacgcggcgccgugcugaugcacaaggggaaacggaucgagccgaguugggcggaugucaagaaagaccuuauuagcuauggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccaggagcggggccuauguuuccgcuaucgcccaaacagagaagucuauugaggauaauccugaaaucgagggagacauauuucguaaacgccggcuuacuauuauggauuuacacccgggcgcaggcaagaccaaaagauaccugcccgcuaucgugagggaagccaucaagcgagggcuccggacguugauucuggcgccaacacgcgucguggccgcagagauggaagaggcucucagaggacugccuaucagguaucagacucccgccauucgggcugagcauaccggucgagaaauaguugaccuuaugugucacgcaacauucaccaugagacuguugucgccagugcgcgucccuaacuacaaucuaaucauuauggacgaggcccauuucacugaucccgccagcaucgcugcgaggggcuauaucucaacccguguggaaaugggggaggcagccggaauuuuuaugacagcuacgccaccgggcucccgggacccuuucccccagaguaacgccccaauaaucgaugaggaaagagagauucccgaaaggucuuggaauagcggucacgaguggguaacugacuuuaaagggaagaccgugugguucguuccuuccaucaaggcaggaaacgauauugccgcuugccugcgcaaaaauggcaagaaagucauccaacucucacgaaagacauuugacucugaauacgugaaaaccagaacuaacgauugggacuucguggucacaaccgauauaagcgagaugggcgcgaauuuuaaggccgagcggguaaucgacccaaggcgcuguaugaaacccgugauuuuaacggauggggaagaacguguuauccuggcaggaccuaugccggugacucauaguuccgcugcccagagacgggguaggauuggccgcaacccaaagaaugaaaacgaccaguacaucuauaugggggagccccuugaaaaugacgaggauugcgcacacuggaaggaggccaaaaugcugcucgacaacauaaauacaccugaaggaauuauccccagcauguucgagccagaacgagagaaggucgaugcuauugacggcgaauacagauugcggggugaggccaggaaaaccuuuguggaucugaugcgcagaggggaccucccuguuuggcuggcguauaagguggcagccgagggcaucaacuacgcugauaggcggugguguuucgacggaaucaaaaacaaucagauccuugaagagaacgucgaaguggagauuuggaccaaggagggcgaacguaagaaacuaaagccccgcuggcuggaugcccgaaucuauucugacccauuggcuuuaaaagaguuuaaggaguucgcagccgggagaaaaucacugacucucaaucugauuacagagaugggaaggcuuccuaccuucaugacacaaaagacucgggaugcucuggacaaccucgccguauugcacacggcagaagcggguggccgcgccuacaaucaugcucuguccgagcuaccggagacccuggaaacacuccuucuguuaacuuugcuggccaccgugacagggggaaucuuucucuuccugaugaguggcagagguauagggaagaugacccuuggcaugugcugcauuaucacugcaagcauccugcucugguaugcucagauucagccccacuggaucgccgcaucgauaauuuuggaguuuuuccugaucguuuuacuaauuccagaaccugagaaacagaggacgccccaagauaaccagcugaccuacgucgugaucgccauacucacaguggucgcugcgacuauggccaaugaaaugggauuucuugagaagaccaaaaaggaccugggcuuggggucuaucgcaacacagcagccagaguccaacauucuggacaucgaucuccggccugcuagcgccuggacccuguacgccguugcaacuacauucgugacgcccaugcuucgacauucaauugaaaauaguucuguaaacgugucccucaccgcuaucgccaaucaagcgacuguccugaugggauuggguaaaggcuggccgcugagcaagauggacauuggggugccauuacuagcuaucggauguuauucacagguuaacccuauaacacugaccgccgcacuccuucuguugguggcccacuacgcuauuaucggccccggucugcaggcaaaggccaccagagaggcgcagaaacgcgcugccgcagggaucaugaagaauccaacagucgauggcauuacuguaauagaccucgaucccaucccuuaugacccgaaauuugaaaagcaacugggacaggugaugcuuuuaauucugugcguuacacaggugcucaugaugaggaccacaugggccuugugugaggcucugacucuagccaccggccccaucaguacacugugggaagggaacccaggacgguucuggaauaccacuauugcagucagcauggcuaacaucuuucguggcuccuaccucgccggugcggggcuucuguucucuauaaugaaaaauacgacaaacaccagaaggggaacuggcaacaucggugagaccuugggcgagaaguggaaaagccgccugaaugcccucgggaaguccgaauuucaaauuuauaagaaaucaggaauccaggagguggaucggacacuggcaaaggaaggcauuaaacgaggggagacugaccaccaugcugucucuagaggaagugccaaguuaaggugguucguggagcgcaacaugguuaccccugaaggcaaagugguagaucuugguugcgggcggggaggcuggucguacuauugugguggccugaagaaugugagagaggucaaggggcucacaaaaggaggccccgggcacgaggaaccuaucccaaugagcacguacggauggaaccuaguucgucugcaguccggcguggacgucuuuuucauacccccugaaaagugcgauaccuugcugugugacauuggugagucuucaccaaaucccacuguggaggcagggaggacacuccggguacuuaaccugguggaaaauugguugaacaauaacacccaguucugcaucaaaguucugaauccguacaugccuagcgugaucgagaagauggaagcucuccaacgcaaauauggaggcgccuuaguccgaaacccacuguccagaaauaguacucaugagauguacugggugucuaacgccagcggcaauauugucucauccgugaacaugauaaguaggaugcuuaucaaccgguuuacaaugcgccacaagaaggcgaccuaugaacccgauguugaccuggggagcggaacgagaaauauugguaucgagucugagauuccuaaccuagacaucauaggcaaaaggaucgaaaagauuaaacaggagcaugaaaccuccuggcacuacgaucaggaccacccauauaagacaugggcuuaccaugggucauaugagacuaaacagaccggaagcgcaucgucuaugguaaauggcgugguccgacuccugacaaagcccugggauguguugccgacuguuacccaaauggccaugacagacaccacuccuuucggucagcagcggguguuuaaggaaaaagucgauacgcguacacaggagcccaaggaggggaccaaaaagcugaugaaaaucacugcugaauggcucuggaaggagcuuggcaaaaagaagaccccaagaauguguacacgcgaagaguucacgaggaaagugcggaguaacgccgcacugggcgccauuuuuaccgacgagaauaaguggaaauccgcuagagaagcgguagaggauagccgcuucugggaauuaguggacaaggagaggaaccugcacuuggaaggcaaaugcgagacuuguguuuacaauaugauggggaagcgagagaagaaacucggagaauuugguaaggccaaaggcucacgggcaaucugguacauguggcugggggcuagauuccuagaguuugaagcccuuggauuccugaacgaggaucauugguuuuccagggaaaauucucucagcggcgucgagggugaggggcugcacaaguugggauauauucugcgcgacgugaguaaaaaggaaggcggcgcaauguacgccgaugacacagcugggugggacacccguauaacucucgaggaucuuaagaacgaagagauggugacaaaucacauggaaggagagcauaaaaagcuggccgaggcgaucuucaaauuaaccuaucaaaacaaggucguucgggugcagagaccuacacccagggguacuguaauggacauuaucucccgccgagaucagcggggcagcgggcaagugggaaccuacggccugaauacguuuaccaacauggaagcacaguugaucagacagauggagggugaaggggucuucaaaaauauucagcaccucacagugacugaggagguugccgugcaaaacuggcuggcuagggucggacgcgaaagacuaucucggauggccauaucaggcgacgauugcgugguaaagccacuugacgauagguucgcaaacgcucugaccgcccucaaugacaugggcaagauccguaaagauauucagcagugggagcccaguaagggguggaacgacuggacacagguuccuuuuugcucccaucacuuccaugaacugaucaugaaagauggacgaguguuggucgugccaugucgcaaucaagacgaguuaauugguagagcucggaucagccagggcgccggguggucucugagggaaacugcaugccucggaaagucguaugcgcagauguggucacuuauguacuuucaccgcagagaucugcggcuagccgcuaacgccauauguagcgcagugccgucccacuggguccccaccaguaggacgacauggucuauccaugcuaaacacgaguggaugaccacugaggacaugcugacaguuuggaaucgaguguggauucgugaaaacccuuggauggaggacaagaccccaguagaaagcugggaggaaauccccuaucucggcaagagagaggaucaguggugcgguuccuugauugggcugacuucacgcgccaccugggccaaaaauauccaagccgcgauaaaccaggugcggagucuuauuggaaaugaggaauacacagacuacaugccuucuaugaagagguucagacgcgaggaagaggaagcuggcguccugugguga

SEQ ID NO: 14841 - RNA, 9876 nt, Artificial Sequence
  derived and/or modified CDS sequence (opt3) from DENV-2__EU482662__SS-prME
accgcaggagugaucauuaugcugauacccaccgcuauggcauuccaccucacuacgagaaacggggaaccucauaugaucgucgggaggcaggaaaaagguaaaagccuucuguuuaagaccgaggacggcguuaauaugugcacauugauggcaauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguggcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccaucggcacgacucacuuucagaaggcacucauuuucauccugcugacagccguggcuccauccaugaccaugcgcugcauagggauuucuaacagagauuuuguugaaggagugucggguggcucaugggucgacaucgugcucgagcacgggagcuguguaacuacaauggccaagaauaaacccaccuuagauuucgaacugauuaagacggaggcgaaacagccugcaacccuuaggaaguauugcaucgaagccaaauugacaaacacuaccacagagagucgguguccaacucaaggagagcccucccugaaugaagaacaggacaagcgcuuuguuugcaagcauucuaugguggaucgaggcugggguaacggguguggacuauucggcaaaggcgggaucguaaccugcgcuauguuuacaugcaagaaaaauauggaaggaaagauugugcagccugagaaccucgaauacaccauagugaucacuccacacagcggugaggagcaugccgucggcaaugacacggggaaacacggaaaggaaauuaaaaucacaccgcaguccucaauaaccgaggcagaacugacuggcuaugguaccguuacaauggaguguagucccagaaccgggcuugauuucaacgaaauggugcuguugcaaauggaggacaaggcuuggcucguacacaggcagugguuucuggauuuaccucugccauggcuccccggcgccgacacucagggaagcaauuggauucagaaggagacacuugugacguucaaaaacccucaugcgaagaaacaagacgucgugguucugggcucucaggaaggggccaugcacaccgcauugacuggagcuacagagauccagauguccucagguaaucuacuguuuaccggccaucucaagugccggcugcguauggauaaacuucaacugaaggggaugagcuacaguauguguacaggaaaguucaaaaucgugaaggaaauugccgagacucagcacggcaccaucgucauucgcgugcaguaugagggugacgggucuccaugcaaaauacccuucgaaaucauggauuuggagaagagacauguacucggcaggcugauuacgguuaacccgaucgugaccgaaaaagacuccccugucaacaucgaggcugaacccccauuuggagauagcuacauuauaaucggcguggagccugggcaguuaaagcugaauugguucaagaaaggaucgucuauuggucaaauguuugagacaacuaugcggggcgccaagcgaauggcaauccuaggggacaccgccugggauuucggaucccucggcggugucuuuacaucaauugggaaagcucugcaccagguguucggcgcgaucuacggagcagccuuuaguggcguuagcuggacuaugaagauacuuaucggggcuauuaucaccuggauuggaaugaacucccgcucuacgagcuugucagugagucugguacucgucggcgugaucacacuguaucuuggugccaugguucaggcagacuccggguguguggucagcuggaaaaauaaggaacugaagugcggaucuggcauauucauuaccgauaacgugcacacuuggacagagcaguacaaauuucaacccgaaucaccaaguaaguuggccagcgcuauccagaaagcccaugaggaagguauuuguggcaucagauccguaaccaggcucgagaaucugauguggaagcagauaacucccgaguuaaaccacauccugucugaaaaugaggugaaacuaaccauuaugacaggggacaucaagggaauuaugcaggcaggcaaacggucgcuccgcccucaaccaacggaacugaaguauagcuggaagaccugggggaaagcgaagaugcuuuccacugagucacauaaccagacauucuugaucgauggaccggaaaccgcugagugccccaauacaaacagagccuggaauagucuggagguugaagacuacggcuuuggugucuucacuaccaacauauggcucaaacugagggagaagcaggacguguuuugugauucuaaauuaaugagcgcagccauuaaggacaaucgugcugugcacgccgauaugggguauuggaucgaauccgcacugaacgacacguggaagauggagaaggcuucauucaucgaggucaagagcugccacuggccuaaaucucauacacuuugguccaauggaguuuuggaaagugagaugauuaucccaaagagcuucgccggccccgugucucagcacaacuaccggccugguuauuacacccaaacugcgggcccauggcaucucgggaaacuggaaauggauuuugacuucugugagggaaccacagugguagucacugaagauugcggcaaccgagggcccucccuaagaaccacaacggccucaggaaagcugauuaccgaguggugcuguaggaguugcacucucccgccucugcgcuaccggggcgaggacgguuguugguaugggauggaaauaagaccacuuaaggagaaagaagagaauuuggugaacagccugguuacagcuggacacggccagaucgauaauuuuucguuaggugugcucggcauggcacuguuccuugaagagaugcugaggacccgcgucgggacuaagcaugccauuuugcucguggcuguuuccuuuaugacacugaucaccggaaacaugucuuuccgagaccuaggccgggugaugguaauggucggggccacgaugacugaugacauuggaaugggcgugaccuaccuggcacuccuggcggccuuuaaagugcgucccacauucgcugccggucuuuugcugagaaaguuaaccagcaaagagcucaugauggcaacuaucgggauagcucugcuuucacagaguacaaucccugaaaccauucuggagcuaacagaugcccucgcacugggaaugauggucuugaagaucguuaggaauauggaaaaguaucaacuggccgugacuauuauggcuaucuccugcguacccaacgcggugauauuacagaaugccuggaaagucucuuguaccauucucgcagcugugagcguuuccccacugcuucugacgucaagccagcagaaggccgacuggaucccuuuggcccucacaaucaaaggccugaaccccaccgcuauuuuucuaacuacccugagucgcacaucuaagaaacgguccuggccacuuaaugaggcaauaauggccgugggcauggucagcauccucgcgucgucacuguugaagaacgacauuccgaugacugggccucugguggcuggagguuuacucaccguuugcuacgugcugacgggcagaucugccgaucuugaacuggagagggcaacagacgucaaaugggaggaucaagccgaaaucaguggguccagccccauuuugucuaucaccauaagcgaggacggauccaugucaaucaagaaugaagaggaggaacagacucucacaauucugauccgaaccggccuacugguaauuaguggucuuuucccagugagcauccccauaacugcugcagccugguaucucugggagguuaagaaacagcgcgcgggggugcugugggaugucccuucuccacccccugugggaaaggcugaauuggaggacggcgccuaccggauuaaacagaagggcaucuuaggguauucccaaaucggagccggugucuacaaagaaggcacauuucacaccauguggcacgugacgagaggggcaguccugaugcauaggggaaagcguauugagccgucaugggcugauguuaagaaagaccucaucaguuacggcgguggguggaagcuggagggagaauggaaagagggcgaagagguacaggugcuugcccuggaaccaggcaagaacccccgcgcaguccagacuaaaccuggguuguucaagaccaauacaggaaccauaggugcugugagccuagauuuuuccccaggcacaucugggucgcccauuguugaccggaagggaaaaguagugggccuguaugguaacggggucgugacuagaagcggagccuacguuucagcgaucgcccagaccgagaaguccauugaggauaauccugaaaucgaggacgauauauucaggaaaaagcgacucacgauuauggaccugcacccgggcgcaggcaaaacaaagcgguaucuucccgcuaucgugcgcgaagccaucaagagaggguuaaggacucugauucucgcuccaacccgggucguggcagccgagauggaagaggccuugcgaggacugccuaucagauaccaaacacccgcuauucgcgcggagcauaccgguagggaaauaguagaccucaugugucacgcaacuuucaccaugcgucugcuuaguccaguccgggugccuaacuauaaccugaucauuauggaugaggcccauuuuacagaccccgcuucuaucgccgcaagaggcuacaucagcacgaggguugaaaugggggaggccgcuggaauuuucaugacugcgaccccaccgggcucccgcgauccuuuuccccagucaaaugccccaauaaucgacgaggaacgagagauucccgaaagaucuuggaacagcggucacgagugggugacagauuucaaagggaagaccgucugguuugugccuaguaucaaagcaggaaaugacauugcugccugcuugcggaagaacggcaaaaagguuauccagcuauccaggaagacuuucgauagcgaauaugugaaaacacgcaccaaugacugggauuuugucgugacgacugacauaucugagaugggcgcaaacuucaaggccgagcguguaaucgauccaagacgguguaugaaacccgugauucugacagacggggaagagaggguuauccucgcuggaccuaugccggucacccacucauccgccgcgcaacgccgagguagaauuggccggaauccaaagaacgaaaaugaccaguacaucuacaugggggagcccuuagaaaacgaugaggacugcgcacauuggaaagaggccaagaugcugcuugauaauauaaacaccccugaaggaauuauccccaguauguuugagccagaaagggagaaaguggacgcuauugauggcgaauaucgccugagaggugaggccaggaagacuuucguggaccucaugcggcguggggauuugccugucuggcuggcuuaccgcguagcagccgagggcaucaauuaugcugaccgaagaugguguuuugauggagugaagaacaaucagauacucgaagagaacguugaaguggagaucuggacaaaagagggcgaaaggaagaaacugaagccccgguggcuugacgcccgcauuuacagcgauccacuagcacugaaagaguucaaggaguucgcggccgggagaaagucguugaccuuaaaccugaucacagagaugggaaggcucccuacuuuuaugacgcagaaagcucgggacgcccuggauaaucuugcaguccugcacaccgcugaagccgguggccgagcauauaaccaugcccucucugaguugccggagacacuggaaacucuacugcuccuuacccuguuagcuacagugaccgggggaauuuucuuguuucugauguccggcaaggguguugggaaaaugacucucggcaugugcugcaucauaacggcgagcauucugcuuugguacgcccaaauccagccccacuggaucgcagcuucaauuauccuggaguucuuucucauaguguugcugauuccagaaccugagaagcagagaacaccccaggacaaucaauuaacauaugucgugaucgccauucuaacuguaguggccgcaaccauggcuaacgaaaugggauuccuggagaaaacaaagaaggaccucggccuugggaguaucgccacccaggagccagaaucuaauauacuggauaucgacuugcgcccugcguccgcuuggacucuguacgccguugcaacaacguuugucacccccaugcucaggcacagcauugagaacucaagugugaaugugagccugacugccaucgcuaaccaggcaacaguccuuaugggacucgguaaaggcuggccgcuguccaagauggauauugggguuccauugcuggccaucggauguuacucucaggugaauccuauuaccuuaaccgcggcucuacugcuccuuaucgcccauuaugcaauaauuggccccggucugcaagccaaagcuacacgggaagcccagaagcgugcagcugccgggaucaugaaaaacccaacuguagacggcaucacggugauugauuuggaccccauaccuuacgauccgaaguucgagaagcagcugggacaggucaugcuccugauccuuugcgugacccaaguuuuaaugaugagaacaacuugggcgcugugugaagcccucaccuuggcaacaggccccauuagcacccugugggaggggaauccaggaagguuuuggaacacuacgaucgcuguguccauggccaauauuuuccgcggcucauaucuagccggugcugggcugcucuuuucuaucaugaaaaacacaaccaauacucggcgaggaaccggcaacauaggugagacacuuggcgaaaaguggaaaaguagacugaaugccuuggggaagucggaguuccagaucuacaaaaagagcggcauucaggaagucgacaggacucuggccaaagagggcaucaagcgcggggagaccgaucaccaugcgguaucccggggaucugcuaagcucagaugguuuguggaacguaacaugguuacaccugagggcaaaguggucgaccuggguugcgggaggggaggcuggucauauuacugugguggcuuaaagaacgugcgggaagucaaagggcuuacgaagggaggccccgggcacgaggaaccuauuccaaugagcaccuauggauggaaucuggugcgccuccaauccggcguugauguguucuucacucccccugagaaaugcgacacacuacugugugauaucggugagaguucuccaaaccccaccauagaagcagggcgaacuuugagaguacugagccucguggagaauuggcuuaacaaugacacacaguuuugcauuaagguccugaacccguacaugccuucaguuaucgaaaagauggagaccuugcagaggaaauacggaggcgcccuggugcggaauccacucucccgcaacaguacgcaugaaauguauugggucagcaaugcuaccggcaacaucgugucuuccguaaauaugauuucaagaauguuaauaaacagguucacaaugaagcacaaaaaggccacuuacgagcccgacguggaucuggggagcggaacccgaaauaucgguauugagucggaaaucccuaaccuugacauuaucggcaaacggauagagaagaucaagcaggaacacgagacaucuuggcauuaugaucaagaccacccauacaaaacuugggcauaucaugggaguuacgaaaccaagcagacaggauccgccagcucaaugguuaauggcgugguccgucugcuaaccaaacccugggauguggucccgauggugacucagauggcuaugacggacacaaccccuuuuggucagcaaagaguuuucaaggagaaaguagauacucgcacccaggagcccaaggaagggacaaagaaacucaugaagauuacggcggaguggcuguggaaagaauugggaaagaaaaagaccccaaggauguguacucgggaggaguuuacaagaaaagugcgcuccaacgccgcacugggcgcuaucuucaccgacgaaaacaaguggaagucugccagggaggcagucgaagauagccgauuuugggagcucguggacaaagaacggaaucuucaccuggagggcaagugcgagacuuguguuuauaacaugauggggaaaagagaaaagaaauuaggagaguucgguaaggccaagggcaguagggcuauuugguacauguggcugggggcccgcuuuuuggaguucgaggcgcucggauuucugaaugaagaucacugguucucccgugagaacagccuaucuggcguggagggugaagggcuucauaaacugggauacauccuccgggacgucucaaagaaagagggcggcgcaauguaugccgacgauacagcugggugggacaccagaauuacacuggaagauuugaagaaugaggaaauggugacuaaccacauggagggagagcauaaaaggcuggccgaagcaauauuuaagcucaccuaccagaauaagguagugcgcguucagcgaccuacgccccgggguaccgucauggacaucauuaguagaagggaucaacgcggcuccggacaggugggaacauauggccuuaacacuuucaccaauauggaggcucagcugaucagacaaauggaaggugaggggaucuucaaaagcauucagcacuuaacagugacugaggaaauagccguccagaacuggcuggcucggguuggaagggagcguuugucucgaauggccaucucgggcgacgauugcgugguaaagccacucgacgaucgcuuugcaucagcgcugaccgcccuaaaugacaugggcaaagugagaaaggauauucagcaaugggaacccagcaaaggguggaacgacuggacgcaggucccuuucugcucccaucacuuucacgagcuuaucaugaaggauggacgggugcugguugugccauguaggaaucaggacgaacucauuggucgcgcuagaaucagucagggcgccggguggucucugaaggagacagcaugcuugggaaaaagcuacgcucaaaugugguccuuaauguauuuccaucggagggaccugcgacucgccgcaaacgccauauguucagcggucccgagucacugggugcccaccucucguacuacauggagcauccaugcuaagcacgaguggaugaccacugaagauaugcuuaccguauggaauagaguuuggauucaggagaacccuuggauggaagacaaaacaccaguggaguccugggaagagguccccuaccugggcaagcgcgaggaucaguggugcgguucacuaaucgggcugacgagccgggccaccugggccaaaaacauucagacugccaucaaucaagugaggucucucauaggaaacgaagaguauacagacuacaugccuuccaugaagagauuucgccgggaagaggaagaggcuggcguguugugguga

SEQ ID NO: 14842 - RNA, 9876 nt, Artificial Sequence
  derived and/or modified CDS sequence (opt3) from DENV-2__EU482663__SS-prME
agcgccggcaugauaauuaugcugauacccaccgugauggcuuuccaccucacuacucggaacggggaaccucauaugaucgucgguauucaagaaaagggaaaaucccuucuguuuaagacggaagacggcguuaauaugugcaccuugauggcaauggauuuaggggaacugugugaggacacaaucacuuacaaaugcccacuucucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacguauuuugugacucuaaguuaaugagcgcggcuauuaaagauaauagggccguccaugcagacauggguuauuggaucgaguccgcccugaacgauacuuggaagauagagaaggcuucauucauugaagugaagaauugccacuggccuaaaagccauacccuuuggucuaacgggguuuuggaguccgaaaugaucaucccaaagaaccucgccggacccgugagucaacacaauuaccguccuggcuaccacacgcagauugcagguccauggcaucugggcaagcuagagauggacuucgauuuuugugacgggacaaccgucaucgugacugaagauugcggaaaccggggccccagccugcgaaccacaacugcuucugggaaacucauuaccgaguggugcuguagauccugcacacugccgccucuuagguaucgcggagaggacggcuguugguacgguauggaaauacggccauugaaggagaaagaagagaaucugguuaacucauuagugacggccgggcacggacagguagauaauuucagucucggcguccuggguauggcgcuuuuucuggaagagauguugagaaccagggugggcacuaagcaugccauccuccugguggcugucagcuucguuacacuaauuaccgggaacaugucguuuaaagaccugggacgcgugguagugauggucggcgcaacuauggccgaugacaucgggaugggagugacauaucucgcucugcuugccgcauucaagguucgacccaccuuugcggccggcuugcuguuacggaagcucacguccaaagagcugaugaugacuaccauugguaucgugcuucugucucaaagcacaauaccugaaaccguccuagagcucacugaugcucuggccuuggggaugauggugcugaagaucguucguaauauggaaaaauaccaguuagcagugacaauuauggcuauccucugcguccccaacgccguaauucugcagaaugcauggaaggugucauguaccauccuugccguugugagugucuccccacuguugcucacaucuagccagcagaaaacugacuggauaccucuggcucuaaccauuaagggacugaaccccacggcgaucuuccuuacaacccucuccagaacuaauaaaaagaggucauggccacugaacgaggccaucauggcagugggcaugguaagcauuuuggcuaguucucuguuaaagaaugacauaccgaugaccggcccucucguggccgggggacugcuuacagucugcuauguucugacuggucgcuccgccgauuuggaacucgagcgggcuaccgacgugaaaugggaggaucaggcagaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagccgcggcuugguacuugugggaggucaaaaagcagagggccgguguguuaugggauguuccuuccccacccccuauggggaaagcagaacuggaggacggagccuaucgaauaaagcaaaagggcauucucggcuacucacagaucggggcuggaguauacaaagaagguaccuuccacacuauguggcaugugacacgcggcgcaguccugaugcacaaggggaaacggaucgagccgaguugggccgaugugaagaaagaccuuauuagcuauggaggcgguuggaagcuggagggggaauggaaggagggagaagagguucagguguuggcgcuagaaccaggcaaaaaucccagagcuguccagaccaagccuggccuguuuaaaacgaacacugggaccaucggagccgugucucucgauuucuccccagguacaucaggcagucccauaauugacaagaaagggaagguagucggacuguacggcaacggugugguuaccaggagcggggcauauguguccgccaucgcucaaacagagaagucuauugaggauaauccugaaaucgaggacgauauauuucguaaacgccggcuuacuauuauggacuuacacccgggagccggcaagaccaaaagauaccugcccgcaaucgucagggaagcuaucaagcgaggccuccggacguugauucuggccccaacacgcgugguugcggccgagauggaagaggcacucagagggcugccuaucagguaucagacucccgcuauucgggccgagcauaccggacgagaaauaguggaccuuaugugucacgcuacauucaccaugagacuguugucgccaguccgcgugccuaacuacaaucuaaucauuauggaugaggcacauuucacugaccccgccagcaucgccgcuagggguuauaucucaacccguguagaaaugggcgaggcggcagggauuuuuaugacagccacgccaccgggaucccgggauccuuucccccagaguaacgcuccaauaaucgacgaggaaagagagauucccgaaaggucuuggaauagcggccacgagugggugacugauuuuaaagguaagaccguuugguucgucccuuccaucaaggccgggaacgacauugcagccugccugcgcaaaaauggaaagaaagugauccaacucucacgaaagacauuugauucugaauacgugaaaaccagaacuaacgacugggauuucgucguaacaaccgacauaagcgagaugggcgcuaauuuuaaggcggagcgggugaucgauccaaggcgcuguaugaaacccguuauuuuaacggacggcgaagaacgugugauccuggccgggccuaugccggucacucauaguuccgcagcucagagacggggaaggauuggucgcaacccaaagaaugaaaacgaccaguacaucuauaugggcgagccccuugaaaaugaugaggacugcgcccacuggaaggaggcaaaaaugcugcucgauaacauaaauacaccugaagggauuauccccagcauguucgagccagaacgagagaagguggacgccauugauggagaauacagauugcggggcgaggcuaggaaaaccuuuguugaccugaugcgcagaggugaucucccuguguggcuggccuauaaggucgcggcagaggggaucaacuacgccgacaggcggugguguuucgauggcaucaaaaacaaucagauccuugaagagaacguggaaguagagauuuggaccaaggagggagaacguaagaaacuaaagccccgcuggcuggacgcucgaaucuauucugauccauuggccuuaaaagaguuuaaggaguucgcugcaggcagaaaaucacugacucucaaucugauuacagagauggggaggcuuccuaccuucaugacacaaaagacucgggacgcccuggauaaccucgcuguguugcacacggccgaagcaggaggucgcgcguacaaucaugcccuguccgagcuaccggagacccuggaaacacuccuucuguuaacuuugcuggcuaccguuacaggcgggaucuuucucuuccugaugaguggaagaggcauagguaagaugacccuugggaugugcugcauuaucacugccagcauccugcucugguaugcacagauucagccccacuggaucgcugccucgauaauuuuggaguuuuuccugaucgucuuacuaauuccagaaccugagaaacagaggacgccccaagacaaccagcugaccuacguggugaucgcaauacucacagucguugccgcuacuauggcgaaugaaaugggcuuucuugagaagaccaaaaaggacuucggacugggcucuaucgccacacagcagccagaguccaacauuuuggauaucgaccugcggccugcaagcgcuuggacccucuacgccguggccacuacauuuguaacgcccaugcugcgacauucaauugaaaauaguucugugaacgucucccuuaccgcaaucgcuaaucaagccacugugcucauggggcugggaaaagguuggccguugagcaagauggauauuggcguuccacuguuagcgaucggguguuauucacaggugaacccuauaacacuaaccgcugcccugcuccuucuggucgcacacuacgccauuaucggacccggcuugcaggcuaaggcaaccagagaggcccagaaacgcgcggcugccgguaucaugaagaauccaacaguagacgggauuacugugauagaucuggaccccaucccuuaugauccgaaauucgaaaagcaacucggccagguuaugcugcuuauuuuaugcgugacgcagguccugaugaugaggaccacaugggcacucugugaggccuugacucuggcuaccggacccaucaguacacuaugggaaggcaacccagggcgguuuuggaauaccacuauugccgugagcauggcaaacaucuuccguggauccuaccuggcuggcgccggucuccuauuuucuauaaugaaaaauacgacaaacaccagaagggggacuggaaacaucggcgagacccugggugagaaguggaaaagccgcuugaaugcgcugggcaaguccgaguuccaaauuuauaagaaaucagggauccaggaggucgaccggacacucgccaaggaaggaauuaaacgaggcgagacugaucaccaugcagugucuagagggagugcuaagcugaggugguuuguugagcgcaacauggugaccccugaaggaaaaguaguggacuuaggcugcgguagagggggauggucguacuauuguggcggucuuagaaauguccgugagguuaagggccugacaaaagggggacccggccacgaagaaccuaucccaaugagcacguacggguggaaccucgugaggcuacaguccggagucgauguguucuucauacccccugaaaaaugcgacacccuguugugugauauuggcgagucuucaccaaaucccacuguagaggccggucggacacugcgcgugcucaaccuuguugaaaauuggcugaacaauaacacccaguuuugcaucaagguguugaauccguacaugccuagcgucaucgagaaaauggaagcacugcaacgaaaguaugggggagcucucgugagaaacccauuauccaggaauaguacucaugagauguacugggucucuaacgccagcggcaauauugugucauccguuaacaugauaagucggaugcugaucaaccgcuucacaaugagacacaaaaaggccaccuaugaacccgacguagaccuuggcagcgggacgaggaauauuggaaucgagucugagauuccuaaccuggauaucauagguaagcgaaucgagaaaauuaagcaggagcaugaaaccuccuggcacuacgaccaggaucacccauauaaaacaugggcguaccauggcucauaugagacuaagcagaccgggagcgcuucgucuauggugaauggagucgugcggcuacucacaaaacccugggacguucugccgacugugacccaaauggcaaugacagauaccacuccuuuuggccagcagcgugucuucaaggaaaagguggacacgagaacacaggagcccaaagaggguaccaagaaauugaugaagaucacugccgaauggcuguggaaagagcucgggaagaaaaagaccccacgcauguguacaagggaagaguuuacgcggaagguaagaaguaacgcugcccuuggagcaauuuucaccgaugagaauaaauggaaguccgcccgcgaagcuguggaggacagcagguuuugggaacugguugauaaagagcgaaacuuacaccuggaaggcaagugcgagacuugugucuacaauaugaugggcaaacgggagaagaaguugggggaguucggaaaagcgaaggguucaagagccaucugguacauguggcucggcgcaagguuucuggaguucgaagcucuaggguuucuuaacgaggaccauugguucucccgcgaaaauucucugagcggaguggagggcgagggucuccacaaacugggguauauuuugcgugaugugaguaagaaagaaggaggcgccauguacgcagacgacacagccggcugggauacccggauaacucuggaggaccucaagaacgaagagauggucacaaaucacauggaaggggagcauaagaaacuugcugaggccaucuuuaagcugaccuaucaaaacaaaguugugagaguacagaggccuacaccccgcggaacugugauggauauuaucucccgacgggaccagagagguagcggccaagucgggaccuacggauuaaauacguucaccaacauggaagcgcagcugaucaggcagauggagggcgaagguguguucaagaauauucagcacuugacaguuacugaggagguggcaguccaaaacuggcucgcccgcguggggagagaacggcugucuaggauggcuauaucaggagaugacugcguaguuaaaccacuagaugaccguuuugccaacgcacuuaccgcucugaaugauaugggcaagauccgaaaggacauucagcagugggagcccaguaaaggcuggaacgauuggacacaggugccuuucugcucccaucacuuucaugaacucaucaugaaggacgggcgcguccugguggugccauguagaaaucaagaugaguugauuggacgggccaggaucagccagggugcuggcuggucuuuacgcgaaacugccugccuggggaaaucguaugcacagauguggucacucauguacuuccacagacgggaccuuaggcuggcggccaacgcuauauguagcgccgucccgucccacuggguucccaccagucgaacgacauggucuauccaugcaaagcacgaguggaugaccacugaggacaugcuaacaguguggaaucguguauggauuagagaaaacccuuggauggaggauaaaaccccaguggaaagcugggaggaaauccccuaucugggaaagcgcgaggaccaguggugcggcucccucauugguuugacuucacgggcuaccugggccaagaauauccaagcagccauaaaccaggucaggagucugauugggaaugaggaauacaucgauuacaugccuucuaugaaaagauuucgccgggaggaagaggaagcgggagugcuuugguga

SEQ ID NO: 14843 - RNA, 9876 nt, Artificial Sequence
  derived and/or modified CDS sequence (opt3) from DENV-2__EU482664__SS-prME
accgccggagugaucauuaugcugauacccacagcuauggcauuccaccucacuacgaggaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugcguugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaagcagccugcaacccuucggaaauauugcaucgaagccaaguugacaaacacuaccacagagagucgcuguccaacucaaggagagcccucccugaaugaagaacaggacaaacgauuuguuugcaagcauucuaugguggauagaggcugggguaacggguguggacuauucggcaagggcgggaucgucacaugcgcuauguuuacaugcaaaaagaauauggaaggaaaaauugugcagccugagaaccucgaauacaccauagugaucacuccacacagcggugaggagcaugccgucggcaaugacacggggaagcacggaaaagaaauuaagaucacaccgcaguccucaauaaccgaggcagaacugacuggcuaugguaccguuacaauggaguguagucccaggaccgggcuugauuucaacgaaauggugcuguugcaaauggaggacaaggcuuggcucguacaccggcagugguuucuggauuuaccucugccauggcuccccggcgccgacacucagggaagcaauuggauucagaaggagacacuugugacguucaagaacccucaugcgaaaaagcaagacgucgugguucugggcucucaggaaggggccaugcacaccgcauugacuggagcuacagagauccagauguccucagguaaucuacuguuuaccggccaucucaaaugccgucugcgcauggauaaacuucaacugaaagggaugagcuacaguauguguacaggaaaguucaagaucgugaaagaaauugccgagacucagcacggcaccaucgucauuagagugcaguaugagggugacgggucuccaugcaagauacccuucgaaaucauggauuuggagaaaaggcauguacucggccggcugauuacgguuaacccgaucgugaccgaaaaggacuccccugucaacaucgaggcugaacccccauuuggagauagcuacauuauaaucggcguggagccugggcaguuaaaacugaauugguucaagaagggaucgucuauuggucaaauguuugagacaacuaugcgaggcgccaaacgcauggcaauccuaggggacaccgccugggauuucggaucccucggcggugucuuuacaucaauugggaaggcucugcaccagguguucggcgcgaucuacggagcagccuuuaguggcguuagcuggacuaugaaaauacuuaucggggcuauuaucaccuggauuggaaugaacuccagaucuacgagcuugucagugagucugguacucgucggcgugaucacacuguaucuuggugccaugguucaggcagacuccggguguguggucagcuggaagaauaaagaacugaagugcggaucuggcauauucauuaccgauaacgugcacacuuggacagagcaguacaaguuucaacccgaaucaccaaguaaauuggccagcgcuauccagaaggcccaugaggaagguauuuguggcaucagguccguaacccggcucgagaaucugauguggaaacagauaacucccgaguuaaaccacauccugucugaaaaugaggugaagcuaaccauuaugacaggggacaucaaaggaauuaugcaggcaggcaagcgcucgcucagaccucaaccaacggaacugaaauauagcuggaagaccugggggaaggcgaaaaugcuuuccacugagucacauaaccagacauucuugaucgauggaccggaaaccgcugagugccccaauacaaacagggccuggaauagucuggagguugaagacuacggcuuuggugucuucacuaccaacauauggcucaagcugcgugagaaacaggacguguuuugugauucuaaguuaaugagcgcagccauuaaagacaaucgggcugugcacgccgauaugggguauuggaucgaauccgcacugaacgacacguggaagauggagaaggcuucauucaucgaggucaaaagcugccacuggccuaagucucauacacuuugguccaauggaguuuuggaaagugagaugauuaucccaaaaucauucgccggccccgugucucagcacaacuaccgaccugguuauuacacccaaacugcgggcccauggcaucucgggaagcuggaaauggauuuugacuucugugagggaaccacagugguagucacugaagauugcggcaacagagggcccucccuaaggaccacaacggccucaggaaaacugauuaccgaguggugcugucgcaguugcacucucccgccucugcgguacagaggcgaggacgguuguugguaugggauggaaauaaggccacuuaaggagaaggaagagaauuuggugaacagccugguuacagcuggacacggccagaucgauaauuuuucguuaggugugcucggcauggcacuguuccuugaagagaugcugcgcacccgagucgggacuaaacaugccauuuugcucguggcuguuuccuuugugacacugaucaccggaaacaugucuuuccgggaccuaggccguguaauggucauggugggggccacgaugacugaugacauuggaaugggcgugaccuaccuggcacuccuggcggccuuuaaggucagacccacauucgcugccggucuuuugcugaggaaauuaaccagcaaggagcucaugauggcaacuaucgggauagcucugcuuucacagaguacaaucccugaaaccauucuggagcuaacagaugcccucgcacugggaaugaugguuuugaaaaucgugcgcaauauggaaaaguaucaacuggccguaacuauuauggcuaucuccugcgugcccaacgcggucauauuacagaaugccuggaaggugucuuguaccauucucgcagcuguuagcguguccccacugcuucugacgucaagccagcagaaagccgacuggaucccuuuggcccucacaaucaagggccugaaccccaccgcuauuuuucuaacuacccugagucggacaucuaaaaagagauccuggccacuuaaugaggcaauaauggccgucggcauggugagcauccucgcgucgucacuguugaaaaacgacauuccgaugacugggccucugguugcuggagguuuacucaccgugugcuacguccugacgggcaggucugccgaucuugaacuggagcgagcaacagacguaaagugggaggaucaagccgaaaucaguggguccagccccauuuugucuaucaccauaagcgaggacggauccaugucaaucaaaaaugaagaggaggaacagacucucacaauucugauccgcaccggccuacuggugauuaguggucuuuucccaguuagcauccccauaacugcugcagccugguaucucugggaggugaagaagcagcgggcggggguccugugggaugugccuucuccacccccuguaggaaaagcugaauuggaggacggcgccuacagaauuaagcagaaaggcaucuuaggguauucccaaaucggagcugguguguacaaggaaggcacauuucacaccauguggcacgucacgagaggggcaguucugaugcaucguggaaaacgcauugagccgucaugggcagaugugaagaaggaccucaucaguuacggcgguggguggaaacuggagggagaauggaaggagggcgaagaggugcagguccuugcccuggaaccaggcaaaaacccccgggcagugcagacuaagccuggguuguucaaaaccaauacaggaaccauaggugcuguuagccuagauuuuuccccaggcacaucugggucgcccauuguagacagaaagggaaagguggucggccuguaugguaacggggugguuacuaggagcggagccuacgugucagcgaucgcccagaccgagaaauccauugaggauaauccugaaaucgaggacgauauauuccgaaagaaacggcucacgauuauggaccugcacccgggcgcaggcaagacaaaacgcuaucuucccgcuaucgucagagaagccaucaagaggggguuacggacucugauucucgcuccaacccgagugguagcagccgagauggaagaggccuugagaggacugccuauccgcuaccaaacacccgcuauuagggcggagcauaccggucgugaaauagucgaccucaugugucacgcaacuuucaccaugcggcugcuuaguccagugagaguuccuaacuauaaccugaucauuauggaugaggcccauuuuacagaccccgcuucuaucgccgcaaggggcuacaucagcacgcgcguggaaaugggggaggccgcuggaauuuucaugacugcgaccccaccgggcucccgagauccuuuuccccagucaaaugccccaauaaucgacgaggaaagagagauucccgaacggucuuggaacagcggucacgagugggucacagauuucaaggggaaaaccgugugguuuguuccuaguaucaaggcaggaaaugacauugcugccugcuugaggaaaaacggcaagaaagugauccagcuaucccgcaagacuuucgauagcgaauaugucaagacacguaccaaugacugggauuuugugguaacgacugacauaucugagaugggcgcaaacuucaaagccgagagagugaucgauccacggagguguaugaagcccguuauucugacagacggggaagaacgcgucauccucgcuggaccuaugccggugacccacucauccgccgcgcaacgaagaggucggauuggcaggaaucccaaaaacgaaaaugaccaguacaucuacaugggggagcccuuagaaaacgaugaggacugcgcacauuggaaggaggccaaaaugcugcuugauaauauaaacaccccugaaggaauuauccccaguauguuugagccagaacgcgagaagguggacgcuauugauggcgaauauagacugaggggugaggcccggaaaacuuucgucgaccucaugcgucgcggggauuugccuguauggcuggcuuaccgaguggcagccgagggcaucaauuaugcugacagaaggugguguuuugauggaguuaagaacaaucagauacucgaagagaacguggaagucgagaucuggacaaaggagggcgaacggaaaaagcugaaaccccgcuggcuugacgccagaauuuacagcgauccacuagcacugaaggaguucaaagaguucgcggccgggaggaagucguugaccuuaaaccugaucacagagaugggacggcucccuacuuuuaugacgcagaaggcucgagacgcccuggauaaucuugcagugcugcacaccgcugaagccgguggcagagcauauaaccaugcccucucugaguugccggagacacuggaaacucuacugcuccuuacccuguuagcuacaguuaccgggggaauuuucuuguuucugauguccggcaaagguguggggaagaugacucucggcaugugcugcaucauaacggcgagcauucugcuuugguacgcccaaauccagccccacuggaucgcagcuucaauuauccuggaguucuuucucauagucuugcugauuccagaaccugagaaacagcgcaccccacaggacaaucaauuaacauaugugguaaucgccauucuaacugugguugccgcaaccauggcuaacgaaaugggauuccuggagaagaccaaaaaggaccucggccuugggagugucgccacccaggagccagaaucuaauauccuggauauagacuugaggccugcguccgcuuggacucuguacgccguggcaacaacguuugugacccccaugcuccggcacagcaucgagaacucaagugucaauguuagccugacugccauugcuaaccaggcaacagugcuuaugggacucgguaagggcuggccgcuguccaaaauggauaucgggguaccauugcuggccauuggauguuacucucaggugaauccuaucaccuuaaccgcggcucuacugcuccuuauugcccauuaugcaaucauaggccccggucugcaagccaaggcuacacgugaagcccagaaaagagcagcugccgggauuaugaagaacccaacugucgacggcaucacggugaucgauuuggaccccauuccuuacgauccgaaauucgagaagcagcugggacagguuaugcuccugauacuuugcgugacccaagucuuaaugaugaggacaacuugggcgcugugugaagcccucaccuuggcaacaggccccaucagcacccugugggaggggaauccaggacgcuuuuggaacacuacgauugcuguauccauggccaauaucuuccggggcucauaucuagccggugcugggcugcucuuuucuauuaugaagaacacaaccaauacucgaagaggaaccggcaacaucggugagacacuuggcgaaaaauggaagaguaggcugaaugccuuggggaaaucggaguuccagauauacaagaaaagcggaauccaggaaguggaccgcacucuggccaaggagggcauuaaaagaggggaaaccgaucaccaugcgguuuccagaggaucugcuaagcuccguugguuuguggaaaggaacauggucacaccugagggcaagguggucgaccuggguugcgggcggggaggcuggucauauuacugugguggccuuaaaaacgugcgcgaaguuaaggggcuaacgaaaggaggccccgggcacgaggaaccuaucccaaugagcaccuauggauggaaucuggugcgacuccaauccggcguagauguguucuucacucccccugagaagugcgacacacuacugugugauauuggugagaguucuccaaaccccaccaucgaagcagggagaacuuugaggguccugagccucguugagaauuggcuuaacaaugacacacaguuuugcauaaaagugcugaacccguacaugccuucagucauugaaaagauggagaccuugcagcggaaguacggaggcgcccuggugcgcaauccacucuccagaaacaguacgcaugaaauguauuggguaagcaaugcuaccggcaacaucgugucuuccguuaauaugaucucaaggauguuaauuaaccgauucacaaugaaacacaagaaagccacuuacgagcccgacguggaucuggggagcggaacccggaauauagguaucgagucggaaauuccuaaccuugacaucauuggcaagcguaucgagaaaauaaagcaggaacacgagacaucuuggcauuaugaucaagaccacccauacaagacuugggcauaucaugggaguuacgaaaccaaacagacaggauccgccagcucaauggucaauggcguggucagacugcuaaccaagcccugggaugugguuccgaugguaacucagauggcuaugacggacacaaccccuuuuggucagcaacgcguguucaaagagaaggucgauacuaggacccaggagcccaaagaagggacaaagaagcucaugaaaaucacggcggaguggcuguggaaggaauugggcaaaaagaaaaccccacggauguguacuagagaggaguuuacacgcaaggugagguccaacgccgcacugggcgcuauuuucaccgacgaaaacaaauggaagucugcccgagaggcaguugaagauagccgguuuugggagcucguggacaaggaaagaaaucuucaccuggagggcaaaugcgagacuugugucuauaacaugauggggaagagggagaaaaaguuaggagaguucgguaaagccaagggcagucgcgcuaucugguacauguggcugggggccagauuuuuggaguucgaggcgcucggauuucugaaugaagaucacugguucucccgggagaacagccuaucuggcguggagggugaagggcuucauaagcugggauacauucucagagacguaagcaaaaaggagggcggcgcaauguaugccgacgauacagcugggugggacaccaggaucacacuggaagauuugaaaaaugaggaaauggugacuaaccacauggagggagagcauaagcgccuggccgaagcaauuuuuaaacucaccuaccagaauaagguuguccgagugcagcggccuacgcccagagguaccgugauggacauaaucaguaggcgcgaucaaagaggcuccgggcaggucggaacauauggccuuaacacuuucaccaauauggaggcucagcugauucggcaaauggaaggugaggggaucuucaagagcauccagcacuuaacaguuacugaggaaauugccgugcagaacuggcuggcuaggguaggacgugagcgauugucucgcauggccauaucgggcgacgauugcguggucaaaccacucgacgauagauuugcaucagcgcugaccgcccuaaaugacaugggcaaggugcggaaagauauccagcaaugggaacccagcaagggguggaacgacuggacgcagguuccuuucugcucccaucacuuucacgagcuuauuaugaaagauggaagggugcuggucgugccaugucgcaaucaggacgaacucaucgguagagcucggauuagucagggcgccggguggucucugaaggagacagcaugcuugggaaagagcuacgcucaaaugugguccuuaauguauuuccauaggcgagaccugcgucucgccgcaaacgccaucuguucagcgguaccgagucacuggguucccaccucuagaacuacauggagcauacaugcuaaacacgaguggaugaccacugaagauaugcuuaccguguggaaucgcgucuggauccaggagaacccuuggauggaagacaagacaccaguggaguccugggaagaggugcccuaccugggcaaacgggaggaucaguggugcgguucacuaauugggcugacgagcagggccaccugggcaaagaacauccagacugccauuaaucaagucagaucucucaucggaaacgaagaguauacagacuacaugccuuccaugaaacgcuuucggagggaagaggaagaggcuggcguuuugugguga

SEQ ID NO: 14844 - RNA, 9876 nt, Artificial Sequence
  derived and/or modified CDS sequence (opt3) from DENV-2__EU482665__SS-prME
agcgcaggcaugauaauuaugcugauacccaccgugauggcuuuccaccucacuacuagaaacggggaaccucauaugaucgucgguauucaagaaaagggaaaaucccuucuguuuaagacggaggacggcguuaauaugugcaccuugauggcaauggauuuaggggaacugugugaggacacgaucacuuacaaaugcccacuucucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaagacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggccggugucuuaugggaugugccuuccccacccccuauggggaaagccgaacuggaggacggagcuuaucgaauaaagcaaaagggcauucucggcuacucacagaucggggcaggaguuuacaaagaagguaccuuccacacuauguggcauguaacacgcggcgccgugcugaugcacaaggggaaacggaucgagccgaguugggcggaugucaagaaagaccuuauuagcuauggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccaggagcggggccuauguuuccgcuaucgcccaaacagagaagucuauugaggauaauccugaaaucgaggacgauauauuucguaaacgccggcuuacuauuauggacuuacacccgggagcaggcaagaccaaaagauaccugcccgcuaucgugagggaagccaucaagcgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaagguaagaccgugugguucguuccuuccaucaaggcagggaacgacauugccgcuugccugcgcaaaaauggaaagaaagucauccaacucucacgaaagacauuugauucugaauacgugaaaaccagaacuaacgacugggauuucguggucacaaccgacauaagcgagaugggcgcgaauuuuaaggccgagcggguaaucgauccaaggcgcuguaugaaacccgugauuuuaacggacggcgaagaacguguuauccuggcagggccuaugccggugacucauaguuccgcugcccagagacggggaaggauuggucgcaacccaaagaaugaaaacgaccaguacaucuauaugggcgagccccuugaaaaugaugaggacugcgcacacuggaaggaggccaaaaugcugcucgauaacauaaauacaccugaagggauuauccccagcauguucgagccagaacgagagaaggucgacgcuauugauggagaauacagauugcggggcgaggccaggaaaaccuuuguggaccugaugcgcagaggugaucucccuguuuggcuggcguauaagguggcagccgaggggaucaacuacgcugacaggcggugguguuucgauggcaucaaaaacaaucagauccuugaagagaacgucgaaguggagauuuggaccaaggagggagaacguaagaaacuaaagccccgcuggcuggacgcccgaaucuauucugauccauuggcuuuaaaagaguuuaaggaguucgcagccggcagaaaaucacugacucucaaucugauuacagagauggggaggcuuccuaccuucaugacacaaaagacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaaacagaggacgccccaagacaaccagcugaccuacgucgugaucgccauacucacaguggucgcugcgacuauggccaaugaaaugggcuuucuugagaagaccaaaaaggacuucggacugggcucuaucgcaacacagcagccagaguccaacauuuuggauaucgaccugcggccugcuagcgccuggacccucuacgccguugcaacuacauuugugacgcccaugcugcgacauucaauugaaaauaguucuguaaacgugucccuuaccgcuaucgccaaucaagcgacuguccucauggggcugggaaaagguuggccguugagcaagauggauauuggcgugccacuguuagcuaucggguguuauucacagguuaacccuauaacacuaaccgccgcacugcuccuucugguggcccacuacgcuauuaucggacccggcuugcaggcaaaggccaccagagaggcgcagaaacgcgcugccgcagguaucaugaagaauccaacagucgacgggauuacuguaauagaucuggaccccaucccuuaugauccgaaauucgaaaagcaacucggccaggugaugcugcuuauuuuaugcguuacacaggugcugaugaugaggaccacaugggcccucugugaggcuuugacucuggccaccggacccaucaguacacuaugggaaggcaacccagggcgguuuuggaauaccacuauugcagucagcauggcuaacaucuuccguggauccuaccuggccggcgcgggucuccuauuuucuauaaugaaaaauacgacaaacaccagaagggggacuggaaacaucggcgagacccugggugagaaguggaaaagccgcuugaaugcccugggcaaguccgaguuccaaauuuauaagaaaucagggauccaggagguggaccggacacucgcaaaggaaggaauuaaacgaggcgagacugaucaccaugcugucucuagagggagugccaagcugaggugguuuguggagcgcaacaugguuaccccugaaggaaaagugguagacuuaggcugcgguagagggggauggucguacuauuguggcggucuuaagaaugugagagaggucaagggccugacaaaagggggacccggccacgaagaaccuaucccaaugagcacguacggguggaaccucguucgucuacaguccggaguggaugucuucuucauacccccugaaaagugcgacacccuguugugugauauuggcgagucuucaccaaaucccacuguggaggcagguaggacacugcggguacucaaccuuguggaaaauuggcugaacaauaacacccaguuuugcaucaaaguuuugaauccguacaugccuagcgugaucgagaagauggaagcucugcaacgcaaauaugggggagcccucguccgaaacccauuauccagaaauaguacucaugagauguacugggugucuaacgccagcggcaauauugucucauccgugaacaugauaaguaggaugcugaucaaccgguucacaaugcgccacaagaaggcgaccuaugaacccgacguugaccuuggcagcgggacgagaaauauuggaaucgagucugagauuccuaaccuggauaucauagguaaaaggaucgaaaagauuaaacaggagcaugaaaccuccuggcacuacgaccaggaucacccauauaagacaugggcuuaccauggcucauaugagacuaaacagaccgggagcgcaucgucuaugguaaauggagugguccgacuacucacaaagcccugggacgugcugccgacuguuacccaaauggccaugacagauaccacuccuuuuggccagcagcggguguucaaggaaaaagucgacacgcguacacaggagcccaaggaggguaccaaaaaguugaugaaaaucacugcugaauggcuguggaaggagcucgggaaaaagaagaccccaagaauguguacacgcgaagaguuuacgaggaaagugcggaguaacgccgcacuuggagccauuuucaccgaugagaauaaguggaaauccgcuagagaagcgguagaggacagccgcuuuugggaacugguggauaaggagaggaacuuacaccuggaaggcaaaugcgagacuuguguuuacaauaugaugggcaagcgagagaagaaauugggggaguucggaaaggccaaagguucacgggcaaucugguacauguggcucggcgcuagauuucuggaguucgaagcccuaggguuucuuaacgaggaccauugguucuccagggaaaauucucugagcggagucgagggcgagggucuccacaagcugggguauauuuugcgcgaugugaguaaaaaggaaggaggcgcaauguacgccgacgacacagcuggcugggauacccguauaacucuggaggaccucaagaacgaagagauggugacaaaucacauggaaggggagcauaagaaacuugccgaggcgaucuuuaaacugaccuaucaaaacaaagucguucgggugcagagaccuacacccaggggaacuguaauggauauuaucucccgccgagaccagcgggguagcggccaaguggggaccuacggauuaaauacguucaccaacauggaagcacagcugaucagacagauggagggcgaaggugucuucaaaaauauucagcacuugacagugacugaggagguugccgugcaaaacuggcucgcuagggucgggcgcgaaagacugucucggauggccauaucaggagaugacugcgugguaaagccacuagaugacagguuugcaaacgcucuuaccgcccugaaugauaugggcaagauccguaaagacauucagcagugggagcccaguaagggcuggaacgauuggacacagguuccuuucugcucccaucacuuucaugaacucaucaugaaagacgggcgagugcuggucgugccaugucgcaaucaagaugaguugauuggacgggcucggaucagccagggugccggcuggucuuuaagggaaacugcaugccuggggaagucguaugcgcagauguggucacucauguacuuccaccgcagagaccuucggcuggccgcuaacgccauauguagcgcagugccgucccacuggguccccaccaguaggacgacauggucuauccaugcuaaacacgaguggaugaccacugaggacaugcuaacaguuuggaaucgaguguggauucgugaaaacccuuggauggaggauaagaccccaguagaaagcugggaggaaauccccuaucugggaaagagagaggaccaguggugcggcucccucauugguuugacuucacgcgccaccugggccaaaaauauccaagccgcgauaaaccaggugcggagucugauugggaaugaggaauacacagauuacaugccuucuaugaagagguuuagacgcgaggaagaggaagcuggaguccuuugguga

SEQ ID NO: 14845 - RNA, 9876 nt, Artificial Sequence
  derived and/or modified CDS sequence (opt3) from DENV-2__EU482666__SS-prME
accgccggagugaucauuaugcugauacccacggcuauggcauuccaccucacuacgaggaacggggagccucauaugaucgucggaaggcaggaaaaggguaaaagccuucuguuuaagaccgaggacggaguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugcguugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaagcagccugcaacccuucggaaauauugcaucgaagccaaguugacaaacacuaccacagagagucgcuguccaacucaaggagagcccucccugaaugaagaacaggacaaacgauuuguuugcaagcauucuaugguggauagaggcugggguaacggguguggacuauucggcaagggcgggaucgucacaugcgcuauguuuacaugcaaaaagaauauggaaggaaaaauugugcagccugagaaccucgaauacaccauagugaucacuccacacagcggugaggagcaugccgucggcaaugacacggggaagcacggaaaagaaauuaagaucacaccgcaguccucaauaaccgaggcagaacugacuggcuaugguaccguuacaauggaguguagucccaggaccgggcuugauuucaacgaaauggugcuguugcaaauggaggacaaggcuuggcucguacaccggcagugguuucuggauuuaccucugccauggcuccccggcgccgacacucagggaagcaauuggauucagaaggagacacuugugacguucaagaacccucaugcgaaaaagcaagacgucgugguucugggcucucaggaaggggccaugcacaccgcauugacuggagcuacagagauccagauguccucagguaaucuacuguuuaccggccaucucaaaugccgucugcgcauggauaaacuucaacugaaagggaugagcuacaguauguguacaggaaaguucaagaucgugaaagaaauugccgagacucagcacggcaccaucgucauuagagugcaguaugagggugacgggucuccaugcaagauacccuucgaaaucauggauuuggagaaaaggcauguacucggccggcugauuacgguuaacccgaucgugaccgaaaaggacuccccugucaacaucgaggcugaacccccauuuggagauagcuacauuauaaucggcguggagccugggcaguuaaaacugaauugguucaagaagggaucgucuauuggucaaauguuugagacaacuaugcgaggcgccaaacgcauggcaauccuaggggacaccgccugggauuucggaucccucggcggugucuuuacaucaauugggaaggcucugcaccagguguucggcgcgaucuacggagcagccuuuaguggcguuagcuggacuaugaaaauacuuaucggggcuauuaucaccuggauuggaaugaacuccagaucuacgagcuugucagugagucugguacucgucggcgugaucacacuguaucuuggugccaugguucaggcagacuccggguguguggucagcuggaagaauaaagaacugaagugcggaucuggcauauucauuaccgauaacgugcacacuuggacagagcaguacaaguuucaacccgaaucaccaaguaaauuggccagcgcuauccagaaggcccaugaggaagguauuuguggcaucagguccguaacccggcucgagaaucugauguggaaacagauaacucccgaguuaaaccacauccugucugaaaaugaggugaagcuaaccauuaugacaggggacaucaaaggaauuaugcaggcaggcaagcgcucgcucagaccucaaccaacggaacugaaauauagcuggaagaccugggggaaggcgaaaaugcuuuccacugagucacauaaccagacauucuugaucgauggaccggaaaccgcugagugccccaauacaaacagggccuggaauagucuggagguugaagacuacggcuuuggugucuucacuaccaacauauggcucaagcugcgugagaaacaggacguguuuugugauucuaaguuaaugagcgcagccauuaaagacaaucgggcugugcacgccgauaugggguauuggaucgaauccgcacugaacgacacguggaagauggagaaggcuucauucaucgaggucaaaagcugccacuggccuaagucucauacacuuugguccaauggaguuuuggaaagugagaugauuaucccaaaaucauucgccggccccgugucucagcacaacuaccgaccugguuaucauacccaaacugcgggcccauggcaccucgggaagcuggaaauggauuuugacuucugugagggaaccacagugguagucacugaagauugcggcaacagagggcccucccuaaggaccacaacggccucaggaaaacugauuaccgaguggugcugucgcaguugcacucucccgccucugcgguacagaggcgaggacgguuguugguacgggauggaaauaaggccacuuaaggagaaggaagagaauuuggugaacagccugguuacagcuggacauggccagaucgauaauuuuucguuaggugugcucggcauggcacuguuccuugaagagaugcugcgcacccgagucgggacuaaacacgccauuuugcucguggcuguuuccuuuaugacacugaucaccggaaacaugucuuuccgggaccuaggccgugugaugguaauggucggggccacgaugacugaugacauuggaaugggcgugaccuaucuggcacuccuggcggccuuuaaggugagacccacauucgcugccggucuuuugcugaggaaauuaaccagcaaggagcucaugauggcaacuaucgggauagcucugcuuucacagaguacaaucccugaaaccauucuggagcuaacagaugcccucgcacugggaaugauggucuugaaaaucaugcgcaauauggaaaaguaccaacuggccguuacuauuauggcuaucuccugcgugcccaacgcgguaauauuacagaaugccuggaaggugucuuguaccauucucgcagcugucagcguguccccacugcuucugacgucaagccagcagaaagccgacuggaucccuuuggcccucacaaucaagggccugaaccccaccgcuauuuuucuaacuacccugagucggacaucuaaaaagagauccuggccacuuaaugaggcaauaauggccguuggcauggugagcauccucgcgucgucacuguugaaaaacgacauuccgaugacugggccucuggucgcuggagguuuacucaccgugugcuauguucugacgggcaggucugccgaucuugaacuggagcgagcaacagacgugaagugggaggaucaagccgaaaucaguggguccagccccauuuugucuaucaccauaagcgaggacggauccaugucaaucaaaaaugaagaggaggaacagacucucacaauucugauccgcaccggccuacuggucauuaguggucuuuucccaguaagcauccccauaacugcugcagccugguaccucugggaggugaagaagcagcgggcggggguucugugggaugugccuucuccacccccugucggaaaagcugaauuggaggacggcgccuauagaauuaagcagaaaggcaucuuaggguacucccaaaucggagcugguguguauaaggaaggcacauuucacaccauguggcauguaacgagaggggcagugcugaugcaccguggaaaacgcauugagccgucaugggcagaugucaagaaggaccucaucaguuacggcgguggguggaaacuggagggagaauggaaggagggcgaagagguucaggugcuugcccuggaaccaggcaaaaacccccgggcagugcagacuaagccuggguuguucaaaaccaauacaggaaccauaggugcugucagccuagauuuuuccccaggcacaucugggucgcccauuguggacagaaagggaaagguuguaggccuguacgguaacgggguggucacuaggagcggagccuaugugucagcgaucgcccagaccgagaaauccauugaggauaauccugaaaucgaggacgauauauuccgaaagaaacggcucacgauuauggaccugcauccgggcgcaggcaagacaaaacgcuaccuucccgcuaucguuagagaagccaucaagaggggguuacggacucugauucucgcuccaacccgaguggucgcagccgagauggaagaggccuugagaggacugccuauccgcuaucaaacacccgcuauuagggcggagcacaccggucgugaaauaguggaccucaugugucaugcaacuuucaccaugcggcugcuuaguccaguaagagucccuaacuacaaccugaucauuauggaugaggcccacuuuacagaccccgcuucuaucgccgcaaggggcuauaucagcacgcgcguggaaaugggggaggccgcuggaauuuucaugacugcgaccccaccgggcucccgagauccuuuuccccagucaaaugccccaauaaucgacgaggaaagagagauucccgaacggucuuggaacagcggucacgaguggguuacagauuucaaggggaaaaccgugugguuugucccuaguaucaaggcaggaaaugacauugcugccugcuugaggaaaaacggcaagaaagugauccagcuaucccgcaagacuuucgauagcgaauacguuaagacacguaccaaugacugggauuuuguggucacgacugacauaucugagaugggcgcaaacuucaaagccgagagagugaucgauccacggagguguaugaagcccguaauucugacagacggggaagaacgcgugauccucgcuggaccuaugccgguuacccauucauccgccgcgcaacgaagaggucggauuggcaggaaucccaaaaacgaaaaugaccaguauaucuacaugggggagcccuuagaaaacgaugaggacugcgcacacuggaaggaggccaaaaugcugcuugauaauauaaacaccccugaaggaauuauccccaguauguuugagccagaacgcgagaaggucgacgcuauugauggcgaauacagacugaggggugaggcccggaaaacuuucguggaccucaugcgucgcggggauuugccuguguggcuggcuuaucgagucgcagccgagggcaucaauuacgcugacagaaggugguguuuugauggaguaaagaacaaucagauacucgaagagaacguggaaguugagaucuggacaaaggagggcgaacggaaaaagcugaaaccccgcuggcuugacgccagaauuuauagcgauccacuagcacugaaggaguucaaagaguucgcggccgggaggaagucguugaccuuaaaccugaucacagagaugggacggcucccuacuuuuaugacgcagaaggcucgagacgcccuggauaaucuugcagugcugcauaccgcugaagccgguggcagagcauacaaccacgcccucucugaguugccggagacacuggaaacucuacugcuccuuacccuguuagcuacagucaccgggggaauuuucuuguuucugauguccggcaaagguguggggaagaugacucucggcaugugcugcaucauaacggcgagcauucugcuuugguaugcccaaauccagccccacuggaucgcagcuucaauuauccuggaguucuuucucauaguuuugcugauuccagaaccugagaaacagcgcaccccacaggacaaucaauuaacauacguggucaucgccauucuaacugugguagccgcaaccauggcuaacgaaaugggauuccuggagaagaccaaaaaggaccucggccuugggaguaucgccacccaggagccagaaucuaauauacuggauaucgacuugaggccugcguccgcuuggacucuguaugccguggcaacaacguuuguuacccccaugcuccggcauagcauugagaacucaagugucaaugugagccugacugccaucgcuaaccaggcaacagugcuuaugggacucgguaagggcuggccgcuguccaaaauggauauuggggucccauugcuggccaucggauguuacucucagguuaauccuauuaccuuaaccgcggcucuacugcuccuuaucgcccacuacgcaauaauuggccccggucugcaagccaaggcuacacgugaagcccagaaaagagcagcugccgggaucaugaagaacccaacuguggacggcaucacgguaauugauuuggaccccauaccuuaugauccgaaauucgagaagcagcugggacaggugaugcuccugauccuuugcgucacccaaguguuaaugaugaggacaacuugggcgcugugugaagcccucaccuuggcaacaggccccauuagcacccugugggaggggaauccaggacgcuuuuggaacacuacgaucgcuguuuccauggccaauauuuuccggggcucauaccuagccggugcugggcugcucuuuucuaucaugaagaacacaaccaauacucgaagaggaaccggcaacauaggugagacacuuggcgaaaaauggaagaguaggcugaaugccuuggggaaaucggaguuccagaucuauaagaaaagcggcauucaggaaguggaccgcacucuggccaaggagggcaucaaaagaggggaaaccgaucaucacgcggucuccagaggaucugcuaagcuccguugguuuguagaaaggaacauggugacaccugagggcaagguuguggaccuggguugcgggcggggaggcuggucauacuauugugguggccuuaaaaacguccgcgaagugaaggggcuaacgaaaggaggccccgggcaugaggaaccuauuccaaugagcaccuacggauggaaucugguccgacuccaauccggcguggauguuuucuucacucccccugagaagugcgacacacuacugugugauaucggugagaguucuccaaaccccaccauagaagcagggagaacuuugagggugcugagccucguagagaauuggcuuaacaaugacacacaguuuugcauuaaagugcugaacccguauaugccuucagucaucgaaaagauggagaccuugcagcggaaguacggaggcgcccugguucgcaauccacucuccagaaacaguacgcacgaaauguacugggugagcaaugcuaccggcaacaucgucucuuccgugaauaugauuucaaggauguuaauaaaccgauucacaaugaaacacaagaaagccacuuaugagcccgacguagaucuggggagcggaacccggaauaucgguauugagucggaaaucccuaaccuugacauuaucggcaagcguauagagaaaaucaagcaggaacaugagacaucuuggcacuacgaucaagaccauccauauaagacuugggcauaccacgggaguuaugaaaccaaacagacaggauccgccagcucaauggugaauggcguugugagacugcuaaccaagcccugggaugucgugccgauggucacucagauggcuaugacggacacaaccccuuuuggucagcaacgcguguucaaagagaagguugauacuaggacccaggagcccaaagaagggacaaagaagcucaugaaaauuacggcggaguggcuguggaaggaauugggcaaaaagaaaaccccacggauguguacuagagaggaguuuacacgcaagguaagguccaacgccgcacugggcgcuaucuucaccgacgaaaacaaauggaagucugcccgagaggcaguggaagauagccgguuuugggagcucgucgacaaggaaagaaaucuucaccuggagggcaaaugcgagacuuguguguacaacaugauggggaagagggagaaaaaguuaggagaguucgguaaagccaagggcagucgcgcuauuugguauauguggcugggggccagauuuuuggaguucgaggcgcucggauuucugaaugaagaucauugguucucccgggagaacagccuaucuggcguugagggugaagggcuucacaagcugggauacauccucagagacgugagcaaaaaggagggcggcgcaauguacgccgacgauacagcugggugggacaccaggauuacacuggaagauuugaaaaaugaggaaauggucacuaaccauauggagggagagcacaagcgccuggccgaagcaauauuuaaacucaccuaucagaauaaggugguacgagugcagcggccuacgcccagagguaccguuauggacaucauuaguaggcgcgaucaaagaggcuccgggcaggucggaacauacggccuuaacacuuucaccaauauggaggcucagcugauccggcaaauggaaggugaggggaucuucaagagcauucagcauuuaacagugacugaggaaauagccgugcagaacuggcuggcuagggucggacgugagcgauugucucgcauggccaucucgggcgacgauugcguugugaaaccacucgacgauagauuugcaucagcgcugaccgcccuaaaugacaugggcaagguacggaaagauauucagcaaugggaacccagcaagggguggaacgacuggacacaggugccuuucugcucccaccacuuucaugagcuuaucaugaaagauggaaggguccuggugguuccaugucgcaaucaggacgaacucauugguagagcucggaucagucagggcgccggguggucucugaaggagacagcaugcuugggaaagagcuaugcucaaaugugguccuuaauguacuuccacaggcgagaccugcgucucgccgcaaacgccauauguucagcggugccgagucauuggguccccaccucuagaacuacauggagcauccacgcuaaacacgaguggaugaccacugaagauaugcuuaccguguggaaucgcguauggauucaggagaacccuuggauggaagacaagacaccaguugaguccugggaagaggugcccuaucugggcaaacgggaggaucaguggugcgguucacuaaucgggcugacgagcagggccaccugggcaaagaacauucagacugccaucaaucaagucagaucucucauaggaaacgaagaguacacagacuauaugccuuccaugaaacgcuuucggagggaagaggaagaggcuggcguguugugguga

SEQ ID NO: 14846 - RNA, 9876 nt, Artificial Sequence
  derived and/or modified CDS sequence (opt3) from DENV-2__EU482667__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaagcucuuguuaccuucaagaacccucaugccaaaaagcaagacguggucgugcugggaucccaggagggcgcgaugcacacugccuugacaggggcaacggaaauacagaugucaagcggaaaucuacuguuuaccggucaucucaaaugccggcugcguauggacaagcuucaacugaagggcaugaguuacucuauguguacugggaaauucaagguaguuaaagagauugcugagacacagcacggaaccaucgugaucaagguccaguaugaaggcgaugguuccccaugcaaaauucccuucgagaucauggacuuggaaaagcgcuacgugcucgggagacugauuacagucaacccgauagugacugagaaggauagcccuguuaacaucgaagccgagcccccauuuggcgacucguacauuaucaucggaguggagccuggccaguuaaaacugaauugguucaagaaagggucuuccauuggacaaauguuugaaaccacgaugaggggugcuaagcggauggccauacuaggcgauaccgcaugggacuucgggucacucggaggcguauuuacaaguaucgguaaagcccugcaucaggucuucggggcuauuuauggcgcggcauuuagcggaguguccuggacuaugaagauccuuauuggcguuaucauaaccuggaucgggaugaacucucgaagcacaucauugagugugucccugguccucgugggaauuguaacucuguaccuuggcgugaugguucaggccgauagcgguugugucgugucuuggaagaauaaagagcugaagugcgggucaggaaucuucauuaccgacaacgugcacacguggacagaacaguauaaauuucaacccgagaguccaagcaaguuggcuuccgccauccagaaagcacaggaagagggcauaugugguauucgcucugucaccagacucgagaaucugauguggaagcagaucacucccgaauuaaaccacauucuggccgagaaugaaguuaaacuaacaaucaugaccggcgauauaaaggggaucaugcaagcuggaaagaggucgcuccggccucagccaacugagcugaaauacagcuggaagaccuggggcaaagccaagaugcuuuccacagaaucauauaaccagacguucuugauugacgggccggagaccgcagagugccccaauacuaaccgcgcguggaauagucuggaaguggaggauuacggauuuggcguguucacaaccaacaucuggcucaaacugaaggaaaagcaggacguauuuugugacucuaaauuaaugagcgcugccauuaaggauaauagagcaguccaugccgacauggguuauuggaucgaguccgcucugaacgauacauggaaaauagagaaggccucauucauugaagugaaaaauugccacuggccuaagagccauacucuuuggucuaacgggguuuuggaguccgaaaugaucaucccaaagaaccucgcaggacccgugagucaacacaauuacaggccuggcuaccacacccagauugcugguccauggcaucugggcaaacuagagauggacuucgauuuuugugacgggacgacagucaucgugaccgaagauugcggaaaccguggccccagccugcggacuaccacagccucugggaagcucauuacugaguggugcugucgauccugcacccugccgccucuuagauauaggggagaggacggcuguugguacgguauggaaauacgcccauugaaagagaaggaagagaaucugguuaacucauuagugacagcggggcacggacagguagauaauuucagucucggcguccuggguauggcccuuuuucuggaagagauguugcggacgagagugggcaccaaacaugcuauccuccugguggcagucagcuucguuacucuaauuacagggaacaugucguuuaaggaccugggaagggugguagugauggucggcgccaccauggcugaugacaucgggaugggagugacuuaucucgcccugcuugcagcguucaagguucgccccacauuugccgcuggcuugcuguuacgaaaacucaccuccaaggagcugaugaugacgacuauugguaucgugcuucugucucaaagcaccauaccugaaacaguccuagagcucaccgaugcccuggcauuggggaugauggugcugaaaaucguucggaauauggaaaaguaccaguuagcugugacuauuauggccauccucugcguccccaacgcaguaauucugcagaaugccuggaaagugucauguacaauccuugcuguugugagugucuccccacuguugcucaccucuagccagcaaaagacagacuggauaccucuggcgcuaacuauuaaaggacugaaccccaccgccaucuuccuuacgacacucucccguaccaauaagaagagaucauggccacugaacgaggcaaucauggcugugggcaugguaagcauuuuggccaguucucuguuaaaaaaugacauaccgaugacuggcccucucguggccgggggacugcuuaccgucugcuauguucugacagguagguccgcugauuuggaacucgagcgcgcaacugacgugaagugggaggaucaggccgaaaucagcggcucgucacccauucugucuaucaccauuagugaggacggguccaugagcaucaaaaacgaagaggaggaacagacgcuaacaauacugauccggaccggacuucucgugauuucuggccuguuuccaaucagcauucccaucacugcggcugccugguacuugugggaggucaagaaacagagagcagguguguuaugggauguuccuuccccacccccuauggggaaggccgaacuggaggacggagcuuauaggauaaagcaaaaaggcauucucggcuacucacagaucggggcaggaguauacaaggaagguacauuccacaccauguggcaugugacucgaggcgccguccugaugcacaaagggaagcgcaucgagccgaguugggcggaugugaaaaaggaccuuauuagcuauggaggcgguuggaagcuggagggggaauggaaagagggagaagagguucagguguuggcucuagaaccaggcaagaauccccgggccguccagacaaaaccuggccuguuuaagaccaacacggggacuaucggagcagugucucucgauuucuccccagguaccucaggcagucccauaauugacaaaaaggggaagguagucggacuguacggcaacggugugguuacaagaagcggggccuauguguccgcuaucgcccaaaccgagaaaucuauugaggauaauccugaaaucgaggacgauauauuuaggaagcgucgccuuacaauuauggacuuacacccgggagcaggcaaaacuaagcgguaccugcccgcuaucgucagagaagccaucaaaaggggccuccgaaccuugauucuggcgccaacgcgggugguugccgcagagauggaagaggcucuccgcgggcugccuaucagauaucagacacccgccauuagggcugagcauacuggacgggaaauaguggaccuuaugugucacgcaaccuucacaaugcgacuguugucgccagucagagugccuaacuacaaucuaaucauuauggaugaggcccauuucaccgaccccgccagcaucgcugcgcgcgguuauaucucaacuaggguagaaaugggcgaggcagccgggauuuuuaugaccgcuacaccaccgggaucccgugauccuuucccccagaguaacgccccaauaaucgacgaggaacgggagauucccgaaagaucuuggaauagcggccacgagugggugacggauuuuaaggguaagacuguuugguucgucccuuccaucaaagcagggaacgacauugccgcuugccugaggaagaauggaaaaaaggugauccaacucucacgcaaaaccuuugauucugaauacgugaagacacgaaccaacgacugggauuucgucguaacuacagacauaagcgagaugggcgcgaauuuuaaagccgagagagugaucgauccacggagguguaugaagcccguuauuuuaaccgacggcgaagagcgcgugauccuggcagggccuaugccggucacgcauaguuccgcugcccagcguagaggacggauugguaggaacccaaagaaugaaaacgaccaguacaucuauaugggcgagccccuugaaaaugaugaggacugcgcacacuggaaagaggccaagaugcugcucgauaacauaaauacuccugaagggauuauccccagcauguucgagccagaacgcgagaaaguggacgcuauugauggagaauaccgauugagaggcgaggcccggaagacauuuguugaccugaugaggcgcggugaucucccuguguggcuggcguauaaagucgcagccgaggggaucaacuacgcugacagaaggugguguuucgauggcauaaagaacaaucagauccuugaagagaacguggaaguagagauuuggaccaaggagggagaacggaaaaagcuaaaaccccguuggcuggacgcccgcaucuauucugauccauuggcuuuaaaggaguuuaaagaauucgcagccggccgaaagucacugacccucaaucugauuacugagauggggagacuuccuacauucaugacccaaaagacaagggacgcucuggauaaccucgccguguugcacacugcagaagcgggaggucgggccuacaaucaugcucuguccgagcuaccggagacgcuggaaacccuccuucuguuaacauugcuggccacuguuaccggcgggaucuuucucuuccugaugaguggacgcggcauagguaaaaugacacuugggaugugcugcauuaucaccgcaagcauccugcucugguaugcucagauucagccccacuggaucgccgcaucgauaauuuuggaguuuuuccugaucgucuuacuaauuccagaaccugagaagcagagaacuccccaagacaaccagcugacguacguggugaucgccauacucaccgucguugcugcgacaauggccaaugaaaugggcuuucuugagaaaacuaagaaagacuucggacugggcucuaucgcaacccagcagccagaguccaacauuuuggauaucgaccugaggccugcuagcgccuggacacucuacgccguggcaaccacuuuuguaacacccaugcugcggcauucaauugaaaauaguucugugaacgucucccuuacggcuaucgccaaucaagcgaccgugcucauggggcugggaaaggguuggccguugagcaagauggauauuggcguuccacuguuagcuaucggguguuauucacaggugaacccuauaacucuaacagccgcacugcuccuucuggucgcccacuacgcuauuaucggacccggcuugcaggcaaaagccacccgagaggcgcagaagagagcugccgcagguaucaugaaaaauccaaccguagacgggauuacagugauagaucuggaccccaucccuuaugauccgaaguucgaaaaacaacucggccagguuaugcugcuuauuuuaugcgugacucagguccugaugaugcgcacgaccugggcccucugugaggcuuugacacuggccacuggacccaucaguacccuaugggaaggcaacccagggagguuuuggaauacaaccauugcagugagcauggcuaacaucuuccggggauccuaccuggccggcgcgggucuccuuuuuucuauaaugaagaauacuacgaacacacguagagggaccggaaacaucggcgagacucugggugagaaauggaagagcagguugaaugcccugggcaaguccgaauuccaaauuuauaaaaagucagggauccaggaggucgaccgcacccucgcaaaagaaggaauuaagcggggcgagacagaucaccaugcugugucucgagggagugccaaacugagaugguuuguugagaggaacauggugacuccugaaggaaagguaguggacuuaggcugcggucgcgggggauggucguacuauuguggcggucuuaagaauguccgggagguuaaaggccugaccaaggggggacccggccacgaagagccuaucccaaugagcacauacggguggaaccucgugagacuacaguccggagucgauguguucuucauacccccugaaaaaugcgacacgcuguugugugauauuggcgagucuucaccaaaucccaccguagaggcaggucguacucugagggugcucaaccuuguugaaaauuggcugaacaauaacacacaguuuugcaucaagguguugaauccguacaugccuagcgucaucgagaaaauggaagcucugcaacggaaguaugggggagcccucgugcgcaacccauuaucccgaaauaguacccaugagauguacugggucucuaacgccagcggcaauauugugucauccguuaacaugauaaguagaaugcugaucaacagguucacuaugcggcacaagaaagcgacauaugaacccgacguagaccuuggcagcgggacccgcaauauuggaaucgagucugagauuccuaaccuggauaucauagguaagagaaucgaaaaaauuaagcaggagcaugaaacguccuggcacuacgaccaggaucacccauauaaaaccugggcuuaccauggcucauaugagacaaagcagacugggagcgcaucgucuauggugaauggagucgugaggcuacucaccaagcccugggacguucugccgacagugacucaaauggccaugaccgauacaaccccuuuuggccagcagcgagucuucaaagaaaagguggacacucggacgcaggagcccaaagaggguacaaagaaauugaugaagaucaccgcugaauggcuguggaaagagcucgggaagaagaaaacuccacguauguguaccagagaagaguuuacacgcaagguaaggaguaacgccgcacuuggagccauuuucacggaugagaauaaauggaaguccgcucgggaagcgguggaggacagcagauuuugggaacugguugauaaagagcgcaacuuacaccuggaaggcaagugcgagaccugugucuacaauaugaugggcaagagggagaaaaaguugggggaauucggaaaagccaaggguucacgagcaaucugguacauguggcucggcgcucgguuucuggaguucgaagcccuaggguuucuuaacgaggaccauugguucuccagagaaaauucucugagcggaguggagggcgagggucuccacaaacugggguauauuuugagggaugugaguaagaaggaaggaggcgcaauguacgccgacgacacugcuggcugggauacacgcauaacccuggaggaccucaaaaacgaagagauggucacuaaucacauggaaggggagcauaagaaacuugccgaggcgaucuuuaagcugacauaucaaaacaaaguugugcguguacagcggccuacccccagaggaacagugauggauauuaucuccaggcgcgaccagcgagguagcggccaagucgggacuuacggauuaaauaccuucacgaacauggaagcacagcugauccggcagauggagggcgaagguguguucaagaauauucagcacuugaccguuacagaggagguggccguccaaaacuggcucgcuagaguggggagggaacgccugucuagaauggccauaucaggagaugacugcguaguuaagccacuagaugaccgguuugcaaacgcucuuacugcccugaaugauaugggcaaaaucaggaaggacauucagcagugggagcccaguaaaggcuggaacgauuggacccaggugccuuucugcucccaucacuuucaugaacucaucaugaaggacgggcguguccugguggugccaugucgaaaucaagaugaguugauuggacgcgcuagaaucagccagggugccggcuggucuuuacgggaaacagcaugccuggggaaaucguaugcgcagauguggucacucauguacuuccacaggcgcgaccuuagacuggccgcuaacgccauauguagcgcagucccgucccacuggguucccacuagucggaccacguggucuauccaugcuaagcacgaguggaugacaaccgaggacaugcuaacuguguggaauaggguauggauucgagaaaacccuuggauggaggauaagacaccaguggaaagcugggaggaaauccccuaucugggaaaacgugaggaccaguggugcggcucccucauugguuugaccucaagagccacuugggcaaagaauauccaagccgcgauaaaccagguccgcagucugauugggaaugaggaauacaccgauuacaugccuucuaugaaacgguuuaggagagaggaagaggaagcuggagugcuuugguga

SEQ ID NO: 14847 - RNA, 9876 nt, Artificial Sequence
  derived and/or modified CDS sequence (opt3) from DENV-2__EU482668__SS-prME
agcgcaggcaugauaauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccauuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauacgggggaucaugcaagccggaaagcgcucgcucagaccucagccaaccgagcugaaauacagcuggaagacauggggcaaggcuaaaaugcuuuccacggaaucauauaaccagaccuucuugauugacgggccggagacugccgagugccccaauacaaacagggcauggaauagucuggaaguggaggauuacggauuuggcguguucaccacaaacaucuggcucaagcugaaagaaaagcaggacgcguuuugugacucuaaauuaaugagcgcugccauuaaggauaaucgugcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccggccuggcuaccacacgcagauugcugguccauggcaucugggcaaacuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaggagaaagaagagaaucuggugaacucauuaguuacggcggggcacggacagguggauaauuucagucucggcguacuggguauggcccuuuuucuggaagagauguugaggacccgcgucggcacuaagcaugcuauccuccugguggcagugagcuucgucacacuaauuaccgggaacaugucguuuaaagaccugggacgaguugugguaauggugggcgccacuauggcugaugacaucgggaugggagucacauaucucgcccugcuugcagcguucaaggugcggcccaccuuugccgcuggcuugcuguuacguaaacucacguccaaggagcugaugaugacuaccauugguaucguucuucugucucaaagcacaauaccugaaaccgugcuagagcucacugaugcccuggcauuggggaugaugguccugaagaucgugagaaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaagacugacuggauaccucuggcgcuaaccauuaagggacugaaccccacggccaucuuccuuacaacccucuccaggacuaauaaaaagcgcucauggccacugaacgaggcaaucauggcugucggcauggugagcauuuuggccaguucucugcucaaaaaugacauaccgaugaccggcccucuaguagccgggggacugcuuacagugugcuauguccugacuggucgguccgcugauuuggaacucgagagagcaaccgacguuaagugggaggaucaggccgaaaucagcggcucgucacccauucugucuaucacgauuagugaggacggguccaugagcaucaagaacgaagaggaggaacagacacuaaccauacugaucaggacuggacuucucgugauuucuggccuguuuccaaucagcauucccaucacagcggcugccugguacuugugggaggugaaaaagcagcgagccggugucuuaugggaugugccuuccccacccccuauggggaaagccgaacuggaggacggagcuuaucgcauaaagcaaaaaggcauucucggcuacucacagaucggggcaggaguuuacaaggaagguaccuuccacacuauguggcauguaacacggggcgccgugcugaugcacaaggggaaaagaaucgagccgaguugggcggaugucaagaaagaccuuauuagcuauggaggcgguuggaagcuggagggggaauggaaagagggagaagaggugcagguuuuggcucuagaaccaggcaagaaucccagggccgugcagaccaagccuggccuguuuaaaacgaacacugggaccaucggagcagucucucucgauuucuccccagguacaucaggcagucccauaauugacaagaaagggaaggugguaggacuguacggcaacggugucgugacccguagcggggccuauguuuccgcuaucgcccaaacagagaaaucuauugaggauaauccugaaaucgaggacgauauauuucgcaagcggagacuuacuauuauggacuuacacccgggagcaggcaagaccaaaagguaccugcccgcuaucgugcgagaagccaucaagcggggccuccgcacguugauucuggcgccaacaagagucguggccgcagagauggaagaggcucucagggggcugccuauccgguaucagacucccgccauucgagcugagcauaccggaagagaaauaguugaccuuaugugucacgcaacauucaccaugcgccuguugucgccagugagggucccuaacuacaaucuaaucauuauggaugaggcccauuucacugaccccgccagcaucgcugcgcgugguuauaucucaacccggguggaaaugggcgaggcagccgggauuuuuaugacagcuacgccaccgggauccagagauccuuucccccagaguaacgccccaauaaucgacgaggaaagggagauucccgaacgcucuuggaauagcggccacgaguggguaacugauuuuaaagguaagaccgugugguucguuccuuccaucaaagcagggaacgacauugccgcuugccugcgaaagaauggaaagaaagucauccaacucucaagaaagacauuugauucugaauacgugaaaacccggacuaacgacugggauuucguggucacaaccgacauaagcgagaugggcgcgaauuuuaaggccgagaggguaaucgauccacgccguuguaugaaacccgugauuuuaacggacggcgaagagagaguuauccuggcagggccuaugccggugacucauaguuccgcugcccagcggaggggacgcauuggucgaaacccaaagaaugaaaacgaccaguacaucuauaugggcgagccccuugaaaaugaugaggacugcgcacacuggaaagaggccaagaugcugcucgauaacauaaauacaccugaagggauuauccccagcauguucgagccagaaagagagaaggucgacgcuauugauggagaauaccgguugaggggcgaggcccgcaaaaccuuuguggaccugaugagaaggggugaucucccuguuuggcuggcguauaagguggcagccgaggggaucaacuacgcugaccggcguugguguuucgauggcaucaaaaacaaucagauccuugaagagaacgucgaaguggagauuuggaccaaggagggagaacgcaaaaagcuaaagccccgauggcuggacgccagaaucuauucugauccauuggcuuuaaaagaguuuaaggaguucgcagccggcaggaaaucacugacucucaaucugauuacagagauggggcggcuuccuaccuucaugacacaaaagacucgcgacgcucuggauaaccucgccguauugcacacggcagaagcgggagguagagccuacaaucaugcucuguccgagcuaccggagacccuggaaacacuccuucuguuaacuuugcuggccaccgugacaggcgggaucuuucucuuccugaugaguggaaggggcauagguaaaaugacccuugggaugugcugcauuaucacugcaagcauccugcucugguaugcucagauucagccccacuggaucgccgcaucgauaauuuuggaguuuuuccugaucguuuuacuaauuccagaaccugagaagcagcggacgccccaagacaaccagcugaccuacgucgugaucgccauacucacaguggucgcugcgacuauggccaaugaaaugggcuuucuugagaagaccaaaaaggaccugggauugggcucuaucgcaacacagcagccagaguccaacauucuggauaucgaccuccgaccugcuagcgccuggacccuguacgccguugcaacuacauucgugacgcccaugcuuagacauucaauugaaaauaguucuguaaacgugucccucaccgcuaucgccaaucaagcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaagccacccgcgaggcgcagaagagggcugccgcagguaucaugaagaauccaacagucgacgggauuacuguaauagaucucgaccccaucccuuaugauccgaaauuugaaaagcaacugggccaggugaugcuuuuaauucugugcguuacacaggugcucaugaugcggaccacaugggccuugugugaggcucugacucuagccaccggacccaucaguacacugugggaaggcaacccagggcguuucuggaauaccacuauugcagucagcauggcuaacaucuuuagaggauccuaccucgccggcgcgggucuucuguucucuauaaugaaaaauacgacaaacaccaggcgcgggacuggaaacaucggcgagaccuugggugagaaguggaaaagccggcugaaugcccucggcaaguccgaauuucaaauuuauaaaaagucagggauccaggagguggaccgaacacuggcaaaggaaggaauuaaaagaggcgagacugaucaccaugcugucucuagggggagugccaaguuacgcugguucguggagcggaacaugguuaccccugaaggaaaagugguagaccuuggcugcgguagagggggauggucguacuauuguggcggucugaagaaugugcgugaggucaaaggccucacaaaagggggacccggccacgaggaaccuaucccaaugagcacguacggguggaaccuaguuaggcugcaguccggaguggaugucuuuuucauacccccugaaaagugcgacaccuugcugugugauauuggcgagucuucaccaaaucccacuguggaggcaggucggacacuccgcguacuuaaccugguggaaaauugguugaacaauaacacccaguucugcaucaaaguucugaauccguacaugccuagcgugaucgagaagauggaagcucuccaacgaaaauaugggggagccuuagucagaaacccacuguccaggaauaguacucaugagauguacugggugucuaacgccagcggcaauauugucucauccgugaacaugauaagucggaugcuuaucaaccgcuuuacaaugagacacaagaaagcgaccuaugaacccgacguugaccugggcagcgggacgaggaauauuggaaucgagucugagauuccuaaccuagauaucauagguaagcgaaucgaaaagauuaaacaggagcaugaaaccuccuggcacuacgaccaggaucacccauauaagacaugggcuuaccauggcucauaugagacuaaacagaccgggagcgcaucgucuaugguaaauggagugguccggcuccugacaaagcccugggacguguugccgacuguuacccaaauggccaugacagauaccacuccuuucggccagcagcguguguuuaaagaaaaggucgacacgagaacacaggagcccaaggaggguaccaaaaagcugaugaaaaucacugcugaauggcucuggaaggagcuugggaaaaagaaaaccccacgcauguguacaagggaagaguucacgcggaaggugagaaguaacgccgcacugggagccauuuuuaccgaugagaauaaguggaaauccgcucgcgaagcgguagaggacagcagguucugggaauuaguggauaaggagcgaaaccugcacuuggaaggcaaaugcgagacuuguguuuacaauaugaugggcaagcgggagaaaaagcucggggaauuuggaaaggccaaagguucaagagcaaucugguacauguggcugggcgcuagguuccuagaguuugaagcccuuggguuccugaacgaggaccauugguuuucccgcgaaaauucucucagcggagucgagggcgagggucugcacaaguugggguauauucugcgugaugugaguaaaaaggaaggaggcgcaauguacgccgacgacacagcuggcugggauacccggauaacucucgaggaccuuaaaaacgaagagauggugacaaaucacauggaaggggagcauaagaagcuggccgaggcgaucuucaaauuaaccuaucaaaacaaggucguuagagugcagaggccuacaccccgcggaacuguaauggauauuaucucccgacgggaccagagagguagcggccaaguggggaccuacggacugaauacguuuaccaacauggaagcacaguugaucaggcagauggagggcgaaggugucuucaaaaauauucagcaccucacagugacugaggagguugccgugcauaacuggcuggcucgcgucgggagagaacggcuaucuaggauggccauaucaggagaugacugcgugguaaagccacuugaugaccguuucgcaaacgcucugaccgcccucaaugauaugggcaaaauccgaaaggacauucaacagugggagcccaguaagggcuggaacgauuggacacagguuccuuuuugcucccaccauuuccacgaacugaucaugaaagacgggcgcauuuugguggucccauguagaaaucaggaugaguuaaucggacgggcuaggauaagccaaggugccggcuggucucugcgcgaaacugcaugccucgggaagucguaugcgcagauguggucacuuauguacuuucacagacgggaccugaggcuagccgcuaacgccaucuguagcgcagugccgucccauugggugcccaccagucgaacgacauggucuauucacgcuaaacaugaguggaugaccacugaggacaugcugacagucuggaaucguguuuggaucagagaaaacccuuggauggaggauaagaccccaguggaaagcugggaggaaauucccuaucucggaaaacgcgaggaccaguggugcggcuccuugaucggucugacuucacgggccaccugggcaaagaauauacaggccgcgauuaaccaaguaaggagucuuaucgggaaugaggaauacacagauuacaugccuucuaugaagagauuccgccgggaggaagaggaagcuggagugcugugguga

SEQ ID NO: 14848 - RNA, 9876 nt, Artificial Sequence
  derived and/or modified CDS sequence (opt3) from DENV-2__EU482669__SS-prME
agcgcaggaaugaucauuaugcugauacccaccgugauggcuuuccaccucacaacuagaaacggggaaccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucagccugggugacauauggaaccuguacuacaaccggcgagcaccggcgcgaaaagcgaaguguagcgcuggugccccaugucgguauggggcuugagacgcguacugaaaccuggaugagcuccgagggagcuuggaaacacgcccagagaaucgagacauggauacugaggcauccuggcuucacuaucauggcagccauuuuggcuuacaccaucggcacaacccacuuucagcgggugcucauuuucauccugcugacggcaguugccccaucuaugacuaugcgcugcauagggauuucgaacagagauuuuguggaaggagucucagguggcagcuggguggacaucguacucgagcacgggaguuguguuacaaccauggcuaagaauaagcccacuuuagauuucgaacugauuaaaacagaggccaagcagccugcgacccuuaggaaauauugcaucgaagcaaaguugacgaacaccacaacugagucccgguguccaacccaaggagagcccucucugaaagaagaacaggacaagcgcuuugugugcaagcauagcauggucgaucgaggcugggguaauggguguggacuauucggcaaaggcgggaucgugacaugcgccauguuuacuugcaagaaaaacauggaaggaaagauugugcagccugagaaucucgaauacaccauagucguuacaccacacuccggugaggagcaugcugugggcaacgacaccgggaaacacggaaaggaaaucaaaguaacuccgcagucaaguauuacggagguggaacugacaggcuaugguaccgucacuauggaguguagccccagaaccgggcuugauuucaaugaaauggugcuguugcaaauggagaacaaggccuggcucguucacaggcagugguuucuggacuuaccucugccauggcuccccggcgcagauaagcaggagucuaauuggauccagaaagaaacacuugugaccuucaagaacccucaugcuaaaaagcaagacgucgugguacugggaucccaggagggcgccaugcacacugcguugacaggggccacggaaauacagaugucaagcggaaaucuacuguuuaccggucaucucaaaugccggcugcguauggacaaacuucaacugaagggcaugaguuacucuauguguacugggaaauucaagguugugaaagagauugcagagacacagcacggaaccaucgucauccgcgugcaguaugaaggcgaugguuccccaugcaagauucccuucgagaucauggacuuggagaagagauacguccucgggaggcugauuacagugaacccgauaguuacugagaaggauagcccugugaacaucgaagcugagcccccauuuggcgacucguacauuaucaucggaguagagccuggccaguuaaagcugaauugguucaaaaaggggucuuccauuggacaaauguuugaaaccacgaugcggggugccaaacgaauggcuauacuaggcgauaccgccugggacuucgggucacucggaggcgucuuuacaaguaucgguaaggcacugcaucagguguucggggccauuuauggcgcugcguuuagcggaguuuccuggacuaugaaaauccuuauuggcgugaucauaaccuggaucgggaugaacucucgcagcacaucauugagugucucccuggugcucguaggaauugugacucuguaccuuggcguuaugguccaggcagauagcgguuguguggugucuuggaagaauaaggagcugaaaugcgggucaggaaucuucauuaccgacaacguccacacguggacagaacaguauaaguuucaacccgagaguccaagcaaauuggccuccgcuauccagaaggcccaggaagagggcauaugugguauuagaucuguuaccaggcucgagaaucugauguggaaacagaucacucccgaauuaaaccacauucuggcagagaaugaagugaagcuaacaaucaugaccggcgauauaaaagggaucaugcaagccggaaagcggucgcuccgcccucagccaacugagcugaaguacagcuggaaaaccuggggcaaggcuaaaaugcuuuccacagaaucauauaaccagacguucuugauugacgggccggagaccgccgagugccccaauacuaacagagcauggaauagucuggaaguggaggauuacggauuuggcguauucacaaccaacaucuggcucaagcugaaagaaaagcaggacgcguuuugugacucuaaguuaaugagcgcugccauuaaagauaauagggcaguccaugccgacauggguuauuggaucgaguccgcucugaacgauacauggaagauagagaaagccucauucauugaagugaagaauugccacuggccuaaaagccauacucuuuggucuaacgggguuuuggaguccgaaaugaucaucccaaagaaccucgcaggacccgugagucaacacaauuaccguccuggcuaccacacccagauugcugguccauggcaucugggcaagcuagagauggacuucgauuuuugugacgggacgacagucaucgugaccgaagauugcggaaaccggggccccagccugcgaacuaccacagccucugggaaacucauuacugaguggugcuguagauccugcacccugccgccucuuagguaucgcggagaggacggcuguugguacgguauggaaauacggccauugaaggagaaagaagagaaucugguuaacucauuagugacagcggggcacggacagguagauaauuucagucucggcguccuggguauggcccuuuuucuggaagagauguugagaacgagggugggcaccaagcaugcuauccuccugguggcagucagcuucguuacucuaauuacagggaacaugucguuuaaagaccugggacgcgugguagugauggucggcgccaccauggcugaugacaucgggaugggagugacuuaucucgcccugcuugcagcguucaagguucgacccacauuugccgcuggcuugcuguuacggaagcucaccuccaaagagcugaugaugacgacuauugguaucgugcuucugucucaaagcaccauaccugaaacaguccuagagcucaccgaugcccuggcauuggggaugauggugcugaagaucguucguaauauggaaaaauaccaguuagcugugacuauuauggccauccucugcguccccaacgcaguaauucugcagaaugccuggaaggugucauguacaauccuugcuguugugagugucuccccacuguugcucaccucuagccagcagaagacagacuggauaccucuggcgcuaacuauuaagggacugaaccccaccgccaucuuccuuacgacacucuccagaaccaauaaaaagaggucauggccacugaacgaggcaaucauggcugugggcaugguaagcauuuuggccaguucucuguuaaagaaugacauaccgaugacuggcccucucguggccgggggacugcuuaccgucugcuauguucugacaggucgcuccgcugauuuggaacucgagcgggcaacugacgugaaaugggaggaucaggccgaaaucagcggcucgucacccauucugucuaucaccauuagugaggacggguccaugagcaucaagaacgaagaggaggaacagacgcuaacaauacugaucagaaccggacuucucgugauuucuggccuguuuccaaucagcauucccaucacugcggcugccugguacuugugggaggucaaaaagcagagggccgguguguuaugggauguuccuuccccacccccuauggggaaagccgaacuggaggacggagcuuaucgaauaaagcaaaagggcauucucggcuacucacagaucggggcaggaguauacaaagaagguacauuccacaccauguggcaugugacucgcggcgccguccugaugcacaaggggaaacggaucgagccgaguugggcggaugugaagaaagaccuuauuagcuauggaggcgguuggaagcuggagggggaauggaaggagggagaagagguucagguguuggcucuagaaccaggcaaaaaucccagagccguccagacaaagccuggccuguuuaaaaccaacacggggacuaucggagcagugucucucgauuucuccccagguaccucaggcagucccauaauugacaagaaagggaagguagucggacuguacggcaacggugugguuacaaggagcggggccuauguguccgcuaucgcccaaaccgagaagucuauugaggauaauccugaaaucgaggacgauauauuucguaaacgccggcuuacaauuauggacuuacacccgggagcaggcaagacuaaaagauaccugcccgcuaucgucagggaagccaucaagcgaggccuccggaccuugauucuggcgccaacgcgcgugguugccgcagagauggaagaggcucucagagggcugccuaucagguaucagacacccgccauuaaagcugagcauacuggacgggaaauaguggaccuuaugugucacgcaaccuucacaaugcgacuguugucgccagucagagugccuaacuacaaucuaaucauuauggaugaggcccauuucaccgaccccgccagcaucgcugcgcgcgguuauaucucaacuaggguagaaaugggcgaggcagccgggauuuuuaugaccgcuacaccaccgggaucccgugauccuuucccccagaguaacgccccaauaaucgacgaggaacgggagauucccgaaagaucuuggaauagcggccacgagugggugacggauuacaaggguaagacuguuugguuugucccuuccaucaaagcagggaacgacauugccgcuugccugaggaagaauggcaagaaggugauccaacucucacgcaaaaccuucgauucugaauacgugaagacacgaaccaacgacugggauuuugucguaacuacagacauaagcgagaugggcgcgaauuucaaagccgagagagugaucgauccacggagguguaugaagcccguuauuuuaaccgacggcgaagaacgcgugauccuggcagggccuaugccggucacgcauaguuccgcugcccagcguagaggacggauugguaggaacccaaagaaugaaaacgaccaguauaucuacaugggcgagccccuugaaaaugaugaggacugcgcacacuggaaagaggccaagaugcugcucgauaacauaaauacuccugaagggauuauccccagcauguuugagccagaacgcgagaaaguggacgcuauugauggagaauaucgauugagaggcgaggcccggaagacauucguugaccugaugaggcgcggugaucucccuguguggcuggcguacaaagucgcagccgaggggaucaacuaugcugacagaaggugguguuuugauggcauaaagaacaaucagauccuugaagagaacguggaaguagagauuuggaccaaggagggagaacggaaaaagcuaaaaccccguuggcuggacgcccgcaucuacucugauccauuggcuuuaaaggaguucaaagaauuugcagccggccgaaagucacugacccucaaucugauuacugagauggggagacuuccuacauucaugacccaaaagacaagggacgcucuggauaaccucgccguguugcacacugcagaagcgggaggucgggccuauaaucaugcucuguccgagcuaccggagacgcuggaaacccuccuucuguuaacauugcuggccacuguuaccggcgggaucuuccucuuucugaugaguggacgcggcauagguaaaaugacacuugggaugugcugcauuaucaccgcaagcauccugcucugguacgcucagauucagccccacuggaucgccgcaucgauaauuuuggaguucuuucugaucgucuuacuaauuccagaaccugagaagcagagaacuccccaagacaaccagcugacguacguggugaucgccauacucaccgucguugcugcgacaauggccaaugaaaugggcuuccuugagaaaacuaagaaagaccugggauugggcucuaucgcaacccagcagccagaguccaacauucuggauaucgaccucaggccugcuagcgccuggacacuguaugccguggcaaccacuuuuguaacacccaugcuucggcauucaauugaaaauaguucugugaacgucucccucacggcuaucgccaaucaagcgaccgugcugaugggguugggaaaggguuggccgcugagcaagauggauauuggcguuccauuacuagcuaucggguguuacucacaggugaacccuauaacucugacagccgcacuccuucuguuggucgcccacuaugcuauuaucggacccggccugcaggcaaaagccacccgagaggcgcagaagagagcugccgcagguaucaugaaaaauccaaccguagacgggauuacagugauagaucucgaccccaucccuuacgauccgaaguucgaaaaacaacugggccagguuaugcuuuuaauucugugcgugacucagguccucaugaugcgcacgaccugggccuugugugaggcucugacacuagccacuggacccaucaguacccugugggaaggcaacccagggagguuuuggaauacaaccauugcagugagcauggcuaacaucuuccggggauccuaucucgccggcgcgggucuucuguuuucuauaaugaagaauacuacgaacacacguagagggaccggaaacaucggcgagacuuugggugagaaauggaaaagcaggcugaaugcccucggcaaguccgaguuccaaauuuacaaaaagucagggauccaggaggucgaccgcacccuggcaaaagaaggaauuaagcggggcgagacagaucaccaugcugugucucgagggagugccaaauuaagaugguuuguugagaggaacauggugacuccugaaggaaagguaguggaccuuggcugcggucgcgggggauggucguauuacuguggcggucugaagaauguccgggagguuaaaggccucaccaaagggggacccggccacgaagaaccuaucccaaugagcacauacggguggaaccuagugagacugcaguccggagucgauguguucuuuauacccccugaaaaaugcgacacguugcugugugauauuggcgagucuucaccaaaucccaccguagaggcaggucguacucucagggugcuuaaccugguugaaaauugguugaacaauaacacacaguucugcaucaaggugcugaauccguauaugccuagcgucaucgagaaaauggaagcucuccaacggaaguacgggggagccuuagugcgcaacccacugucccgaaauaguacccaugagauguauugggucucuaacgccagcggcaauauugugucauccguuaacaugauaaguagaaugcuuaucaacagguucacuaugcggcacaagaaagcgacauacgaacccgacguagaccugggcagcgggacccgcaauauuggaaucgagucugagauuccuaaccuagauaucauagguaagagaaucgagaaaauuaagcaggagcaugaaacguccuggcacuaugaccaggaucacccauacaaaaccugggcuuaucauggcucauacgagacaaagcagacugggagcgcaucgucuauggugaauggagucgugaggcuccugaccaagcccugggacguuuugccgacagugacucaaauggccaugaccgauacaaccccuuuuggccagcagcgagucuucaaagaaaagguggacacucggacgcaggagcccaaagaggguacaaagaaacugaugaagaucaccgcugaauggcucuggaaagagcuugggaagaagaaaacuccacguauguguaccagagaagaguuuacacgcaagguaaggaguaacgccgcacugggagccauuuucacggaugagaauaaauggaaguccgcucgggaagcgguggaggacagcagauuuugggaauuaguugauaaagagcgcaaccugcacuuggaaggcaagugcgagaccugugucuacaauaugaugggcaagagggagaaaaagcucggggaguucggaaaagccaaggguucacgagcaaucugguauauguggcugggcgcucgguuucuagaguucgaagcccuuggguuucugaacgaggaccauugguucuccagagaaaauucucucagcggaguggagggcgagggucugcacaaauugggguacauucugagggaugugaguaagaaggaaggaggcgcaauguaugccgacgacacugcuggcugggauacacgcauaacccucgaggaccuuaaaaacgaagagauggucacuaaucacauggaaggggagcauaagaaacuggccgaggcgaucuuuaaguuaacauaccaaaacaaaguugugcguguacagcggccuacccccagaggaacagugauggauauuaucuccaggcgcgaccagcgagguagcggccaagucgggacuuauggacugaauaccuucacgaacauggaagcacaguugauccggcagauggagggcgaagguguguuuaagaccauucagcaccucacaguuacugaggagguggccguccaaaauuggcuggcuagaguggggagggaacgccuaucuagaauggccauaucaggagaugacugcguaguuaagccacuugaugaccgguucgcaaacgcucugaccgcccucaacgauaugggcaaaaucaggaaggacauucagcagugggagcccaguaaaggcuggaaugauuggacacaggugccuuucugcucccaucacuuucaugaacugaucaugaaggacgggcgugucuugguggugccaugucgaaaccaagaugaguuaauuggacgcgcuagaaucagccagggugccggcuggucucugcgggaaacugcaugccucgggaaaucguacgcgcagauguggucacuuauguauuuccacaggcgcgaccugagacuagccgcuaaugccauauguagcgcagucccgucccacuggguucccaccagucggacgacauggucuauccaugcuaagcacgaguggaugaccacugaggacaugcugacaguguggaacaggguauggauucgagaaaauccuuggauggaggauaagaccccaguggaaagcugggaggaaauccccuaccucggaaaacgugaggaccaguggugcggcuccuugauuggucugacuucaagagccaccugggcaaagaacauccaagccgcgauaaaucagguccgcagucuuauugggaacgaggaauacacagauuauaugccuucuaugaaacgguuuaggagagaggaagaggaagcuggagugcugugguga

SEQ ID NO: 14849 - RNA, 9876 nt, Artificial Sequence
  derived and/or modified CDS sequence (opt3) from DENV-2__EU482670__SS-prME
agcgcaggcaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaaugaaagagauugcagagacccagcacggaacaaucguuauccgcgugcaguaugaaggcgaugguuccccaugcaagauucccuucgagaucauggacuuggagaagagauacguccucgggaggcugauuacugugaacccgauagucaccgagaaggauagcccugugaacaucgaagcugagcccccauuuggcgacucguacauuaucaucggaguugagccuggccaguuaaagcugaauugguucaaaaaggggucuuccauuggacaaauguuugaaacgaccaugcggggugccaaacgaauggcuauacuaggcgauacagccugggacuucgggucacucggaggcguguuuacaaguaucgguaaggcacugcaucagguauucggggccauuuauggcgcugcguuuagcggagucuccuggaccaugaaaauccuuauuggcgugaucauaacauggaucgggaugaacucucgcagcacuucauugaguguuucccuggugcucgucggaauugugacccuguaccuuggcguaauggugcaggcagauagcgguuguguugucucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugugacuaggcucgagaaucugauguggaaacagaucacacccgaauuaaaccacauucuggcagagaaugaagucaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucacauaaccagaccuucuugauugacgggccggagacugccgagugccccaauacaaacagagcauggaauagucuggaaguugaggauuauggauuuggcguguucaccacaaacaucuggcucaagcugaaagaaaagcaggacgcguuuugugacucuaaguuaaugagcgcugccauuaaagauaauagggcagugcacgccgacauggguuacuggaucgaguccgcucugaacgauacuuggaagauagagaaagccucauucauugaaguaaagaauugccauuggccuaaaagccacacccuuuggucuaacggggucuuggaguccgaaaugaucaucccaaagaaccucgcaggacccgugagucaacacaauuaucguccuggcuaccauacgcagguugcugguccauggcaccugggcaagcuagagauggacuucgauuuuugugacgggacaaccgugauugucacugaagauugcggaaaccggggccccagccugcgaaccacaacugccucugggaaacucaucaccgaguggugcuguagauccugcacacugccgccucuuagguaccgcggagaggacggcuguugguaugguauggaaauucggccauugaaggagaaagaagagaaucuggugaacucauuaguuacggcggggcauggacagguggauaauuucagucucggcguacuggguauggcccuuuuucuggaagagauguugagaaccagggucggcacuaagcacgcuauacuccugguggcagugagcuucgucacacuaaucaccgggaacaugucguuuaaagaccugggacgcguugugguaauggugggcgccacuauggcugaugacauugggaugggagucacauaccucgcccugcuugcagcguucaaggugcgacccaccuuugccgcuggcuugcuguuacggaagcucacguccaaagagcugaugaugacuaccaucgguauuguucuucugucucaaagcacaaucccugaaaccgugcuagagcucacugaugcccuggcauuggggaugaugguccugaagauagugcguaauauggaaaaauaucaguuagcuguuacaaucauggccauucucugcgugcccaacgcagucauccugcagaaugccuggaagguaucauguaccauucuugcugugguuaguguguccccacuguugcucacaucuagccagcagaaaacugacuggaucccucuggcgcuaaccauaaagggacugaaccccacggccauuuuccuuacaacccucuccagaacuaauaaaaagaggucauggccacugaacgaggcaaucauggcugucggcauggugagcaucuuggccaguucucuguuaaagaaugacauuccgaugaccggcccucucguagccgggggacugcuuacagugugcuacguccugacuggucgcuccgcugauuuggaacucgagcgggcaaccgacguuaaaugggaggaucaggccgaaauaagcggcucgucacccauccugucuauuacgaucagugaggacggguccaugagcauuaagaacgaagaggaggaacagacacuaaccauccugauaagaacuggacuucucgugaucucuggccuguuuccaauuagcauccccauuacagcggcugccugguauuugugggaggugaaaaagcagagggccggugucuuaugggaugugccuuccccacccccuauggggaaagccgaacuggaggacggagcuuaccgaaucaagcaaaagggcauacucggcuauucacagauuggggcaggaguuuacaaagaagguaccuuccauacuauguggcacguaacacgcggcgccgugcugaugcacaaggggaaacggaucgagccgaguugggcggaugucaagaaagaccuuaucagcuacggaggcgguuggaagcuggagggggaauggaaggagggagaagaggugcagguuuuggcucuagaaccaggcaaaaaucccagagccgugcagaccaagccuggccuguuuaaaacgaacacugggaccauuggagcagucucucucgauuucuccccagguacaucaggcagucccaucauagacaagaaagggaaggugguaggacuguauggcaacggugucgugaccaggagcggggccuacguuuccgcuauugcccaaacagagaagucuaucgaggauaauccugaaauugaggacgauaucuuucguaaacgccggcuuacuauaauggacuuacauccgggagcaggcaagaccaaaagauaucugcccgcuauugugagggaagccaucaagcgaggccuccggacguugauccuggcgccaacacgcgucguggccgcagagauggaagaggcucucagagggcugccuauuagguaccagacucccgccauccgggcugagcacaccggacgagaaauuguugaccuuaugugucaugcaacauucaccaugagacuguugucgccagugcgcgucccuaacuauaaucuaauaaucauggaugaggcccacuucacugaccccgccagcauugcugcgagggguuacaucucaacccguguggaaaugggcgaggcagccgggaucuuuaugacagcuacgccaccgggaucccgggauccuuucccccagaguaacgccccaauuauagacgaggaaagagagauccccgaaaggucuuggaauagcggccaugaguggguaacugauuuuaaagguaagaccgugugguucguuccuuccauuaaggcagggaacgacaucgccgcuugccugcgcaaaaauggaaagaaagucauucaacucucacgaaagacauuugauucugaauaugugaaaaccagaacuaacgacugggauuucguggucacaaccgacaucagcgagaugggcgcgaauuuuaaggccgagcggguaauagauccaaggcgcuguaugaaacccgugaucuuaacggacggcgaagaacguguuauucuggcagggccuaugccggugacucacaguuccgcugcccagagacggggaaggaucggucgcaacccaaagaaugaaaacgaccaguacauuuacaugggcgagccccuugaaaaugaugaggacugcgcacacuggaaggaggccaaaaugcugcucgauaacaucaauacaccugaagggauaauucccagcauguucgagccagaacgagagaaggucgacgcuaucgauggagaauauagauugcggggcgaggccaggaaaaccuuuguggaccugaugcgcagaggugaucucccuguuuggcuggcguacaagguggcagccgaggggauuaacuaugcugacaggcggugguguuucgauggcaucaaaaacaaucagauacuugaagagaacgucgaaguggagaucuggaccaaggagggagaacguaagaaacuaaagccccgcuggcuggacgcccgaauuuacucugauccauuggcuuuaaaagaguuuaaggaguucgcagccggcagaaaaucacugacucucaaucugaucacagagauggggaggcuuccuaccuucaugacacaaaagacucgggacgcucuggauaaccucgccguauugcauacggcagaagcgggaggucgcgccuauaaucacgcucuguccgagcuaccggagacccuggaaacacuccuucuguuaacuuugcuggccaccgugacaggcgggauuuuucucuuccugaugaguggaagaggcaucgguaagaugacccuugggaugugcugcauaauuacugcaagcauccugcucugguacgcucagauccagccccauuggauugccgcaucgaucauauuggaguuuuuccugauuguuuuacuaaucccagaaccugagaaacagaggacgccccaagacaaccagcugaccuaugucgugauugccauccucacaguggucgcugcgacuauggccaaugaaaugggcuuucuugagaagaccaaaaaggaccugggauugggcucuauagcaacacagcagccagaguccaacauccuggauauugaccuccggccugcuagcgccuggacccuguacgccguugcaacuacauucgugacgcccaugcuucgacacucaaucgaaaauaguucuguaaacgugucccucaccgcuauugccaaucaagcgacuguccugaugggguugggaaaagguuggccgcugagcaagauggauaucggcgugccauuacuagcuauuggguguuacucacagguuaacccuaucacacugaccgccgcacuccuucuguugguggcccacuaugcuauaauuggacccggccugcaggcaaaggccaccagagaggcgcagaaacgcgcugccgcagguaucaugaagaauccaacagucgacgggaucacuguaauugaucucgaccccauaccuuacgauccgaaauuugaaaagcaacugggccaggugaugcuuuuaauccugugcguuacacaggugcucaugaugaggaccacaugggccuugugugaggcucugacucuagccaccggacccauuaguacacugugggaaggcaacccagggcgguucuggaauaccacuaucgcagucagcauggcuaacauuuuucguggauccuaucucgccggcgcgggucuucuguucucuaucaugaaaaauacgacaaacaccagaagggggacuggaaacaugggcgagaccuugggugagaaguggaaaagccgccugaaugcccucggcaaguccgaauuucaaauauacaagaaaucagggauccaggagguggaccggacacuggcaaaggaaggaauuaaacgaggcgagacugaucaucacgcugucucuagagggagugccaaguuaaggugguucguggagcgcaacaugguuaccccugaaggaaaagugguagaccuuggcugcgguagagggggauggucguauuacuguggcggucugaagaaugugagagaggucaagggccucacaaaagggggacccggccaugaggaaccuaucccaaugagcacguauggguggaaccuaguucgucugcaguccggaguggaugucuuuuucauucccccugaaaagugcgacaccuugcugugugauaucggcgagucuucaccaaaucccacuguggaggcagguaggacacuccggguacuuaaccugguggaaaauugguugaacaauaacacccaguucugcauaaaaguucugaauccguacaugccuagcgugauugagaagauggaagcucuccaacgcaaauacgggggagccuuaguccgaaacccacuguccagaaauaguacucacgagauguauugggugucuaacgccagcggcaauaucgucucauccgugaacaugaucaguaggaugcuuauuaaccgguuuacaaugcgccauaagaaggcgaccuacgaacccgacguugaccugggcagcgggacgagaaauauaggaaucgagucugagauuccuaaccuagauaucauugguaaaaggaucgaaaagauaaaacaggagcacgaaaccuccuggcacuaugaccaggaucauccauacaagacaugggcuuaucacggcucauacgagacuaaacagaccgggagcgcaucgucuaugguaaauggagugguccgacuccugacaaagcccugggacguguugccgacuguuacccaaauggccaugacagauaccacuccuuucggccagcagcggguguuuaaggaaaaagucgacacgcguacacaggagcccaaggaggguaccaaaaagcugaugaaaaucacugcugaauggcucuggaaggagcuugggaaaaagaagaccccaagaauguguacacgcgaagaguucacgaggaaagugcggaguaacgccgcacugggagccauuuuuaccgaugagaauaaguggaaauccgcuagagaagcgguagaggacagccgcuucugggaauuaguggauaaggagaggaaccugcauuuggaaggcaaaugcgagacuuguguuuauaauaugaugggcaagcgagagaagaaacucggggaauuuggaaaggccaaagguucacgggcaaucugguacauguggcugggcgcuagauuccuagaguuugaagcccuuggguuccugaacgaggaccacugguuuuccagggaaaauucucucagcggagucgagggcgagggucugcacaaguugggguacauucugcgcgaugugaguaaaaaggaaggaggcgcaauguaugccgacgacacagcuggcugggauacccguaucacucucgaggaccuuaagaacgaagagauggugacaaaucauauggaaggggagcacaaaaagcuggccgaggcgauuuucaaauuaaccuaccaaaacaaggucguucgggugcagagaccuacacccaggggaacuguaauggauauaaucucccgccgagaccagcgggguagcggccaaguggggaccuauggacugaauacguuuaccaacauggaagcacaguugauuagacagauggagggcgaaggugucuucaaaaauauccagcaucucacagugacugaggagguugccgugcaaaacuggcuggcuagggucgggcgcgaaagacuaucucggauggccaucucaggagaugacugcgugguaaagccacuugaugacagguucgcaaacgcucugaccgcccucaaugauaugggcaagauucguaaagacauacagcagugggagcccaguaagggcuggaacgauuggacacagguuccuuuuugcucccaccauuuccacgaacugaucaugaaagacgggcgaauuuugguggucccaugucgcaaucaagaugaguuaaucggacgggcucggauuagccagggugccggcuggucucugagggaaacugcaugccucgggaagucguacgcgcagauguggucacuuauguauuuucaccgcagagaccugcggcuagccgcuaacgccaucuguagcgcagugccgucccauugggugcccaccaguaggacgacauggucuauacacgcuaaacaugaguggaugaccacugaggacaugcugacagucuggaaucgaguuuggauccgugaaaacccuuggauggaggauaagaccccaguggaaagcugggaggaaauucccuaccucggaaagagagaggaccaguggugcggcuccuugaucggucugacuucacgcgccaccugggccaaaaauauucaagccgcgaucaaccagguacggagucuuauagggaaugaggaauauacagauuacaugccuucuaugaagagguucagacgcgaggaagaggaagcuggagugcugugguga

SEQ ID NO: 14850 - RNA, 9876 nt, Artificial Sequence
  derived and/or modified CDS sequence (opt3) from DENV-2__EU482671__SS-prME
agcgcaggaaugauaauuaugcugauaccaaccgugauggcuuuccaccucacuacuagaaacggggagccucauaugaucguagguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuuaucugcaagcauagcaugguggaucgaggcugggguaauggguguggacuauucggcaaaggcgggauugucacuugcgcaauguuuaccugcaagaaaaacauggaaggaaagauagugcagccugagaaucucgaauacacaaucguggucaccccacacuccggugaggagcaugccguuggcaacgacacugggaaacacggaaaggaaauuaaagugacgccgcagucaaguaucacagaggcugaacugaccggcuaugguacuguaaccauggaguguagccccagaacagggcuugauuucaaugaaauggugcuguugcaaauggagaacaaggccuggcucguccacaggcagugguuucuggacuuaccucugccauggcuccccggcgcagauaagcaggagucuaauuggauacagaaagaaacccuugugacuuucaagaacccucaugcuaaaaagcaagacguugugguccugggaucccaggagggcgccaugcacacagcguugacgggggccaccgaaauucagaugucaagcggaaaucuacuguuuacuggucaucucaaaugccggcugcguauggacaaacuucaacugaagggcaugaguuacucuauguguacagggaaauucaaggugguacgcgagaucgcagagacccagcacggaacaaucguuauuagagugcaguaugaaggcgaugguuccccaugcaaaauccccuucgagauuauggacuuggaaaagagguacguccucgggcggcugauaacugugaacccgaucgucaccgagaaagauagcccugugaacauugaagcugagcccccauuuggcgacucguacaucaucauuggaguugagccuggccaguuaaagcugaauugguucaagaaagggucuuccauaggacaaauguuugaaacgaccaugcgaggugccaagcgcauggcuauccuaggcgauacagccugggacuucgggucacucggaggcguguuuacaaguauugguaaagcacugcaucagguauucggggccaucuauggcgcugcguuuagcggagucuccuggaccaugaagauucuuaucggcgugauaaucacauggauugggaugaacucuagaagcacuucauugaguguuucccuggugcucgucggaaucgugacccuguaccuuggcguaauggugcaggcagauagcgguuguguugucucuuggaaaaauaaggagcugaagugcgggucaggaauuuucaucacggacaacgugcacacauggaccgaacaguauaaauuucaacccgagaguccaagcaaguuggccuccgcuauacagaaagcccaggaagagggcauuugugguaucaggucugugacucggcucgagaaucugauguggaagcagauuacacccgaauuaaaccacauccuggcagagaaugaagucaaacuaaccauaaugacuggcgauaucaaggggauuaugcaagccggaaaacgcucgcucagaccucagccaaccgagcugaaguacagcuggaagacauggggcaaagcuaagaugcuuuccacggaaucauauaaccagaccuucuugaucgacgggccggagacugccgagugccccaauacaaacagggcauggaauagucuggaaguugaggauuacggauuuggcguguucaccacaaacauuuggcucaaacugaaggaaaaacaggacgcguuuugugacucuaaguuaaugagcgcugccaucaaggauaaucgugcagugcaugccgacauggguuauuggauagaguccgcucugaacgauacuuggaaaauugagaaggccucauucaucgaagucaagaauugccacuggccuaagagccauacccuuuggucuaacggggucuuggaguccgaaaugaucauucccaagaaccucgcaggacccgugagucaacacaauuaccggccuggcuaccacacgcagaucgcugguccauggcaucugggcaagcuagagauggacuucgauuuuugugacgggacaaccguuauugugacugaagauugcggaaaccgaggccccagccugagaaccacaacugccucugggaagcucauaaccgaguggugcuguagguccugcacacugccgccucuucgcuaucggggagaggacggcuguugguacgguauggaaaucagaccauugaaagagaaggaagagaaucuggucaacucauuagugacggcggggcacggacagguugauaauuucagucucggcgugcuggguauggcccuuuuucuggaagagauguugaggacccgcguaggcacuaaacaugcuauucuccuggucgcagugagcuucgugacacuaaucaccgggaacaugucguuuaaggaccugggacgagucguugugaugguaggcgccacuauggcugaugacauugggaugggagugacauaucucgcccugcuugcagcguucaaaguccggcccaccuuugccgcuggcuugcuguuacguaagcucacguccaaggagcugaugaugacuaccaucgguauagugcuucugucucaaagcacaaucccugaaaccguucuagagcucacugaugcccuggcauuggggaugauggugcugaaaauugucagaaauauggaaaaguaccaguuagcugugacaaucauggccauucucugcguucccaacgcagugauccugcagaaugccuggaaagucucauguaccauacuugcuguagugaguguuuccccacuguugcucacaucuagccagcaaaagacugacuggauuccucuggcgcuaaccaucaaaggacugaaccccacggccaucuuccuuacaacccucuccaggacuaauaagaaacgcucauggccacugaacgaggcaauuauggcugugggcauggucagcauauuggccaguucucuguuaaagaaugacaucccgaugaccggcccucucguggccgggggacugcuuacaguaugcuaugugcugacuggucgguccgcugauuuggaacucgagagagcaaccgacgucaagugggaggaucaggccgaaauuagcggcucgucacccauccugucuauuacgaucagugaggacggguccaugagcaucaagaacgaagaggaggaacagacacuaaccauccugauuaggacuggacuucucguuaucucuggccuguuuccaauuagcauccccauaacagcggcugccugguacuugugggaggugaagaaacagcgagccgguguguuaugggaugucccuuccccacccccuauggggaaggccgaacuggaggacggagcuuaucgcauuaaacaaaagggcauccucggcuacucacagaucggggcaggaguguacaaggaagguaccuuccacacuauguggcauguuacacggggcgccguacugaugcacaaagggaagagaauugagccgaguugggcggaugugaaaaaggaccuuaucagcuauggaggcgguuggaaacuggagggggaauggaaggagggagaagagguccagguguuggcucuagaaccaggcaagaaucccagggccguucagaccaaaccuggccuguuuaagacgaacacugggaccauaggagcagugucucucgauuucuccccagguacaucaggcagucccauuaucgacaaaaaggggaaagucgugggacuguacggcaacgguguagucacccguagcggggccuauguguccgcuauugcccaaacagagaagucuaucgaggauaauccugaaauagaggacgauauuuuucgcaagcggagacuuacuaucauggacuuacacccgggagcaggcaaaaccaagagguaccugcccgcuaucguucgagaagccauuaaacggggccuccgcacguugauccuggcgccaacaagaguggucgccgcagagauggaagaggcucucagggggcugccuauucgguaucagacucccgccauacgagcugagcauaccggaagagaaaucguggaccuuaugugucacgcaacauucaccaugcgccuguugucgccaguuagggugccuaacuacaaucuaauuaucauggaugaggcccauuucacugaccccgccagcaucgcugcgcgugguuauauuucaacccgggucgaaaugggcgaggcagccgggauauuuaugacagcuacgccaccgggauccagagauccuuucccccagaguaacgccccaaucauugacgaggaaagggagauccccgaacgcucuuggaauagcggccacgagugggugacugauuuuaaggguaaaaccguaugguucgugccuuccauuaaggcagggaacgacaucgccgcuugccugcgaaagaauggcaaaaagguuauacaacucucaagaaaaacauuugauucugaauacgucaagacccggacuaacgacugggauuucguggugacaaccgacaucagcgagaugggcgcgaauuuuaaagccgagagggucauugauccacgccguuguaugaagcccguaaucuuaacggacggcgaagagagagugauucuggcagggccuaugccgguuacucauaguuccgcugcccagcggaggggacgcaucggucgaaaccccaaaaaugaaaacgaccaguacauauauaugggcgagccccuugaaaaugaugaggacugcgcacacuggaaggaggccaagaugcugcucgauaacauuaauacaccugaagggaucauucccagcauguucgagccagaaagagagaaaguggacgcuaucgauggagaauaccgguugaggggcgaggcccgcaagaccuuugucgaccugaugagaaggggugaucucccuguguggcuggcguauaaaguugcagccgaggggauaaacuacgcugaccggcguugguguuucgauggcaucaagaacaaucagauucuugaagagaacguggaagucgagaucuggaccaaagagggagaacgcaagaagcuaaaaccccgauggcuggacgccagaauuuauucugauccauuggcuuuaaaggaguuuaaagaguucgcagccggcaggaagucacugacucucaaucugaucacagagauggggcggcuuccuaccuucaugacacagaaaacucgcgacgcucuggauaaccucgccguguugcacacggcagaagcgggagguagagccuacaaucaugcucuguccgagcuaccggagacccuggaaacacuccuucuguuaacuuugcuggccaccguaacaggcgggauauuucucuuccugaugaguggaaggggcauugguaagaugacccuugggaugugcugcaucaucacugcaagcauucugcucugguaugcucagauccagccccacuggauagccgcaucgauuaucuuggaguuuuuccugauuguguuacuaaucccagaaccugagaagcagcggacgccccaagacaaccagcugaccuacguugucauagccauccucacagugguggcugcgacuauggccaaugaaaugggcuuucuugagaaaaccaagaaagaccugggauugggcucuauugcaacacagcagccagaguccaacauccuggauauugaccuccgaccugcuagcgccuggacccuguacgccgucgcaacuacauucguuacgcccaugcuuagacauucaaucgaaaauaguucugugaacguaucccucaccgcuauugccaaucaagcgacugugcugaugggguugggaaaggguuggccgcugagcaaaauggauaucggcgucccauuacuagcuauaggguguuauucacaggugaacccuauuacacugaccgccgcacuccuucuguugguugcccacuacgcuaucaucggacccggccugcaggcaaaggccacccgcgaggcgcagaagagggcugccgcagguauuaugaaaaauccaacaguggacgggauaacugucaucgaucucgaccccauuccuuaugauccgaaguuugaaaaacaacugggccagguaaugcuuuuaauccugugcgugacgcagguucucaugaugcggaccacaugggccuugugugaggcucugacucuagccaccggacccauuaguacacugugggaaggcaacccagggcguuucuggaauaccacuaucgcagugagcauggcuaacauauuuagaggauccuaccucgccggcgcgggucuucuguucucuaucaugaagaauacgacaaacaccaggcgcgggacuggaaacaugggcgagaccuugggugagaaauggaaaagccggcugaaugcccucggcaaauccgaauuucaaauuuauaagcgaucagggauccaggaggucgacagaacacuggcaaaggaaggaauuaaaaggggcgagacugaucaccaugcugugucucgcgggagugccaaguuacggugguucgucgagagaaacauggugaccccugaaggaaaaguuguggaccuuggcugcggucgugggggauggucguacuauuguggcggucugaagaauguaagggaggugaaaggccucacaaaagggggacccggccacgaggaaccuaucccaaugagcacguacggguggaaccuaguccggcugcaguccggaguugauguguuuuucauacccccugaaaagugcgacaccuugcugugugauauuggcgagucuucaccaaaucccacugucgaggcaggucgcacacuccgagugcuuaaccugguagaaaauugguugaacaauaacacccaguucugcaucaaagugcugaauccguacaugccuagcguuaucgagaagauggaagcucuccaaagaaaauaugggggagccuuagugaggaacccacugucccggaauaguacucaugagauguacugggucucuaacgccagcggcaauauugugucauccgucaacaugauaagucgcaugcuuaucaacagauuuacaaugaggcacaagaaagcgaccuaugaacccgacguggaccugggcagcgggacgcgaaauauuggaaucgagucugagauuccuaaccuagauaucauagguaagcggaucgaaaagauuaaacaggagcaugaaaccuccuggcacuacgaccaggaucacccauauaagacaugggcuuaccauggcucauaugagacuaaacagaccgggagcgcaucgucuaugguuaauggaguagugcgucuccugacaaagcccugggacgucuugccgacugugacccaaauggccaugacagauaccacuccuuucggccagcagagaguuuuuaaagaaaagguggacacgcgcacacaggagcccaaggaggguaccaaaaagcugaugaaaaucacugcugaauggcucuggaaggagcuugggaaaaagaaaaccccaaggauguguacacgggaagaguucacgagaaagguccgcaguaacgccgcacugggagccauuuuuaccgaugagaauaaguggaaauccgcuagggaagcgguggaggacagccgauucugggaauuaguagauaaggagcggaaccugcacuuggaaggcaaaugcgagacuuguguguacaauaugaugggcaagagagagaaaaagcucggggaauuuggaaaggccaaagguucaagggcaaucugguacauguggcugggcgcucgcuuccuagaguuugaagcccuuggguuccugaacgaggaccauugguuuucccgugaaaauucucucagcggaguugagggcgagggucugcacaaguugggguauauucugcgggaugucaguaaaaaggaaggaggcgcaauguacgccgacgacacagcuggcugggauaccagaauaacucucgaggaccuuaaaaacgaagagauggugacaaaucacauggaaggggagcauaagaagcuggccgaggcgaucuucaaauuaaccuaucaaaacaagguggucaggguucagcgcccuacaccccgaggaacugugauggauauuaucucccggagagaccagagggguagcggccaaguagggaccuacggacugaauacguuuaccaacauggaagcacaguugauccgccagauggagggcgaagguguguucaaaaauauucagcaccucacagucacugaggagguggccguucaaaacuggcuggcuagaguggggcgggaaaggcuaucucguauggccauaucaggagaugacugcgucgugaagccacuugaugaccgauucgcaaacgcucugaccgcccucaaugauaugggcaaaauccgcaaggacauucagcagugggagcccaguaagggcuggaacgauuggacacagguaccuuuuugcucccaucacuuccaugaacugaucaugaaagacgggagaguuuugguggucccaugucggaaucaagaugaguuaauuggaagggcucgcaucagccagggugccggcuggucucugagagaaacugcaugccucgggaagucguaugcgcagauguggucacuuauguacuuucaccggagggaccugcgacuagccgcuaacgccauauguagcgcagugccgucccacugggugcccaccagucguacgacauggucuauccaugcuaaacacgaguggaugaccacugaggacaugcugacagucuggaauagaguuuggauucgcgaaaacccuuggauggaggauaagaccccaguggaaagcugggaggaaauccccuaucucggaaaacgggaggaccaguggugcggcuccuugauuggucugacuucaagggccaccugggcaaagaauauccaagccgcgauaaaccagguaagaagucuuauugggaaugaggaauacacagauuacaugccuucuaugaagcgcuuccggagggaggaagaggaagcuggagugcugugguga

SEQ ID NO: 14851 - RNA, 9876 nt, Artificial Sequence
  derived and/or modified CDS sequence (opt3) from DENV-2__EU482674__SS-prME
agcgccggcaugaucauuaugcugauaccaaccgugauggcuuuccaccucacuacuagaaacggggagccucauaugaucgucuccauucaggaaaaggggaaaucucuucuguuuaagacggaggacgguguuaauaugugcaccuugauggcgauggauuuaggcgaacugugugaggacacgaucacuuacaaaugcccacuacucaggcaaaacgaaccggaggauauugacuguuggugcaauucaaccaguacaugggugaccuaugggacuuguacaaccacgggagagcaccggcgcgaaaagcgaagcguagcccuggugccacaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggugcucauuuucauccugcugacugcuguugcaccaucgaugacaaugcgcugcauaggcauuucaaacagagauuuuguggaaggggucagcggagguaguuggguggacaucguacucgagcacggcuccuguguuaccacuauggccaagaauaagcccacauuagauuucgaacugauuaaaaccgaggcuaagcagccugccacgcuuaggaaauauugcaucgaagcgaaguugaccaacacaacuaccgagucucgguguccaacacaaggggagcccagccugaaagaagaacaagacaagcgcuuugugugcaagcauuccauggucgaucgaggauggggcaaugguugugggcuauucggaaaaggcggcaucgugacuugcgcaauguuuaccugcaagaaaaacauggaagggaagauugugcagccugagaaucucgaauacacaauagucguuaccccacacucaggagaggagcaugccguggguaacgacacuggcaaacacgggaaggaaaucaaaguaacgccgcagaguagcauuacagaggcugaacugaccggauauggcacugugaccauggaguguucucccagaacaggucuugauuucaaugaaaugguccuguugcaaauggagaacaaggccuggcucgugcacaggcagugguuucuggacuuaccucugccauggcuccccggggcagauaagcaggaguccaauuggauccagaaagaaacccuuguuacuuucaagaacccucaugcuaaaaagcaagacguggucgugcugggcucacaggagggagccaugcacacagcguugacgggcgccaccgaaauacagaugagcagugggaaucuacuguuuacuggacaucucaaaugccggcugcguauggacaaacuucaacugaaggguaugucuuacuccauguguacaggcaaauucaagguaguuaaagagauugcagagacccagcacgggacaaucgugauccgcguccaguaugaaggagauggcagcccaugcaagauucccuucgagaucauggacuuggagaagcgguacgugcucgguaggcugauuacugucaacccgauagugaccgagaaggauucgccuguuaacaucgaagcugagcccccauuuggggacucuuacauuaucaucggcguggagccuggacaguuaaagcugaauugguucaaaaagggcuccucaauugggcaaauguuugaaacgaccaugcggggagccaaacgaauggcuauacuaggugauacagccugggacuucggcagucucgggggaguauuuacuagcaucggcaaggcacugcaucaggucuucggugccauuuauggggcugcguuuuccggcgugucuuggaccaugaaaauccuuauuggaguuaucauaacauggaucggcaugaacagccgcucaacaaguuuguccgugagccugguccucguggggauuguaacccuguaccuuggagugaugguucaggcagauucuggcugugucgugucauggaagaauaaggagcugaaaugcgguagugggaucuucauuacggacaacgugcacacauggaccgaacaguauaaguuucaacccgagagcccauccaaauuggccucugcuauccagaaggcccaggaagagggaauauguggcauuagaucggucacuaggcucgagaaucugauguggaaacagaucacacccgaauuaaaccacauucuggcagagaaugaaguuaagcuaaccaucaugacuggugauauacggggcaucaugcaagccgggaaacgcagccucagaccucagccaaccgagcugaaguacuccuggaagacauggggaaaagcuaagaugcuuucaacggaaaguuauaaccagaccuucuugauugacggcccggagacugccgagugccccaauacaaacagggcauggaacucucuggaaguggaggauuacggguuuggaguguucaccacaaacaucuggcucaaacugaaggaaaaacaggacgcguuuugugacagcaaguuaauguccgcugccauuaaggauaaucgugcaguacaugccgacaugggcuauuggaucgagucagcucugaacgauacuuggaaaauagagaaggccagcuucauugaagucaaaaauugccacuggccuaagucucauacccuuugguccaacgguguguuggagagugaaaugaucauccccaagaaucucgcagggcccguuagccaacacaauuaccggccuggauaccacacgcagauugcuggcccauggcaucuggguaagcuagagauggacuucgauuuuugugacggcacaaccgugaucgucacugaagauugcgggaaccgaggacccucucugagaaccacaacugccuccggcaagcucauuaccgaguggugcuguaggucaugcacacugccgccucuucgcuauagaggggaagacggauguugguacggcauggaaauaagaccauugaaagagaaggaagagaaucuggugaacaguuuaguuacggcgggucacggacagguggauaauuucagccucggaguacugggcauggcccuuuuucuggaagagauguugaggacccgcgucgguacuaaacaugcuauccuccugguggcagugucguucgucacacuaauuaccggcaacauguccuuuaaggaccuggggcgaguugugguaauggugggagccacuauggcugaugacaucggcaugggggucacauaucucgcccugcuugcagcguucaaagugcggcccaccuuugccgcuggauugcuguuacguaagcucacgucuaaggagcugaugaugacuaccauuggcaucguucuucugagccaaucaacaauaccugaaaccgugcuagagcucacugaugcccuggcauuggguaugaugguccugaaaaucgugagaaauauggaaaaguaccaguuagcuguuacaauuauggccauccucugcgugcccaacgcagucauucugcagaaugccuggaaaguaaguuguaccauccuugcugugguuuccgugucuccacuguugcucacaagcucccagcaaaagacugacuggauaccucuggcgcuaaccauuaaagggcugaaccccacggccaucuuccuuacaacccucucaaggacuaauaagaaacgcagcuggccacugaacgaggcaaucauggcugucggaauggugaguauuuuggccucuucccuguuaaagaaugacauaccgaugaccggcccucucguagccggcgggcugcuuacagugugcuauguccugacuggacggagcgcugauuuggaacucgagagagcaaccgacguuaagugggaggaucaggccgaaaucucggguucaucucccauucugaguaucacgauuuccgaggacggcagcaugucuaucaaaaacgaagaggaggaacagacacuaaccauacugaucaggacugggcuucucgugauuagcggacuguuuccaaucuccauucccaucacagcggcugccugguacuugugggaggugaagaaacagcgagcaggcgucuuaugggaugugccuucaccacccccuauggguaaggccgaacuggaggacggggcuuaucgcauaaaacaaaaggggauucucggccacagucagaucggcgcagggguuuacaaggaaggaaccuuccauacuauguggcacguaacacggggugccgugcugaugcacaaaggcaagagaaucgagccgagcugggcggaugucaaaaaggaccuuauuucuuacgggggaggcuggaaacuggagggugaauggaaggagggggaagaggugcagguuuuggcucuagaaccaggaaagaaucccagggccgugcagaccaaaccuggccuguuuaagacgaacacuggcaccaucggggcagucucccucgauuucucaccaggaacaagugguagccccauaauugacaaaaagggcaaagugguagggcuguauggaaacggcgucgugacccguuccggugccuacguuucugcuaucgcccaaacagagaagaauauugaggauaacccugaaaucgaggacgauauauuucgcaagcggagacuuacuauuauggacuuacauccgggggcaggaaaaaccaagagguaucugcccgcuaucgugcgagaagccaucaaacggggccuccgcacguugauucuggcgccaacaagagucguggccgcagagauggaagaggcucucaggggccugccuauccgguaccagacucccgccauucgagcugagcacaccgggagagaaauaguugaccuuaugugucaugcaacauucaccaugcgccuguugucgccagugagggucccuaauuauaaccuaaucauuauggaugaggcccacuucacugaccccgccagcaucgcugcgcguggauacaucucaacccggguggaaaugggugaggcagccggcauuuuuaugacagcuacgccaccgggguccagagauccuuucccccagaguaaugccccaauaaucgacgaggaaagggagauucccgaacgcucuuggaacagcggacaugaguggguaacugauuuuaagggcaaaaccgugugguucguuccuuccaucaaggcagguaaugacauugccgcuugccugcgaaagaacgggaaaaaggucauccaacucucaagaaaaacauuugauucugaauaugugaagacccggacuaaugacugggauuucguggucacaaccgacauaagcgagaugggagcgaacuuuaaagccgagaggguaaucgauccacgccguuguaugaagcccgugauuuuaacggacggcgaagagagaguuauccuggcaggcccuaugccggugacucacaguuccgcugcccagcggagggggcgcauuggacgaaaucccaaaaacgaaaaugaccaguacaucuacaugggugagccccuugaaaacgaugaggacugcgcacacuggaaggaggccaagaugcugcucgauaauauaaacacaccugaaggcauuauccccagcauguucgagccagaaagagagaaagucgacgcuauugauggggaauaucgguugaggggagaggcccgcaagaccuuuguggaccugaugagaaggggcgaucucccuguuuggcuggcguacaaaguggcagccgaggguaucaacuaugcugaccggcguugguguuucgaugggauaaagaauaaccagauccuugaagagaaugucgaaguggagauuuggaccaaagagggcgaacgcaagaagcuaaaaccccgauggcuggacgccagaaucuacucugauccauuggcuuuaaaggaguuuaaagaguucgcagccggaaggaagucacugacucucaaccugauuacagagaugggccggcuuccuaccuucaugacacagaaaacucgcgacgcucuggauaaucucgccguauugcauacggcagaagcaggagggagagcauauaaccacgcucuguccgagcuaccggagacccuggaaacacuccuucuguuaacuuugcuggccaccgugacagguggcaucuuucucuuccugaugagugggaggggaauaggcaagaugacccuugguaugugcugcauuaucacugcaagcauccugcucugguacgcucagauucagccccauuggaucgccgcaucgauaauuuuggaguuuuuccugaucguuuuacuaauuccagaaccugagaagcagcggacgccccaagacaaucagcugaccuaugucgugaucgccauacucacaguggucgcugcgacuauggccaacgaaaugggguuucuugagaaaaccaagaaagaccugggcuugggaucuaucgcaacacagcagccagaguccaauauucuggauaucgaccuccgaccugcuagcgccuggacccuguacgccguugcaacuacauucgugacgcccaugcuuagacacucaauugaaaacaguucuguaaaugugucccucaccgcuaucgccaaccaagcgacuguccugaugggcuuggggaagggauggccgcugagcaaaauggauauuggugugccauuacuagcuaucggcuguuacucacagguuaauccuauaacacugaccgccgcacuccuucuguugguggcccacuaugcuauuaucgggcccggacugcaggcaaaggccacccgcgaggcgcagaagagggcugccgcaggcaucaugaaaaacccaacagucgacgguauuacuguaauagaucucgaccccaucccuuacgauccgaaguuugaaaaacaacugggacaggugaugcuuuuaauucugugcguuacacaggugcucaugaugcggaccacaugggccuugugugaggcucugacucuagccaccggccccaucaguacacugugggaaggaaauccaggccguuucuggaacaccacuauugcagucagcauggcuaauaucuuuagaggguccuaucucgccggagcgggccuucuguucucuauaaugaagaacacgacaaacaccaggcgcgguacugggaauaucggagagaccuugggcgagaaauggaaaagccggcugaacgcccucgguaaauccgaauuucaaauuuacaagaagucaggcauccaggagguggaccgaacacuggcaaaagaagggauuaagagaggagagacugaucaucacgcugucucuaggggcagugccaaauuacgcugguucguggagcggaauaugguuaccccugaagggaaggugguagaccuuggaugcggcagagguggguggucguauuacuguggaggccugaaaaacgugcgugaggucaagggucucacaaagggcgggcccggacaugaggaaccuaucccaaugagcacguauggcuggaaucuaguuaggcugcaguccgggguggaugucuuuuucauacccccugaaaaaugcgacaccuugcugugugauauuggagagucuucaccaaaccccacuguggaggcaggccggacacuccgcguacuuaaucugguggaaaacugguugaauaacaauacccaguucugcaucaagguucugaacccguacaugccuagcgugaucgagaaaauggaagcucuccaacgaaaguacgguggggccuuagucagaaauccacuguccaggaacaguacucacgagauguauugggugucuaaugccagcggaaacauugucucauccgugaacaugauaagucggaugcuuaucaaucgcuuuacaaugagacauaaaaaggcgaccuacgaacccgacguugaccugggcagcggcacgaggaacauugggaucgagucugagaagccuaaucuagauauuaucggaaaacgaauagaaaagaucaaacaggagcacgaaaccuccuggcacuaugaccaggaucauccauacaagacaugggcuuaucacgguucauacgagacuaaacagaccggcagcgcaucgucuaugguaaacggggugguccggcuccugacaaagcccugggacguguugccgacuguuacccaaauggccaugacagauaccacuccuuucggacagcagcguguguuuaaggaaaaagucgacacgagaacacaggagcccaaggagggcaccaaaaagcugaugaaaauuacugcugaauggcucuggaaggagcuugguaaaaagaagaccccacgcauguguacaagggaagaguucacgcggaaagugagaaguaaugccgcacugggggccaucuuuaccgaugagaacaaguggaaauccgcucgcgaagcgguagaggacagcagguucugggaauuaguggauaaggagcgaaaucugcauuuggaaggaaaaugcgagacuuguguuuauaacaugaugggcaagcgggagaagaaacucggcgaauuugggaaggccaaaggaucaagagcaauuugguacauguggcugggugcuagguuccuagaguuugaagcccuuggcuuccugaaugaggaccacugguuuucccgcgaaaacucucucagcggggucgagggagagggccugcacaaguuggguuacauccugcgugaugugaguaaaaaggaagggggagcaauguaugccgacgacacagcuggcugggauacccggauuacucucgaggaccuuaagaaugaagagauggugacaaaccauauggaaggcgagcacaaaaagcuggccgaggcgauauucaaauuaaccuaccaaaauaaggucguuagagugcagaggccuacaccccgcgggacuguaauggauaucauuucccgacgggaccagagaggaagcggucaagugggcaccuaugggcugaacacguuuaccaauauggaagcacaguugaucaggcagauggagggagaaggcgucuucaaaaacauccagcaucucacagugacugaggagguugccgugcacaacuggcuggcucgcgucgguagagaacggcuaucuaggauggccauuucaggggaugacugcgugguaaagccacuugaugaccguuucgcaaaugcucugaccgcccucaacgauaugggaaagauacgaaaagacauccaacagugggagcccaguaagggcuggaaugauuggacacagguuccuuuuugcucccaucacuuccacgaacugauuaugaaagacggccgcguguuggucgugccauguagaaaccaggaugaguuaaucgggcgggcuaggauuagccaaggagccgguuggucucugcgcgaaacugcaugccucggcaagucguacgcgcagauguggucacuuauguauuuucauagacgggaccugaggcuagccgcuaaugccaucuguagcgcagugccgucccacuggguccccaccagucgaacgacauggucuauacaugcuaaacacgaguggaugaccacugaggacaugcugacaguuuggaaccguguguggaucagagaaaauccuuggauggaggauaagaccccaguagaaagcugggaggaaauucccuaccucgggaagcgcgaggaccaguggugcggauccuugaucggccugacuucacgggccaccugggccaaaaacauucaggccgcgaucaaucaagugaggagucuuauagguaacgaggaauauacagauuacaugccuucuaugaagagauuccgccgggaggaagaggaagcugggguccugugguga

SEQ ID NO: 14852 - RNA, 9876 nt, Artificial Sequence
  derived and/or modified CDS sequence (opt3) from DENV-2__EU482676__SS-prME
agcgccuccaugaucauuaugcugauaccaaccgugauggcuuuccaccucacuacuagaaauggcgagccucauaugaucgucgggauucaagaaaagggaaaaucucuucuguuuaagacggaggacgguguuaauaugugcaccuugauggcaauggauuuaggcgaacugugugaggacacaaucacuuacaaaugcccacuacucaggcaaaacgaaccggaggauauugacuguuggugcaauucaaccaguacaugggugaccuaugggacuuguacaaccacgggagagcaccggcgcgaaaagcgaagcguagcccuggugccacaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggugcucauuuucauccugcugacugcuguugcaccaucgaugacaaugcgcugcauaggcauuucaaacagagauuuuguggaaggggucagcggagguaguuggguggacaucguacucgagcacggcuccuguguuaccacuauggccaagaauaagcccacauuagauuucgaacugauuaaaaccgaggcuaagcagccugccacgcuuaggaaauauugcaucaaggcgaaauugaccaacacaacuaccgaaucucgguguccaacacaaggggagcccagccugaaggaggaacaggacaagcgcuuugugugcaaacauuccauggucgaucgaggauggggcaaugguugugggcuauucggaaagggcggcaucgugacuugcgcaauguuuaccugcaaaaagaacauggaggggagaauugugcagccugaaaaucucgaguacacaauagucguuaccccacacucaggagaggaacaugccguggguaacgacacuggcaaacacgggaaggagaucaaaguaacgccgcagaguagcauuacagaagcugagcugaccggauauggcacugugaccauggaauguucucccaggacaggucuugauuucaaugagaugguccuguugcaaauggaaaacaaggccuggcucgugcaccggcagugguuucuggacuuaccucugccauggcuccccggggcagauaagcaggaguccaauuggauccagaaagagacccuuguuacuuucaagaacccucaugcuaaaaagcaagacguggucgugcugggcucacaggaaggagccaugcacacagcguugacgggcgccaccgagauacagaugagcagugggaaucuacuguuuacuggacaucucaaaugccgucugcgcauggacaaacuucaacugaaggguaugucuuacuccauguguacaggcaaauucaagguaguuaaagaaauugcagagacccagcacgggacaaucgugaucagaguccaguaugagggagauggcagcccaugcaagauucccuucgaaaucauggacuuggagaaaagguacgugcucggucggcugauuacugucaacccgauagugaccgaaaaggauucgccuguuaacaucgaggcugaacccccauuuggggacucuuacauuaucaucggcguggagccuggacaguuaaagcugaauugguucaaaaagggcuccucaauugggcaaauguuugagacgaccaugcgaggagccaaacgcauggcuauacuaggugauacagccugggacuucggcagucucgggggaguauuuacuagcaucggcaaggcacugcaucaggucuucggugccauuuauggggcugcguuuuccggcgugucuuggaccaugaaaauccuuauuggaguuaucauaacauggaucggcaugaacagcagaucaacaaguuuguccgugagccugguccucguggggauuguaacccuguaccuuggagugaugguucaggcagauucuggcugugucgugucauggaagaauaaggaacugaaaugcgguagugggaucuucauuacggacaacgugcacacauggaccgagcaguauaaguuucaacccgaaagcccauccaaauuggccucugcuauccagaaggcccaggaggaaggaauauguggcauuaggucggucacucggcucgagaaucugauguggaaacagaucacacccgaguuaaaccacauucuggcagaaaaugagguuaagcuaaccaucaugacuggugauauaaaaggcaucaugcaagccgggaagcgcagccucagaccucagccaaccgaacugaaguacuccuggaaaacauggggaaaggcuaaaaugcuuucaacggagaguuauaaccagaccuucuugauugacggcccggaaacugccgagugccccaauacaaacagggcauggaacucucuggagguggaagauuacggguuuggaguguucaccacaaacaucuggcucaagcugaaagagaagcaggacguauuuugugacagcaaguuaauguccgcggcuauuaaagauaaucgugccguccaugcagacaugggcuauuggaucgaaucagcccugaacgauacuuggaagauagagcgggcuagcuucauugaggugaaaaauugccacuggccuaagucucauacccuuugguccaacgguguuuuggaaagugagaugaucauccccaagaaucucgccgggcccgugagccaacacaauuaccgaccuggauaccacacgcagauugcaggcccauggcaucuggguaagcuagaaauggacuucgauuuuugugacggcacaaccgucaucgugacugaggauugcgggaacagaggacccucucugaggaccacaacugcuuccggcaagcucauuaccgaauggugcugucgcucaugcacacugccgccucuucgguauagaggggaggacggauguugguacggcauggagauaaggccauugaaagaaaaggaggaaaaucugguuaacaguuuagugacggccggucacgggcagguagauaauuucagccucggaguccugggcauggcgcuuuuucuggaggaaauguugcgcacccgaguggguacuaaacaugccauccuccugguggcugucucguucguuacacuaauuaccggcaacauguccuuuaaggaccuggggcgggugguagugauggucggagcaacuauggccgaugacaucggcaugggggugacauaucucgcucugcuugccgcauucaaaguucgucccaccuuugcggccggauugcuguuaagaaagcucacgucuaaggagcugaugaugacuaccauuggcaucgugcuucugagccaaucaacaauaccugagaccguccuagaacucacugaugcucuggccuuggguaugauggugcugaaaaucguuaggaauauggagaaguaccaguuagcagugacaauuauggcuauccucugcguccccaacgccguaauucugcagaaugcauggaaagugaguuguaccauccuugccguuguguccgucucuccacuguugcucacaagcucccagcaaaagacugacuggauaccucuggcucuaaccauuaaagggcugaaccccacggcgaucuuccuuacaacccucucacgcacuaauaagaaacggagcuggccacugaacgaagccaucauggcagugggaaugguaaguauuuuggcuucuucccuguuaaagaaugacauaccgaugaccggcccucucguggccggcgggcugcuuacagucugcuauguucugacuggaagaagcgccgauuuggagcucgaaagggcuaccgacgugaagugggaggaucaggcagagaucucggguucaucucccauucugaguaucacgauuuccgaagacggcagcaugucuaucaaaaacgaggaagaggagcagacacuaaccauacugauccgaacugggcuucucgugauuagcggacuguuuccaaucuccauucccaucacagccgcggcuugguacuugugggaagucaagaaacagcgcgccggcguguuaugggauguuccuucaccacccccuauggguaaggcagagcuggaagacggggccuaucggauaaaacaaaagggcauucucggauacagucagaucggcgcugggguauacaaggagggaaccuuccacacuauguggcaugugacaagaggugcaguccugaugcacaaaggcaagaggaucgaaccgagcugggccgaugugaaaaaggaccuuauuucuuaugggggaggcuggaaacuggagggugaguggaaggaaggggaggaaguucagguguuggcgcuagagccaggaaagaauccccgugcuguccagaccaaaccuggccuguuuaagacgaacacuggcaccaucggggccgugucccucgauuucucaccaggaacaagugguagccccauaauugacaaaaagggcaaaguagucgggcuguacggaaacggcgugguuacccgcuccggugcauaugugucugccaucgcucaaacagaaaagucgauugaggauaauccugagaucgaagacgauauauuucggaagagaaggcuuacuauuauggacuuacacccgggggccggaaaaaccaagcgauaccugcccgcaaucguccgggaggcuaucaaacgcggccucagaacguugauucuggccccaacaagggugguugcggccgaaauggaggaagcacuccggggccugccuauccgauaucagacucccgcuauuagagccgagcauaccgggcgcgagauaguggaccuuaugugucacgcuacauucaccaugaggcuguugagcccaguccgugugccuaacuacaaucuaaucauuauggaugaagcacauuucacugaccccgccucaaucgccgcucggggauauaucuccaccagaguagagaugggugaagcggcaggcauuuuuaugacagccacgccaccggggaguagggauccuuucccccagucuaacgcuccaauaaucgacgaggagcgcgaaauucccgagcgaagcuggaacuccggacacgaaugggugacugauuuuaagggcaaaaccguuugguucgucccuucaaucaaggccgguaacgacauugcagccugccugagaaagaaugggaaaaaggugauccaacucucucggaaaacauuugauagcgaguacgugaagaccaggacuaacgacugggauuucgucguaacaaccgacauaagugaaaugggagcuaauuuuaaagcggagcgcgugaucgauccacguagauguaugaagcccguuauuuuaacggacggcgaggaacgggugauccuggccggcccuaugccggucacucauuccagcgcagcucagaggcgcgggcgaauuggaagaaaccccaagaaugagaacgaccaguacaucuauaugggugaaccccuugagaaugaugaagacugcgcccacuggaaggaggcaaagaugcugcucgauaacauaaauacaccugagggcauuauccccucuauguucgaaccagagcgggaaaaaguggacgccauugauggggaguacagguugcgcggagaagcuagaaagaccuuuguugaccugaugaggcggggcgaucucccuguguggcuggccuauaaagucgcggcagaggguaucaacuacgccgaccgucgcugguguuucgaugggauaaagaacaaucagauccuugaggaaaacguggagguagaaauuuggaccaaagagggcgagcgaaagaagcuaaaacccagauggcuggacgcuaggaucuauucagauccauuggccuuaaaggaauuuaaagaguucgcugcaggacggaagucccugacucucaaucugauuacagaaaugggccgccuuccuaccuucaugacacagaaaacuagagacgcccuggauaaccucgcuguguugcacacggccgaggcagggggaagggcguacaaucaugcccugagugaacuaccggagacccuggagacacuccuucuguuaacuuugcuggcuaccguuacagguggcaucuuucucuuccugaugagcgggcggggaauaggcaagaugacccuugguaugugcugcauuaucacugccucgauccugcucugguaugcacagauucagccccacuggaucgcugccucuauaauuuuggaauuuuuccugaucgucuuacuaauuccagagccugaaaagcagcgaacgccccaagacaaccagcugaccuacguggugaucgcaauacucacagucguugccgcuacuauggcgaaugagaugggguuucuugagaaaaccaagaaagacuucggccugggauccaucgccacacagcagccagagagcaacauuuuggauaucgaccugagaccugcaucagcuuggacccucuacgccguggccacuacauuuguaacgcccaugcugcgccauaguauugaaaauucuuccgugaacgucagccuuaccgcaaucgcuaaucaagccacugugcucaugggccuggggaagggauggccguugucaaaaauggauauugguguuccacuguuagcgaucggcuguuauagucaggugaacccuauaacacuaaccgcugcccugcuccuucuggucgcacacuacgccauuaucgggcccggauugcaggcuaaggcaaccagggaagcccagaagcgggcggcugccggcaucaugaaaaauccaacaguagacgguauuacugugauagaucuggaccccaucccuuaugauccgaaguucgagaaacaacucgggcagguuaugcugcuuauuuuaugcgugacgcagguccugaugaugcguaccacaugggcacucugugaagccuugacucuggcuaccggccccaucagcacacuaugggagggaaacccaggcagauuuuggaauaccacuauugccguguccauggcaaacaucuucagggggucuuaccuggcuggagccggccuccuuuuuagcauaaugaagaauacgacaaacacccgccgggguacugggaacaucggagaaacccugggcgagaaauggaagucccgauugaaugcgcuggguaaaucagaguuccaaauuuauaagaagucuggcauccaggaagucgacagaacacucgccaaagaggggauuaagaggggagaaacugaucaccaugcagugagucgcggcucggcuaaacugcggugguuuguugagagaaacauggugaccccugaggggaagguaguggacuuaggaugcggccgugguggguggagcuacuauuguggaggccuuaggaauguccgggaaguuaaaggucugacaaagggcgggcccggacacgaggaaccuaucccaauguccacguacggcuggaaccucgugcgccuacagucuggggucgauguguucuucauacccccugagaagugcgacacccuguugugugauauuggagaaucaagcccaaaucccacuguagaggccggccgaacacugagagugcucaaccuuguugagaauuggcugaacaauaacacccaguuuugcaucaaaguguugaauccguacaugccuuccgucaucgaaaagauggaggcacugcaaaggaaauaugguggggcucucgugcggaacccauuaagucgcaauucuacucaugaaauguacugggucagcaacgccucaggaaauauuguguccaguguuaacaugauaagcagaaugcugaucaacagguucacaaugcgacacaagaaagccaccuaugagcccgacguagaccuuggcucuggcacgcggaauauugggaucgaauccgagauuccuaaccuggauaucauaggaaagcguaucgagaagauuaaacaggaacaugagaccucauggcacuacgaccaggaucacccauauaagacaugggcguaccaugguagcuaugaaacuaaacagaccggcucggcuucuaguauggugaauggggucgugagacuacucacaaagcccugggacguucugccgacugugacccaaauggcaaugacagauaccacuccuuuuggacagcagcgcgucuucaaagagaagguggacacgaggacacaggaacccaaggagggcaccaaaaaguugaugaaaaucacugccgaguggcuguggaaggaacucgguaaaaagaaaaccccacggauguguacaagagaggaauuuacgcgcaagguaagguccaacgcugcccuuggggcaauuuucaccgaugagaauaaguggaaaagcgcccgagaggcuguggaagacucacgguuuugggagcugguugauaaggaaagaaacuuacaccuggagggaaaaugcgaaacuugugucuacaauaugaugggcaagagggagaaaaaguugggcgaguucgggaaggcgaaaggaucccgcgccaucugguacauguggcucggugcacguuuucuggaguucgaggcucuaggcuuucuuaacgaagaccauugguucucucgggagaauagccugagugggguggaaggagagggccuccacaagcuggguuauauuuugagagauguguccaaaaaggaagggggagccauguacgcagacgacacagccggcugggauaccaggauaacucuggaagaccucaaaaacgaggaaauggucacaaaucacauggagggcgaacauaagaaacuugcugaggccaucuuuaaacugaccuaucaaaacaagguugugcgcguacagcgaccuacaccccgggggacugugauggauauuaucagcagaagggaccagcgcggaucuggucaagucggcaccuacggguuaaauacguucaccaacauggaggcgcagcugaucagacagauggaaggagagggcguguucaaaaauauucagcacuugacaguuacugaagagguggcaguccaaaacuggcucgcccggguggguagggagcgucugucacgaauggcuauaaguggggaugacugcguaguuaagccacuagaugaccgcuuugccaacgcacuuaccgcucugaaugauaugggaaaaaucagaaaggacauucagcagugggaacccuccaagggcuggaacgauuggacacaggugccuuucugcagccaucacuuucaugagcucaucaugaaagacggccggguccugguggugccauguaggaaucaagaugaauugauugggcgcgccagaaucucucagggagcugguuggucguuacgggagacugccugccugggcaagucauaugcacagauguggagccucauguacuuccacaggcgagaccuucgucuggcggccaacgcuauauguuccgccgucccgagucacuggguucccaccucuagaacgacauggagcauccaugcaaaacacgaauggaugaccacugaggacaugcuagcuguguggaaucgcguauggauucgggagaacccuuggauggaagauaagacaccaguggaguccugggaagagauccccuaucuggggaaaagggaagaccaguggugcggaucacucauuggcuugaccaguagagccacuugggcaaagaauauccaagccgcgauaaaccagguccgcucucugauugguaaugaggaguacaccgauuacaugccuagcaugaagcgguuuaggcgagaagaggaagaggcuggggugcuuugguga

SEQ ID NO: 14853 - RNA, 9876 nt, Artificial Sequence
  derived and/or modified CDS sequence (opt3) from DENV-2__EU482677__SS-prME
agcgcaggcaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacuaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucgugacggacaacguccacacauggaccgaacaguauaaguuucaacccgagaguccaagcaaauuggccuccgcuauucagaaggcccaggaagagggcaucugugguauaagaucuguuacuaggcucgagaaucugauguggaaacagauuacacccgaauuaaaccacauccuggcagagaaugaagugaagcuaaccauuaugacuggcgauaucaaagggauaaugcaagccggaaagcggucgcuccgcccucagccaaccgagcugaaguacagcuggaaaacauggggcaaggcuaaaaugcuuuccacggaaucauauaaccagaccuucuugaucgacgggccggagacugccgagugccccaauacaaacagagcauggaauagucuggaaguggaggauuacggauuuggcguauucaccacaaacauuuggcucaagcugaaagaaaagcaggacgcguuuugugacucuaaguuaaugagcgcugccaucaaagauaauagggcaguccaugccgacauggguuauuggauugaguccgcucugaacgauacuuggaagaucgagaaagccucauucauagaagugaagaauugccacuggccuaaaagccauacccuuuggucuaacgggguuuuggaguccgaaaugauuaucccaaagaaccucgcaggacccgugagucaacacaauuaccguccuggcuaccacacgcagaucgcugguccauggcaucugggcaagcuagagauggacuucgauuuuugugacgggacaaccgucauugugacugaagauugcggaaaccggggccccagccugcgaaccacaacugccucugggaaacucaucaccgaguggugcuguagauccugcacacugccgccucuuagguaucgcggagaggacggcuguugguacgguauggaaauucggccauugaaggagaaagaagagaaucugguuaacucauuagugacggcggggcacggacagguagauaauuucagucucggcguccuggguauggcccuuuuucuggaagagauguugagaaccagggugggcacuaagcaugcuauacuccugguggcagucagcuucguuacacuaaucaccgggaacaugucguuuaaagaccugggacgcgugguagugauggucggcgccacuauggcugaugacauugggaugggagugacauaucucgcccugcuugcagcguucaagguucgacccaccuuugccgcuggcuugcuguuacggaagcucacguccaaagagcugaugaugacuaccaucgguauugugcuucugucucaaagcacaaucccugaaaccguccuagagcucacugaugcccuggcauuggggaugauggugcugaagauaguucguaauauggaaaaauaccaguuagcugugacaaucauggccauucucugcguccccaacgcaguaauccugcagaaugccuggaaggugucauguaccauucuugcuguugugagugucuccccacuguugcucacaucuagccagcagaagacugacuggaucccucuggcgcuaaccauaaagggacugaaccccacggccauuuuccuuacaacccucuccagaacuaauaaaaagaggucauggccacugaacgaggcaaucauggcugugggcaugguaagcaucuuggccaguucucuguuaaagaaugacauuccgaugaccggcccucucguggccgggggacugcuuacagucugcuauguucugacuggucgcuccgcugauuuggaacucgagcgggcaaccgacgugaaaugggaggaucaggccgaaauaagcggcucgucacccauccugucuauuacgaucagugaggacggguccaugagcauuaagaacgaagaggaggaacagacacuaaccauccugauaagaacuggacuucucgugaucucuggccuguuuccaauuagcauccccauuacagcggcugccugguacuugugggaggucaaaaagcagagggccgguguguuaugggauguuccuuccccacccccuauggggaaagccgaacuggaggacggagcuuaucgaaucaagcaaaagggcauacucggcuacucacagauuggggcaggaguauacaaagaagguaccuuccacacuauguggcaugugacacgcggcgccguccugaugcacaaggggaaacggaucgagccgaguugggcggaugugaagaaagaccuuaucagcuauggaggcgguuggaagcuggagggggaauggaaggagggagaagagguucagguguuggcucuagaaccaggcaaaaaucccagagccguccagaccaagccuggccuguuuaaaacgucuacugggaccauuggagcagugucccucgauuucucaccagguacaaguggcagccccaucauagacaagaaagggaagguagucggacuguacggcaacggugugguuaccagguccggggccuaugugucugcuauugcccaaacagagaagucgaucgaggauaacccugaaauugaggacgauaucuuucguaaacgccggcuuacuauaauggacuuacacccgggagcaggcaagaccaaaagauaccugcccgcuauugucagggaagccaucaagcgaggccuccggacguugauccuggcgccaacacgcgugguugccgcagagauggaagaggcucucagagggcugccuauuagguaucagacucccgccauccgggcugagcauaccggacgagaaauuguggaccuuaugugucacgcaacauucaccaugagacuguugagcccaguccgcgugccuaauuacaaccuaauaaucauggaugaggcccauuucacugaccccgccucaauugcugcgagggguuauaucuccacccguguagaaaugggcgaggcagccgggaucuuuaugacagcuacgccaccgggaagucgggauccuuucccccagucuaaugccccaauuauagacgaggaaagagagauccccgaaaggagcuggaacuccggccacgagugggugacugauuuuaaagguaagaccguuugguucgucccuucaauuaaggcagggaaugacaucgccgcuugccugcgcaaaaacggaaagaaagugauucaacucucucgaaagacauuugauagcgaauacgugaaaaccaagacuaaugacugggauuucgucguaacaaccgacaucagugagaugggcgcgaacuuuaaagccgagagagugauagauccacggagguguaugaagcccguuaucuuaacggacggcgaagaacgcgugauucuggcagggccuaugccggucacucauuccagcgcugcccagcguagaggacggaucgguaggaauccaaagaacgaaaaugaccaguacauuuauaugggcgagccccuugaaaacgaugaggacugcgcacacuggaaagaggccaagaugcugcucgauaauaucaacacaccugaagggauaauucccucuauguucgagccagaacgcgagaaaguggacgcuaucgauggagaauaccgauugagaggcgaggcccggaagaccuuuguugaccugaugaggcgcggugaucucccuguguggcuggcguauaaagucgcagccgaggggauuaauuacgcugacagaaggugguguuucgauggcaucaagaacaaccagauacuugaagagaauguggaaguagagaucuggaccaaggagggagaacggaaaaagcuaaaaccccguuggcuggacgcccgcauuuauucagauccauuggcuuuaaaggaguuuaaagaguucgcagccggccgaaagucccugacucucaaccugaucacagagauggggagacuuccuaccuucaugacacaaaaggcuagggacgcccuggauaaucucgcaguguugcacacugcggaagccggaggucgggcuuacaaccaugcccugagugagcuaccggagacgcuggaaacccuccuucuguuaacauugcuggcaacuguuaccggcgggauuuuucucuuccugaugagcggacgcggcaucgguaaaaugacacuugggaugugcugcauaauuaccgcuucgauccugcucugguaugcccagauccagccccacuggauugcagccucuaucauauuggaguuuuuccugauugucuuacuaaucccagaaccugagaagcagagaacuccccaagacaaucagcugacguacguggugauugcuauccucaccgucguugcggccacaauggcaaacgaaaugggcuuucuugagaaaacuaagaaagaccugggauugggcuccauagcuacccagcagccagagagcaauauccuggauauugaccucaggccugccucagccuggacacuguacgcaguggcuaccacuuucguaacacccaugcuucggcauaguaucgaaaacucuuccgugaaugucagccucacggccauugcgaaccaagcuaccgugcugaugggguugggaaaggguuggccgcugucaaagauggauaucggcguuccauuacuagccauuggguguuauagucaggugaauccuaucacucugacagcagcccuccuucuguuggucgcucacuacgcaauaauuggacccggccugcaggccaaagcgacccgagaggcucagaagagagccgcagccgguaucaugaaaaacccaaccguagacgggaucacagugauugaucucgaccccauaccuuaugauccgaaguuugaaaaacaacugggccagguuaugcuuuuaauccugugcgugacucagguccucaugaugcgcacgaccugggcuuugugugaggcccugacacuagcaacuggacccauuagcacccugugggaaggcaauccagggagguucuggaacacaaccaucgcuguguccauggccaauauuuuucggggaucuuaccucgcgggcgccggucuucuguucagcaucaugaagaacacuacgaauacacguagagggaccggaaacauaggcgagacuuugggugagaaauggaaguccaggcugaacgcacucggcaagucagaauuucaaaccuauaaaaagucugggauccaggaggucgaccgcacacuggcuaaagaaggaauuaagcggggcgagacugaucaccaugccgugagucgagggucggcaaaauuaagaugguucguugagaggaauauggugaccccugaaggaaagguaguggaccuuggcugcggucgcgggggauggagcuacuauuguggcggucugaagaacguccgggagguuaaaggccucacaaaagggggacccggccacgaagaaccuaucccaauguccacguacggguggaaucuagugagacugcagucuggagucgauguguuuuucauucccccugaaaaaugcgacaccuugcugugugauaucggcgagucaagcccaaaccccacuguagaggcuggucguacacucagggugcuuaaucugguugaaaacugguugaauaacaauacccaguucugcauaaaggugcugaacccguacaugccuuccgucauugagaaaauggaagcccuccaacggaaguaugggggagccuuagugcgcaauccacugagucgaaacucuacucaugagauguacugggucagcaaugcgucaggcaacaucguguccaguguuaauaugaucagcagaaugcuuauuaacagguuuacaaugcggcacaagaaagcuaccuaugaacccgacguagaccugggcucugggacgcgcaacauaggaaaugaguccgagaucccuaaccuagauauuaucgguaagagaauugagaagaucaagcaggagcaugaaaccucauggcacuacgaccaggaucacccauauaaaacaugggcauaccauggcagcuaugagacuaagcagaccgggucggccucuaguauggugaauggagucgugaggcuccugacaaagcccugggacguuuugccgacugugacccaaauggcuaugacagauaccacuccuuucggccagcagcgagucuuuaaagaaaagguggacacgcggacacaggagcccaaagaggguaccaagaaacugaugaagauaacugccgaauggcucuggaaagagcuugggaagaagaaaaccccacguauguguacaagagaagaguucacgcgcaagguaagguccaacgcagcccugggagcuaucuuuaccgaugagaauaaauggaaaagcgcgcgggaagccguggaggacucaagauucugggaauuaguugauaaagagcgcaaccugcacuuggaaggcaagugcgagacuugugucuacaauaugaugggcaagagggagaaaaagcucggggaauuuggaaaagcaaaggguucccgagcuauuugguacauguggcugggcgcccgguuccuagaguuugaagcacuuggguuccugaacgaggaccauugguuuucuagagaaaauagccucaguggaguggagggcgagggucugcacaaauugggguauauccugagggauguguccaagaaggaaggaggcgccauguacgcugacgacacagccggcugggauacccgcauuacucucgaggaccuuaaaaacgaagagauggucacaaaucacauggaaggggagcauaagaaacuggcggaggcaaucuucaaguuaaccuaucaaaacaaaguugugcguguacagcggccuacacccagaggaacugugauggauauuauaagcaggcgcgaccagcgagguucuggccaagucgggaccuacggacugaauacguuuaccaacauggaagcccaguugauccggcagauggagggcgaagguguguucaagaauauucagcaccucacaguuacugaggagguggcuguccaaaacuggcuggccagaguggggagggaacgccuaucaagaauggcaaucaguggagaugacugcguaguuaagccacuugaugaccgguucgcuaacgcccugaccgcucucaaugauaugggcaaaaucaggaaggacauucagcagugggagcccuccaaaggcuggaacgauuggacacaggugccuuuuugcagccaucacuuccaugaacugauaaugaaggacgggcgugucuugguggugccaugucgaaaucaagaugaguuaaucggacgcgccagaauuucucagggugcaggcuggucgcugcgggaaacugcgugccucgggaaaucauaugcccagauguggagccuuauguacuuucacaggcgcgaccugagacuagcugccaacgcaaucuguuccgcugucccgagucacuggguucccaccucucggacgacauggagcauucaugccaagcacgaguggaugaccacugaggacaugcugacaguguggaauaggguauggauccgagaaaacccuuggauggaggauaagaccccaguggaauccugggaggaaauacccuaucucggaaaacgugaggaccaguggugcggcucauugaucggucugacaaguagagcaaccugggccaagaauauucaagucgcgaucaaccaggugcgcucucuuauugggaaugaggaauacacagauuacaugccuagcaugaaacgguucaggagagaggaagaggaagcuggaguucugugguga

SEQ ID NO: 14854 - RNA, 9876 nt, Artificial Sequence
  derived and/or modified CDS sequence (opt3) from DENV-2__EU482678__SS-prME
agcgcaggaaugaucauuaugcugauaccaaccgugauggcuuuccaccucacuacucggaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagaugagcaggaaucuaauuggauccagaaggagacccuuguuacuuucaaaaacccucaugcuaagaaacaagacguggucgugcugggaucccaggaaggcgccaugcacacagcguugacgggggccaccgagauacagaugucaagcggaaaucuacuguuuacuggucaucucaagugccggcugcguauggacaaacuucaacugaagggcaugaguuacucuauguguacagggaaguucaaaguaguuaaggagauugcagaaacccagcacggaacaaucgugauccgcguccaguaugagggcgaugguuccccaugcaaaauucccuucgaaaucauggacuuggagaagagauacgugcucgggaggcugauuacugucaacccgauagugaccgaaaaagauagcccuguuaacaucgaggcugagcccccauuuggcgacucguacauuaucaucggaguggaaccuggccaguuaaagcugaauugguucaagaaagggucuuccauuggacaaauguuugagacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggaacugaagugcgggucaggaaucuucauuacggacaacgugcacacauggaccgagcaguauaaauuucaacccgaaaguccaagcaaguuggccuccgcuauccagaaagcccaggaggagggcauaugugguauuagaucugucacuaggcucgaaaaucugauguggaagcagaucacacccgaguuaaaccacauucuggcagaaaaugagguuaaacuaaccaucaugacuggcgauauaaaggggaucaugcaagccggaaaacggucgcuccgcccucagccaaccgaacugaaguacagcuggaagacauggggcaaagcuaagaugcuuuccacggagucauauaaccagaccuucuugauugacgggccggagacuacagaaugccccaauaccaacagagccuggaauagucuggagguggaagauuacggauuuggcguguucacaacuaacaucuggcucaaacugaaggagaaacaggacgcauuuugugacucuaaguuaaugagcgcggcuauuaaggauaauagggccguacaugcagacauggguuauuggaucgaguccgcccugaacgauaccuggaaaauagaaaaggcuucauucauugaggucaaaaauugccacuggccuaagagccauacgcuuuggucuaacgggguguuggaauccgagaugaucauccccaagaaccucgccggacccguuagucaacacaauuaccguccuggcuaccacacacagauugcagguccauggcaucugggcaagcuagaaauggacuucgauuuuugugacgggaccacugugaucgucaccgaggauugcggaaaccggggccccagccugcgaacaacuaccgcuucugggaagcucauuacagaguggugcuguagauccugcacgcugccgccucuuagguaucgcggagaagacggcuguugguacgguauggagauacggccauugaaagaaaaggaggaaaaucuggugaacucauuaguuaccgccgggcacggacagguggauaauuucagucucggcguacuggguauggcgcuuuuucuggaggagauguugagaacuagggucggcacaaaacaugccauccuccugguggcugugagcuucgucacccuaauuacugggaacaugucguuuaaggaccugggacgcguugugguaauggugggcgcaacaauggccgaugacaucgggaugggagucaccuaucucgcucugcuugccgcauucaaagugcgacccacguuugcggccggcuugcuguuacggaagcucacuuccaaggaacugaugaugaccacaauugguaucguucuucugucucaaagcaccauaccugagacugugcuagaacucacagaugcucuggccuuggggaugaugguccugaaaaucgugcguaauauggagaaguaccaguuagcaguuaccauuauggcuauccucugcgugcccaacgccgucauucugcagaaugcauggaaaguaucauguacaauccuugccgugguuaguguguccccacuguugcucacuucuagccagcaaaagaccgacuggauaccucuggcucuagcgauuaaaggacugaaccccacggccaucuuccuuacaacccucuccagaacuaauaagaaaaggucauggccacugaacgaagcaaucauggcugucggcauggugagcauuuuggccaguucucuguuaaagaaugacauaccgaugaccggcccucucguagccgggggacugcuuacagugugcuauguccugacuggucgcuccgcugauuuggagcucgagcgggcaaccgacguuaagugggaagaucaggccgagaucagcggcucgucacccauucugucuaucacgauuagugaagacggguccaugagcaucaaaaacgaggaggaggagcagacacuaaccauacugaucagaacuggacuucucgugauuucuggccuguuuccaaucagcauucccaucacagcggcugccugguacuugugggaagugaagaaacagagggccggugucuuaugggaugugccuuccccacccccuauggggaaggccgagcuggaagacggagcuuaucgaauaaaacaaaagggcauucucggcuacucacagaucggggcaggaguuuacaaggaggguaccuuccacacuauguggcauguaacacgcggcgccgugcugaugcacaaagggaagcggaucgagccgaguugggcggaugucaaaaaggaccuuauuagcuauggaggcgguuggaaacuggaaggggaguggaaggaaggagaggaagugcagguuuuggcucuagagccaggcaagaaucccagagccgugcagaccaaaccuggccuguuuaagacgaacacugggaccaucggagcagucucucucgauuucuccccagguacaucaggcagucccauaauugacaaaaaggggaaagugguaggacuguacggcaacggugucgugaccaggagcggggccuauguuuccgcuaucgcccaaacagagaagucuauugaagauaauccugagaucgaagacgauauauuucguaagcgccggcuuacuauuauggacuuacacccgggagcaggcaaaaccaagagauaccugcccgcuaucgugagggaggccaucaaacgaggccuccggacguugauucuggcgccaacacgcgucguggccgcagaaauggaggaggcucucagagggcugccuaucagguaucagacucccgccauucgggcugaacauaccggacgagagauaguugaccuuaugugucacgcaacauucaccaugagacuguugucgccagugcgcgucccuaacuacaaucuaaucauuauggaugaagcccauuucacugaccccgccagcaucgcugcgagggguuauaucucaacccguguggagaugggcgaggcagccgggauuuuuaugacagcuacgccaccgggaucccgggauccuuucccccagaguaacgccccaauaaucgacgaagagagagaaauucccgagaggucuuggaauacuggccacgaauggguaaccgauuuuaaggguaaaacagugugguucguuccuagcaucaaggcagggaacgacauugccgcuugccugcgcaagaauggcaaaaaggucauccaacucucccgaaaaaccuuugauucagaguacgugaagacuagaacaaacgacugggauuucguggucaccacggacauaucugagaugggcgcgaauuuuaaagccgaacggguaaucgauccaaggcgcuguaugaagcccgugauuuuaacugacggcgaggaacguguuauccuggcagggccuaugccggugacacauagcagugcugcccagagacggggaaggauuggucgcaaccccaaaaaugagaacgaccaguacaucuauaugggcgaaccccuugagaaugaugaggacugcgcacacuggaaggaagccaagaugcugcucgauaacauaaauaccccugaggggauuauccccuccauguucgaaccagagcgagaaaaagucgacgcuauugauggagaguacagauugcggggcgaggccaggaagaccuuuguggaccugaugcgcagaggugaucucccuguuuggcuggcguauaaaguggcagccgaagggaucaacuacgcugacaggcggugguguuucgauggcauaaagaacaaucagauccuugaggaaaacgucgagguggagauuuggacuaaagaaggagagcguaagaagcuaaaaccccgcuggcuggacgcccgaaucuauagcgauccauuggcuuuaaaggaauuuaaagaguucgcagccggcagaaagucucugacacucaaucugauuaccgaaauggggaggcuuccuacauucaugacucagaaaacgcgggacgcucuggauaaccucgccguauugcacaccgcagaggcgggaggucgcgccuacaaucaugcucugucagagcuaccggaaacacuggagacucuccuucuguuaaccuugcuggccacagugaccggcgggaucuuucucuuccugauguccggaagaggcauagguaagaugacucuugggaugugcugcauuaucacggcaaguauccugcucugguaugcucagauucagccccacuggaucgccgcaagcauaauuuuggaauuuuuccugaucguuuuacuaauuccagagccugaaaagcagaggaccccacaagacaaccagcugacauacgucgugaucgccauacucacuguggucgcugcgaccauggccaaugagaugggcuuucuugagaaaacaaagaaagaccugggauugggcucgaucgcaacccagcagccagaaucuaacauucuggauaucgaccuccggccugcuuccgccuggacucuguacgccguugcaacaacguucgugacccccaugcuucgacauagcauugaaaauucaaguguaaacgugucucucacugcuaucgccaaucaagcgacaguccugaugggguugggaaaggguuggccgcuguccaaaauggauauuggcgugccauuacuagcuaucggguguuauagccagguuaacccuauaacccugaccgccgcacuccuucuguugguggcccacuacgcuauuaucggacccggccugcaggcaaaggccacaagagaagcgcagaagcgcgcugccgcagguaucaugaaaaauccaacugucgacgggauuacgguaauagaucucgaccccaucccuuaugauccgaaguuugagaaacaacugggccaggugaugcuuuuaauucugugcguuacccaggugcucaugaugaggacaacuugggccuugugugaagcucugacccuagccacaggacccaucucaacccugugggagggcaacccagggcgguucuggaauacuacgauugcagucaguauggcuaacaucuuucguggaagcuaccucgccggcgcgggucuucuguucuccauaaugaagaauacaaccaacacuagaagggggaccggaaacaucggcgagacauugggugaaaaauggaagucucgccugaaugcccucggcaaaagcgaguuucaaauuuauaagaaguccgggauccaggaaguggaccggacucuggcaaaagagggaauuaagcgaggcgagaccgaucaccaugcugucucaagagggucugccaaauuaaggugguucguggaacgcaacaugguuacaccugagggaaaggugguagaccuuggcugcgguagagggggauggaguuacuauuguggcggucugaaaaaugugagagaagucaagggccucacgaaagggggacccggccacgaggaaccuaucccaaugucgaccuacggguggaaccuaguucgucugcagagcggaguggaugucuuuuucauacccccugagaaaugcgacacuuugcugugugauauuggcgaguccucuccaaaucccacaguggaagcagguaggacccuccggguacuuaaccugguggagaauugguugaacaauaacacucaguucugcaucaagguucugaauccguacaugccuucagugaucgagaaaauggaggcucuccaacgcaaguaugggggagccuuaguccgaaacccacugagcagaaauuccacacaugaaauguacugggugaguaacgccucuggcaauauugucagcucagugaacaugauauccaggaugcuuaucaaccgguuuaccaugcgccacaaaaaggcgacguaugagcccgacguugaccugggcagugggaccagaaauauuggaaucgagagcgaaauuccuaaccuagauaucauagguaagaggaucgagaaaauuaagcaggaacaugagacaucuuggcacuacgaccaggaucacccauauaaaacuugggcuuaccauggcuccuaugaaaccaagcagacagggucagcaagcucgaugguaaauggagugguccgacuccugacuaaacccugggacguguugccgaccguuacacaaauggccaugaccgauacuacgccuuucggccagcagcggguguuuaaggagaaggucgacacacguacccaggagcccaaagaagguacuaagaaacugaugaagaucaccgcugaguggcucuggaaagaacuugggaagaaaaagacaccaagaauguguacgcgcgaggaguucaccaggaaggugcggucuaacgccgcacugggagccauuuuuacugaugaaaauaaauggaagagugcuagagaggcgguagaagacucccgcuucugggaguuaguggauaaagaaaggaaccugcacuuggagggcaagugcgagacauguguuuacaauaugaugggcaaacgagaaaagaagcucggggaguuuggaaaagccaaggguagccgggcaaucugguacauguggcugggcgcuagauuccuagaauuugaggcccuuggguuccugaacgaagaccauugguuuucaagggaaaauucccucucuggagucgagggcgaaggucugcacaaauugggguauauucugcgcgaugugagcaagaaagagggaggcgcaauguacgccgacgacaccgcuggcugggauacucguauaacacucgaagaccuuaagaacgaggaaauggugaccaaucacaugaagggggagcauaaaaagcuggccgaggcgaucuucaaauuaacauaucaaaacaaggucguucgggugcagagaccuacucccaggggaaccguaauggauauuaucagucgccgagaccagcgggguuccggccaaguggggacguacggacugaauaccuuuacaaacauggaagcacaguugaucagacagauggagggcgaaggugucuucaaaaauauucagcaccucacugugaccgaggagguugccgugcaaaacuggcuggcuagggucgggcgcgaaagacuaagccggauggccauaucuggagaugacugcgugguaaagccacuugaugacagguucgcaaacgcucugacagcccucaaugauaugggcaagauccguaaagacauucagcagugggagcccucaaagggcuggaacgauuggacucagguuccuuuuugcagucaucacuuccaugaacugaucaugaaagacgggcgaguguuggucgugccaugucgcaaucaagaugaguuaauugguagagcucggaucucccagggagccggcuggagccugagggaaaccgcaugccucgggaagucuuaugcgcagauguggucgcuuauguacuuucaccgcagagaccugcggcuagccgcuaacgccauauguucagcagugccgagccacuggguccccacguccaggacaaccuggaguauccaugcuaaacacgaguggaugacuacagaggacaugcugaccguuuggaaucgaguguggauucgugaaaacccuuggauggaggauaagacuccaguagaaucuugggaggaaauccccuaucucggaaagagagaggaccaguggugcggcagcuugauuggucugaccucccgcgccacaugggccaaaaauauccaagccgcgauaaaccaggugcggucacuuauugggaaugaggaauacacggauuacaugccuaguaugaagagguucagacgcgaggaagaggaagcuggaguccugugguga

SEQ ID NO: 14855 - RNA, 9876 nt, Artificial Sequence
  derived and/or modified CDS sequence (opt3) from DENV-2__EU482679__SS-prME
agcgcaggcaugaucauuaugcugauacccaccgugauggcuuuccaccucacuacucggaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucacauaaccagaccuucuugauugacgggccggagacugccgagugccccaauacaaacagagcauggaauagucuggaaguggaggauuauggauuuggcguguucaccacaaacaucuggcucaagcugaaagaaaagcaggacgcguuuugugacucuaaguuaaugagcgcugccauuaaagauaauagggcaguacacgccgacauggguuacuggaucgaguccgcucugaacgauacuuggaagauagagaaagccucauucauugaagucaagaauugccauuggccuaaaagccacacccuuuggucuaacgggguguuggaguccgaaaugaucaucccaaagaaccucgcaggacccguuagucaacacaauuaucguccuggcuaccauacgcagauugcugguccauggcaccugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaccgcggagaggacggcuguugguaugguauggaaauacggccauugaaggagaaagaagagaaucuggugaacucauuaguuacggcggggcauggacagguggauaauuucagucucggcguacuggguauggcccuuuuucuggaagagauguugagaaccagggucggcacuaagcacgcuauccuccugguggcagugagcuucgucacacuaauuaccgggaacaugucguuuaaagaccugggacgcguugugguaauggugggcgccacuauggcugaugacaucgggaugggagucacauaccucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaucaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuacguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguauuugugggaggugaaaaagcagagggccggugucuuaugggaugugccuuccccacccccuauggggaaagccgaacuggaggacggagcuuaccgaauaaagcaaaagggcauucucggcuauucacagaucggggcaggaguuuacaaagaagguaccuuccauacuauguggcacguaacacgcggcgccgugcugaugcacaaggggaaacggaucgagccgaguugggcggaugucaagaaagaccuuauuagcuacggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguauggcaacggugucgugaccaggagcggggccuacguuuccgcuaucgcccaaacagagaagucuauugaggauaauccugaaaucgaggacgauauauuucguaaacgccggcuuacuauuauggacuuacauccgggagcaggcaagaccaaaagauaucugcccgcuaucgugagggaagccaucaagcgaggccuccggacguugauucuggcgccaacacgcgucguggccgcagagauggaagaggcucucagagggcugccuaucagguaccagacucccgccauucgggcugagcacaccggacgagaaauaguugaccuuaugugucaugcaacauucaccaugagacuguugucgccaauccgcgugccuaacuauaaucuaauuaucauggaugaggcccacuucacugaccccgccagcaucgcugcgagggguuacauuucaacccgugucgaaaugggcgaggcagccgggauauuuaugacagcuacgccaccgggaucccgggauccuuucccccagaguaacgccccaaucauugacgaggaaagagagauccccgaaaggucuuggaauagcggccaugagugggugacugauuuuaaagguaagaccguaugguucgugccuuccauuaaggcagggaacgacaucgccgcuugccugcgcaaaaauggaaagaaaguuauacaacucucacgaaagacauuugauucugaauaugucaaaaccagaacuaacgacugggauuucguggugacaaccgacaucagcgagaugggcgcgaauuuuaaggccgagcgggucauugauccaaggcgcuguaugaaacccguaaucuuaacggacggcgaagaacgugugauucuggcagggccuaugccgguuacucacaguuccgcugcccagagacggggaaggaucggucgcaacccaaagaaugaaaacgaccaguacauauacaugggcgagccccuugaaaaugaugaggacugcgcacacuggaaggaggccaaaaugcugcucgauaacauuaauacaccugaagggaucauucccagcauguucgagccagaacgagagaagguggacgcuaucgauggagaauauagauugcggggcgaggccaggaaaaccuuugucgaccugaugcgcagaggugaucucccuguguggcuggcguacaagguugcagccgaggggauaaacuaugcugacaggcggugguguuucgauggcaucaaaaacaaucagauucuugaagagaacguggaagucgagaucuggaccaaggagggagaacguaagaaacuaaagccccgcuggcuggacgcccgaauuuacucugauccauuggcuuuaaaagaguuuaaggaguucgcagccggcagaaaaucacugacucucaaucugaucacagagauggggaggcuuccuaccuucaugacacaaaagacucgggacgcucuggauaaccucgccguguugcauacggcagaagcgggaggucgcgccuauaaucacgcucuguccgagcuaccggagacccuggaaacacuccuucuguuaacuuugcuggccaccguaacaggcgggauauuucucuuccugaugaguggaagaggcauugguaagaugacccuugggaugugcugcaucaucacugcaagcauucugcucugguacgcucagauccagccccauuggauagccgcaucgauuaucuuggaguuuuuccugauuguguuacuaaucccagaaccugagaaacagaggacgccccaagacaaccagcugaccuauguugucauagccauccucacagugguggcugcgacuauggccaaugaaaugggcuuucuugagaagaccaaaaaggaccugggauugggcucuauugcaacacagcagccagaguccaacauccuggauauugaccuccggccugcuagcgccuggacccuguacgccgucgcaacuacauucguuacgcccaugcuucgacacucaaucgaaaauaguucugugaacguaucccucaccgcuauugccaaucaagcgacugugcugaugggguugggaaaagguuggccgcugagcaagauggauaucggcgucccauuacuagcuauaggguguuacucacaggugaacccuauuacacugaccgccgcacuccuucuguugguugcccacuaugcuaucaucggacccggccugcaggcaaaggccaccagagaggcgcagaaacgcgcugccgcagguauuaugaagaauccaacaguggacgggauaacugucaucgaucucgaccccauuccuuacgauccgaaauuugaaaagcaacugggccagguaaugcuuuuaauccugugcgugacgcagguucucaugaugaggaccacaugggccuugugugaggcucugacucuagccaccggacccauuaguacacugugggaaggcaacccagggcgguucuggaauaccacuaucgcagugagcauggcuaacauauuucguggauccuaucucgccggcgcgggucuucuguucucuaucaugaaaaauacgacaaacaccagaagggggacuggaaacaugggcgagaccuugggugagaaguggaaaagccgccugaaugcccucggcaaguccgaauuucaaauuuacaagaaaucagggauccaggaggucgaccggacacuggcaaaggaaggaauuaaacgaggcgagacugaucaucacgcugugucuagagggagugccaaguuaaggugguucgucgagcgcaacauggugaccccugaaggaaaaguuguggaccuuggcugcgguagagggggauggucguauuacuguggcggucugaagaauguaagagaggugaagggccucacaaaagggggacccggccaugaggaaccuaucccaaugagcacguauggguggaaccuaguccgucugcaguccggaguugauguguuuuucauacccccugaaaagugcgacaccuugcugugugauauuggcgagucuucaccaaaucccacugucgaggcagguaggacacuccgggugcuuaaccugguagaaaauugguugaacaauaacacccaguucugcaucaaagugcugaauccguacaugccuagcguuaucgagaagauggaagcucuccaacgcaaauacgggggagccuuagugcgaaacccacuguccagaaauaguacucacgagauguauugggucucuaacgccagcggcaauauugugucauccgucaacaugauaaguaggaugcuuaucaaccgguuuacaaugcgccauaagaaggcgaccuacgaacccgacguggaccugggcagcgggacgagaaauauuggaaucgagucugagauuccuaaccuagauaucauagguaaaaggaucgaaaagauuaaacaggagcacgaaaccuccuggcacuaugaccaggaucauccauacaagacaugggcuuaucacggcucauacgagacuaaacagaccgggagcgcaucgucuaugguuaauggaguagugcgacuccugacaaagcccugggacgucuugccgacugugacccaaauggccaugacagauaccacuccuuucggccagcagcggguuuuuaaggaaaaaguggacacgcguacacaggagcccaaggaggguaccaaaaagcugaugaaaaucacugcugaauggcucuggaaggagcuugggaaaaagaagaccccaagaaugggaacacgcgaagaguucacgaggaaaguccggaguaacgccgcacugggcgccauuuuuaccgaugagaauaaguggaaauccgcuagagaagcgguggaggacagccgcuucugggaauuaguagauaaggagaggaaccugcauuuggaaggcaaaugugagacuugcguguauaauaugauggggaagcgagagaagaaacucggagaauuugguaaggccaaaggcucacgggcaaucugguacauguggcugggggcuagauuccuagaguuugaagcccuuggauuccugaacgaggaccacugguuuuccagggaaaauucucucagcggcguugagggugaggggcugcacaaguugggauacauucugcgcgaugucaguaaaaaggaaggcggcgcaauguaugccgacgacacagcugggugggauacccguauaacucucgaggaccuuaagaacgaagagauggugacaaaucauauggaaggagagcacaaaaagcuggccgaggcgaucuucaaauuaaccuaccaaaacaaggugguccggguucagagaccuacacccagggguacugugauggauauuaucucccgccgagaccagcggggcagcgggcaaguaggaaccuauggccugaauacguuuaccaacauggaagcacaguugaucagacagauggagggugaagggguguucaaaaauauucagcaucucacagucacugaggagguggccguucaaaacuggcuggcuagggugggacgcgaaagacuaucucggauggccauaucaggcgaugacugugucgugaagccacuugaugacagguucgcaaacgcucugaccgcccucaaugauaugggcaagauccguaaagacauucagcagugggagcccaguaagggguggaacgauuggacacagguaccuuuuugcucccaccauuuccacgaacugaucaugaaagacggacgaguuuugguggucccaugccgcaaucaagaugaguuaauugguagagcucggaucagccagggcgccggguggucucugagggaaacugcaugucucggaaagucguacgcgcagauguggucacuuauguauuuucaccgcagagaccugcggcuagccgcuaacgccauaugcagcgcagugccgucccauugggugcccaccaguaggacgacauggucuauccacgcuaaacaugaguggaugaccacugaggacaugcugacagucuggaaucgaguuuggauucgugaaaacccuuggauggaggauaagaccccaguggaaagcugggaggaaauccccuaccucggcaagagagaggaccaguggugugguuccuugauugggcugacuucacgcgccaccugggccaaaaauauccaagccgcgauaaaccagguacggagucuuauuggaaaugaggaauauacagauuacaugccuucuaugaagagguucagacgcgaggaagaggaagcuggcgugcugugguga

SEQ ID NO: 14856 - RNA, 9876 nt, Artificial Sequence
  derived and/or modified CDS sequence (opt3) from DENV-2__EU482774__SS-prME
agcgcaggaaugaucauuaugcugauccccaccgugauggcuuuccaccucacuacuagaaacggggaaccucauaugaucgucgguauucaagaaaagggaaagucccuucuguuuaagacggaggacggcguuaauaugugcaccuugauggcaauggauuuaggggaacugugugaggacacaaucacuuacaaaugcccacuucucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaaucuucauuggcguuaucauaacauggaucgggaugaacucucgcagcacuucacuuaguguguccuugguccuggugggaauuguaacccucuaccugggcgugaugguucaggcagauagcgguugugucgugucuuggaagaauaaggagcuuaaaugcgggucaggaaucuuuauuacggacaacgugcacacauggaccgaacaguauaaguuccaacccgagaguccaagcaaacuggccuccgcuauccagaaggcccaggaagagggcauaugugguauuagaucugucacuagguuggagaaucucauguggaaacagaucacacccgaacugaaccacauuuuagcagagaaugaaguuaagcugaccaucaugacuggcgauauaaaagggaucaugcaagccggaaagcggucgcuacgcccucagccaaccgagcucaaguacagcuggaaaacauggggcaaggcuaaaaugcuguccacggaaucacauaaccagaccuuucuuauugacgggccggagacugccgagugccccaauacaaacagagcauggaauaguuuggaaguggaggauuauggauucggcguguuuaccacaaacaucuggcugaagcucaaagaaaagcaggacgcguucugugacucuaagcugaugagcgcugccauuaaagauaauagggcaguacacgccgacauggguuacuggaucgaguccgcuuuaaacgauacuuggaagauagagaaagccucauucauugaagucaagaauugccauuggccuaaaagccacacccuguggucuaacggggugcuugaguccgaaaugaucaucccaaagaacuuggcaggacccguuagucaacacaauuaucguccuggcuaccauacgcagauugcugguccauggcaccucggcaagcuggagauggacuuugauuucugugacgggacaaccgugaucgucacugaagauugcggaaaccggggccccagccuacgaaccacaacugccucugggaaacugauuaccgaguggugcuguagauccugcacacucccgccucugagguaccgcggagaggacggcuguugguaugguauggaaauacggccacuuaaggagaaagaagagaauuuggugaacucacugguuacggcggggcauggacagguggauaauuuuaguuuaggcguacucgguauggcccuguuccuugaagagaugcugagaaccagggucggcacuaagcacgcuaucuugcucguggcagugagcuuugucacacugauuaccgggaacaugucguucaaagaccuaggacgcguugugguaauggugggcgccacuauggcugaugacaucgggaugggagucacauaccuggcccuccuggcagcguuuaaggugcgacccaccuucgccgcuggccuuuugcugcggaaguuaacguccaaagagcucaugaugacuaccauugguaucguucugcuuucucaaagcacaauaccugaaaccgugcuggagcuaacugaugcccucgcacuggggaugauggucuugaagaucgugcguaauauggaaaaauaucagcuggcuguuacaauuauggccaucuuaugcgugcccaacgcagucguacuccagaaugccuggaaggugucauguaccauucuggcuguugugagugucuccccacuucuguugacaucuagccagcagaagacugacuggaucccucucgcgcugaccauaaagggacuaaaccccacggccauuuuucugacaacccuuuccagaacuaauaaaaagaggucauggccacucaacgaggcaaucauggcugugggcaugguaagcauccuggccaguucuuugcugaagaaugacauuccgaugaccggcccuuuaguggccgggggacuccugacagucugcuacguucuuacuggucgcuccgcugaucuggaauuggagcgggcaaccgacgugaaaugggaggaucaggccgaaauaagcggcucgucacccauccucucuauuacgaucagugaggacggguccaugagcauuaagaacgaagaggaggaacagacacugaccauccuaauaagaacuggacugcuugugaucucuggccucuucccaauuagcauccccauuacagcggcugccugguaucugugggaggucaaaaagcagagggccgguguguugugggauguuccuuccccacccccuauggggaaagccgaauuagaggacggagcuuaccgaaucaagcaaaagggcauacugggcuauucacagauuggggcaggaguauacaaagaagguaccuuucauacuauguggcacgugacacgcggcgccguccucaugcacaaggggaaacggaucgagccgaguugggcggaugugaagaaagaccugaucagcuacggaggcgguuggaaacuugagggggaauggaaggagggagaagagguucaggugcuggcuuuggaaccaggcaaaaaucccagagccguccagaccaagccuggccuauucaaaacgaacacugggaccauuggagcagugucucuggauuuuuccccagguacaucaggcagucccaucauagacaagaaagggaagguagucggacucuauggcaacggugugguuaccaggagcggggccuacguguccgcuauugcccaaacagagaagucuaucgaggauaauccugaaauugaggacgauaucuuccguaaacgccggcugacuauaauggaccuucauccgggagcaggcaagaccaaaagauauuuacccgcuauugucagggaagccaucaagcgaggccugcggacgcucaucuuggcgccaacacgcgugguugccgcagagauggaagaggcucugagagggcucccuauuagguaccagacucccgccaucaaagcugagcacaccggacgggaaauuguggaccugaugugucaugcaacauucaccaugcgacuucugucgccagucagagugccuaacuauaauuugauaaucauggaugaggcccacuuuacugaccccgccagcauugcugcgcgcgguuacaucucaaccaggguagaaaugggcgaggcagccgggaucuucaugacagcuacgccaccgggaucccgugauccuuuuccccagaguaacgccccaauuauagacgaggaacgggagauccccgaaagaucuuggaauagcggccaugagugggugacugauuucaaggguaagaccguuugguuugucccuuccauuaaagcagggaacgacaucgccgcuugccuaaggaagaauggcaagaaggugauucaacugucacgcaaaacauucgauucugaauaugugaagacccgaacuaacgacugggauuuugucguaacaaccgacaucagcgagaugggcgcgaauuucaaagccgagagagugauagauccacggagguguaugaagcccguuauccucacggacggcgaagaacgcgugauuuuagcagggccuaugccggucacucacaguuccgcugcccagcguagaggacggaucgguaggaacccaaagaaugaaaacgaccaguacauuuacaugggcgagccccuggaaaaugaugaggacugcgcacacuggaaagaggccaagaugcuucuggauaacaucaauacaccugaagggauaauucccagcauguuugagccagaacgcgagaaaguggacgcuaucgauggagaauaucgacucagaggcgaggcccggaagaccuucguugacuugaugaggcgcggugaucugccuguguggcucgcguacaaagucgcagccgaggggauuaacuaugcugacagaaggugguguuuugauggcaucaagaacaaucagauacuggaagagaacguggaaguagagaucuggaccaaggagggagaacggaagaaacuuaaaccccguuggcuagacgcccgcauuuacucugauccacuggcuuugaaagaguucaaagaguucgcagccggccgaaagucauuaacucugaaucucaucacagagauggggagacugccuaccuuuaugacacaaaagacuagggacgcucuugauaaccuggccgugcuccauacggcagaagcgggaggucgggccuauaaucacgcuuuguccgagcugccggagacccuagaaacacugcuccuucugacuuuauuggccaccguuacaggcgggauuuuccuguuucucaugaguggacgcggcaucgguaaaaugacccuggggaugugcugcauaauuacugcaagcauccuucugugguacgcucagauccagccccauuggauugccgcaucgaucauacucgaguucuuuuugauuguccuguuaaucccagaaccugagaagcagagaacgccccaagacaaccagcuaaccuauguggugauugccauccugacagucguugcugcgacuauggccaaugaaaugggcuuccucgagaaaaccaagaaagaccuuggacugggcucuauagcaacacagcagccagaguccaacaucuuggauauugaccugaggccugcuagcgccuggacccucuacgccguggcaacuacauuuguaacgcccaugcugcggcacucaaucgaaaauaguucugugaacgucucccuuaccgcuauugccaaucaagcgacugugcucauggggcugggaaaggguuggccguugagcaagauggauaucggcguuccacuguuagcuauuggguguuacucacaggugaacccuaucacacuaaccgccgcacugcuccuucuggucgcccacuaugcuauaauuggacccggcuugcaggcaaaagccacccgagaggcgcagaagagagcugccgcagguaucaugaaaaauccaacaguagacgggaucacugugauugaucuggaccccauaccuuacgauccgaaguucgaaaaacaacucggccagguuaugcugcuuaucuuaugcgugacgcagguccugaugaugcgcaccacaugggcccucugugaggcuuugacucuggccaccggacccauuaguacacuaugggaaggcaacccagggagguuuuggaauaccacuaucgcagugagcauggcuaacauuuuccggggauccuaucuggccggcgcgggucuccuauuuucuaucaugaagaauacgacaaacacccguagagggacuggaaacauaggcgagacccugggugagaaauggaaaagcagguugaaugcccugggcaaguccgaguuccaaaucuacaaaaagucagggauucaggaggucgaccgcacacucgcaaaagaaggaaucaagcggggcgagacugaucaucacgcugugucucgagggagugccaaacugagaugguuuguugagaggaacauggugaccccugaaggaaagguaguggacuuaggcugcggucgcgggggauggucguauuacuguggcggucuuaagaauguccgggagguuaaaggccugacaaaagggggacccggccaugaagaaccuauuccaaugagcacguauggguggaaccucgugagacuacaguccggagucgauguguucuucauacccccugaaaaaugcgacacccuguugugugauauaggcgagucuucaccaaaucccacuguagaggcaggucguacacugagggugcucaaccuuguugaaaauuggcugaacaauaacacccaguuuugcauuaagguguugaauccguacaugccuagcgucaucgagaaaauggaagcucugcaacggaaguacgggggagcccucgugcgcaacccauuaucccgaaauaguacucacgagauguauugggucucuaacgccagcggcaauaucgugucauccguuaacaugauuaguagaaugcugauaaacagguucacaaugcggcauaagaaagcgaccuacgaacccgacguagaccuuggcagcgggacgcgcaauaucggaauugagucugagaucccuaaccuggauauuaucgguaagagaauagagaagaucaagcaggagcacgaaaccuccuggcacuaugaccaggaucauccauacaaaacaugggcuuaucacggcucauacgagacuaagcagaccgggagcgcaucgucuauggugaauggagucgugaggcuacucacaaagcccugggacguucugccgacugugacccaaauggccaugacagauaccacuccuuuuggccagcagcgagucuucaaagaaaagguggacacgcggacacaggagcccaaagaggguaccaagaaauugaugaagauuacugcuaaauggcuguggaaggaacucgggaagaaaaagaccccacguauguguacaagagaggaauuuacgcgcaaaguaaggaguaacgccgcacuuggagccaucuucaccgaugagaauaaguggaaauccgcucgggaggcgguggaagacagcagauuuugggagcugguugauaaggaacgcaacuuacaucuggagggcaagugcgaaacuugugucuauaauaugaugggcaaaagggagaagaaauugggggaguucggaaaggccaaagguucacgagcaauuugguacauguggcucggcgcucgguuucuggaguucgaggcccuaggguuucuuaacgaagaccacugguucuccagagaaaauucucugagcggaguggaaggcgagggucuccacaagcugggguacaucuugagggaugugaguaagaaagagggaggcgcaauguaugccgacgacacagcuggcugggauacccgcauuacucuggaagaccucaagaacgaggaaauggucacaaaucauauggagggggaacacaagaaacuugccgaggcgauauuuaaacugaccuaccaaaacaaaguugugcguguacagcggccuacacccagaggaacugugauggauaucauuuccaggcgcgaccagcgagguagcggccaagucgggaccuauggauuaaauacguucaccaacauggaggcacagcugauccggcagauggaaggcgaggguguguucaagaauauccagcauuugacaguuacugaagagguggccguccaaaacuggcucgcuagaguggggagggagcgccugucuagaauggccauuucaggagaugacugcguaguuaaaccacuagaugaccgguuugcaaacgcucuuaccgcccugaaugauaugggcaagauaaggaaagacauccagcagugggaacccaguaagggcuggaacgauuggacacaggugccuuucugcucccaccauuuucacgagcucauuaugaaagacgggcguguccugguggugccaugucgaaaucaagaugaauugaucggacgcgcuagaauuagccagggugccggcuggucuuuacgggagacugcaugccuggggaagucguacgcgcagauguggucacucauguauuuccacaggcgcgaccuuagacuggccgcuaacgccaucuguagcgcagucccgucccauuggguucccaccagucggacgacauggucuauacacgcuaagcaugaauggaugaccacugaggacaugcuaacaguguggaauaggguauggauccgagagaacccuuggauggaagauaaaaccccaguggagagcugggaagagauucccuaccugggaaagcgugaagaccaguggugcggcucccucaucgguuugacuucaagagccaccugggccaagaauauucaagccgcgaucaaccagguccgcagucugauagggaaugaggaguauacagauuacaugccuucuaugaagcgguuuaggagagaagaggaagaggcuggagugcuuugguga

SEQ ID NO: 14857 - RNA, 9876 nt, Artificial Sequence
  derived and/or modified CDS sequence (opt3) from DENV-2__EU482775__SS-prME
agcgcaggaaugauaauuaugcugauaccaaccgugauggcuuuccaccucacuacuagaaacggggagccucauaugaucgucggcauucaggaaaaggguaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagcgauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauacgggggaucaugcaagccggaaaacgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucaacacaauuaccggccuggcuaccacacgcagauugcugguccauggcaucugggcaagcuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaagagaaggaagagaaucuggugaacucauuaguuacggcggggcacggacagguggauaauuucagucucggcguacuggguauggcccuuuuucuggaagagauguugaggacccgcgucggcacuaaacaugcuauccuccugguggcagugagcuucgucacacuaauuaccgggaacaugucguuuaaggaccugggacgaguugugguaauggugggcgccacuauggcugaugacaucgggaugggagucacauaucucgcccugcuugcagcguucaaagugcggcccaccuuugccgcuggcuugcuguuacguaagcucacguccaaggagcugaugaugacuaccauugguaucguucuucugucucaaagcacaauaccugaaaccgugcuagagcucacugaugcccuggcauuggggaugaugguccugaaaaucgugagaaauauggaaaaguaccaguuagcuguuacaauuauggccauccucugcgugcccaacgcagucauucugcagaaugccuggaaaguaucauguaccauccuugcugugguuaguguguccccacuguugcucacaucuagccagcaaaagacugacuggauaccucuggcgcuaaccauuaaaggacugaaccccacggccaucuuccuuacaacccucuccaggacuaauaagaaacgcucauggccacugaacgaggcaaucauggcugucggcauggugagcauuuuggccaguucucuguuaaagaaugacauaccgaugaccggcccucucguagccgggggacugcuuacagugugcuauguccugacuggucgguccgcugauuuggaacucgagagagcaaccgacguuaagugggaggaucaggccgaaaucagcggcucgucacccauucugucuaucacgauuagugaggacggguccaugagcaucaaaaacgaagaggaggaacagacacuaaccauacugaucaggacuggacuucucgugauuucuggccuguuuccaaucagcauucccaucacagcggcugccugguacuugugggaggugaagaaacagcgagccggugucuuaugggaugugccuuccccacccccuauggggaaggccgaacuggaggacggagcuuaucgcauaaaacaaaagggcauucucggcuacucacagaucggggcaggaguuuacaaggaagguaccuuccacacuauguggcauguaacacggggcgccgugcugaugcacaaagggaagagaaucgagccgaguugggcggaugucaggaaagaccuuauuagcuauggaggcgguuggaagcuggagggggaauggaaagagggagaagaggugcagguuuuggcucuagaaccaggcaagaauccccgugccgugcagaccaagccuggccuguuuaaaacgaacacugggaccaucggagcagucucucucgauuucuccccagguacaucaggcagucccauaauugacaagaaagggaaggugguaggacuguacggcaacggugucgugacccgcagcggggccuauguuuccgcuaucgcccaaacagagaaaucuauugaggauaauccugaaaucgaggacgauauauuucggaagagaaggcuuacuauuauggacuuacacccgggagcaggcaagaccaaacgauaccugcccgcuaucgugcgggaagccaucaagcgcggccucagaacguugauucuggcgccaacaagggucguggccgcagagauggaagaggcucuccgggggcugccuauccgauaucagacucccgccauuagagcugagcauaccggacgcgaaauaguugaccuuaugugucacgcaacauucaccaugaggcuguugucgccagugcgugucccuaacuacaaucuaaucauuauggaugaggcccauuucacugaccccgccagcaucgcugcgcgggguuauaucucaaccagaguggaaaugggcgaggcagccgggauuuuuaugacagcuacgccaccgggauccagggauccuuucccccagaguaacgccccaauaaucgacgaggaacgcgagauucccgaacgaucuuggaauagcggccacgaguggguaacugauuuuaaagguaagaccgugugguucguuccuuccaucaaagcagggaacgacauugccgcuugccugagaaagaauggaaagaaagucauccaacucucacggaagacauuugauucugaauacgugaaaaccaggacuaacgacugggauuucguggucacaaccgacauaagcgagaugggcgcgaauuuuaaggccgagcgcguaaucgauccacguagauguaugaaacccgugauuuuaacggacggcgaagaacggguuauccuggcagggccuaugccggugacucauaguuccgcugcccagaggcgcggacgaauugguagaaacccaaagaaugaaaacgaccaguacaucuauaugggcgagccccuugaaaaugaugaggacugcgcacacuggaaagaggccaagaugcugcucgauaacauaaauacaccugaagggauuauccccagcauguucgagccagaacgggagaaggucgacgcuauugauggagaauacagguugcgcggcgaggccagaaaaaccuuuguggaccugaugaggcggggugaucucccuguuuggcuggcguauaagguggcagccgaggggaucaacuacgcugaccgucgcugguguuucgauggcaucaaaaacaaucagauccuugaagagaacgucgaaguggagauuuggaccaaggagggagaaaggaaaaagcuaaagcccagauggcuggacgccagaaucuauucugauccauuggcuuuaaaagaguuuaaggaguucgcagccggccggaaaucacugacucucaaucugauuacagagauggggcgccuuccuaccuucaugacacaaaagacuagagacgcucuggauaaccucgccguauugcacacggcagaagcgggagguagggccuacaaucaugcucuguccgagcuaccggagacccuggaaacacuccuucuguuaacuuugcuggccaccgugacaggcgggaucuuucucuuccugaugaguggacggggcauagguaaaaugacccuugggaugugcugcauuaucacugcaagcauccugcucugguaugcucagauucagccccacuggaucgccgcaucgauaauuuuggaguuuuuccugaucguuuuacuaauuccagaaccugagaagcagcgaacgccccaagacaaccagcugaccuacgucgugaucgccauacucacaguggucgcugcgacuauggccaaugaaaugggcuuucuugagaagaccaaaaaggaccugggauugggcucuaucgcaacacagcagccagaguccaacauucuggauaucgaccucagaccugcuagcgccuggacccuguacgccguugcaacuacauucgugacgcccaugcuucgccauucaauugaaaauaguucuguaaacgugucccucaccgcuaucgccaaucaagcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaagccaccagggaggcgcagaagcgggcugccgcagguaucaugaagaauccaacagucgacgggauuacuguaauagaucucgaccccaucccuuaugauccgaaauuugaaaagcaacugggccaggugaugcuuuuaauucugugcguuacacaggugcucaugaugcguaccacaugggccuugugugaggcucugacucuagccaccggacccaucaguacacugugggaaggcaacccagggagauucuggaauaccacuauugcagucagcauggcuaacaucuuuaggggauccuaccucgccggcgcgggucuucuguucucuauaaugaaaaauacgacaaacacccgccgggggacuggaaacaucggcgagaccuugggugagaaguggaaaagccgacugaaugcccucggcaaguccgaauuucaaauuuauaaaaagucagggauccaggagguggacagaacacuggcaaaggaaggaauuaaaaggggcgagacugaucaccaugcugucucucgcgggagugccaaguuacggugguucguggagagaaacaugguuaccccugaaggaaaagugguagaccuuggcugcggucgugggggauggucguacuauuguggcggucugaagaaugugagggaggucaaaggccucacaaaagggggacccggccacgaggaaccuaucccaaugagcacguacggguggaaccuaguucggcugcaguccggaguggaugucuuuuucauacccccugaaaagugcgacaccuugcugugugauauuggcgagucuucaccaaaucccacuguggaggcaggucgcacacuccgaguacuuaaccugguggaaaauugguugaacaauaacacccaguucugcaucaaaguucugaauccguacaugccuagcgugaucgagaagauggaagcucuccaaagaaaauaugggggagccuuagucaggaacccacugucccggaauaguacucaugagauguacugggugucuaacgccagcggcaauauugucucauccgugaacaugauaagucgcaugcuuaucaacagauuuacaaugaggcacaagaaagcgaccuaugaacccgacguugaccugggcagcgggacgcgaaauauuggaaucgagucugagauuccuaaccuagauaucauagguaagcggaucgaaaagauuaaacaggagcaugaaaccuccuggcacuacgaccaggaucacccauauaagacaugggcuuaccauggcucauaugagacuaaacagaccgggagcgcaucgucuaugguaaauggagugguccgucuccugacaaagcccugggacguguugccgacuguuacccaaauggccaugacagauaccacuccuuucggccagcagagaguguuuaaagaaaaggucgacacgcgcacacaggagcccaaggaggguaccaaaaagcugaugaaaaucacugcugaauggcucuggaaggagcuugggaaaaagaaaaccccaaggauguguacacgggaagaguucacgagaaaggugcgcaguaacgccgcacugggagccauuuuuaccgaugagaauaaguggaaauccgcuagggaagcgguagaggacagccgauucugggaauuaguggauaaggagcggaaccugcacuuggaaggcaaaugcgagacuuguguuuacaauaugaugggcaagagagagaaaaagcucggggaauuuggaaaggccaaagguucaagggcaaucugguacauguggcugggcgcucgcuuccuagaguuugaagcccuuggguuccugaacgaggaccauugguuuucccgugaaaauucucucagcggagucgagggcgagggucugcacaaguugggguauauucugcgggaugugaguaaaaaggaaggaggcgcaauguacgccgacgacacagcuggcugggauaccagaauaacucucgaggaccuuaaaaacgaagagauggugacaaaucacauggaaggggagcauaagaagcuggccgaggcgaucuucaaauuaaccuaucaaaacaaggucguuagggugcagcgcccuacaccccgaggaacuguaauggauauuaucucccggagagaccagagggguagcggccaaguggggaccuacggacugaauacguuuaccaacauggaagcacaguugauccgccagauggagggcgaaggugucuucaaaaauauucagcaccucacagugacugaggagguugccgugcauaacuggcuggcuagagucgggcgggaaaggcuaucucguauggccauaucaggagaugacugcgugguaaagccacuugaugaccgauucgcaaacgcucugaccgcccucaaugauaugggcaaaauccgcaaggacauucaacagugggagcccaguaagggcuggaacgauuggacacagguuccuuuuugcucccaccauuuccacgaacugaucaugaaagacgggagaguguuggucgugccaugucggaaucaggaugaguuaauuggaagggcucgcaucagccaaggugccggcuggucucugagagaaacugcaugccucgggaagucguaugcgcagauguggucacuuauguacuuucaccggagggaccugcgacuagccgcuaacgccauauguagcgcagugccgucccauuggguccccaccagucguacgacauggucuauccacgcuaaacaugaguggaugaccacugaggacaugcugacaguuuggaauagaguguggauucgcgaaaacccuuggauggaggauaagaccccaguagaaagcugggaggaaauccccuaucucggaaaacgggaggaccaguggugcggcuccuugauuggucugacuucaagggccaccugggcaaagaauauccaggccgcgauaaaccaagugagaagucuuauugggaaugaggaauacacagauuacaugccuucuaugaagcgcuuccggagggaggaagaggaagcuggaguccugugguga

SEQ ID NO: 14858 - RNA, 9876 nt, Artificial Sequence
  derived and/or modified CDS sequence (opt3) from DENV-2__EU482776__SS-prME
agcgccggaaugaucauuaugcugauaccaaccgugauggcuuuccaccucacuacuagaaacggggaaccucauaugaucgucgguauucaagaaaagggaaaaucccuucuguuuaagacggaagacggaguuaauaugugcaccuugauggcaauggauuuaggggaacugugugaggacacuaucacuuacaaaugcccacuacucaggcaaaacgaaccggaggauauugacuguuggugcaauucuaccucaacaugggugaccuauggaacuuguacgaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauacgggggaucaugcaagccggaaaacgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucaacacaauuaccggccuggcuaccacacgcagauugcugguccauggcaucugggcaagcuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaagagaaggaagagaaucuggugaacucauuaguuacggcggggcacggacagguggauaauuucagucucggcguacuggguauggcccuuuuucuggaagagauguugaggacccgcgucggcacuaaacaugcuauccuccugguggcagugagcuucgucacacuaauuaccgggaacaugucguuuaaggaccugggacgaguugugguaauggugggcgccacuauggcugaugacaucgggaugggagucacauaucucgcccugcuugcagcguacaaagugcggcccaccuucgccgcuggcuugcuguuacguaagcucacguccaaggagcugaugaugacuaccauugguaucguucuucugucucaaagcacaauaccugaaaccgugcuagagcucacugaugcccuggcauuggggaugaugguccugaaaaucgugagaaauauggaaaaguaucaguuagcuguuacaauuauggccauccucugcgugcccaacgcagucauucugcagaaugccuggaaggcuucauguaccauccuugcgguagugaguguuuccccacuguugcucacaucuagccagcaaaagacugacuggauaccucuggcccuaaccauuaaaggacugaaccccacggcaaucuuucuuacaacccucuccaggacuaauaagaaacgcucauggccacugaacgaggcuaucauggccgugggcauggucagcauuuuggccaguucucuguuaaagaaugacauaccgaugaccggcccucucguggcugggggacugcuuacaguaugcuacgugcugacuggucgguccgcagauuuggaacucgagagagccaccgacgucaagugggaggaucaggcggaaaucagcggcucgucacccauucugucuaucacgauuagugaggacggguccaugagcaucaaaaacgaagaggaggaacagacacuaaccauacugaucaggacuggacuucucguuauuucuggccuguucccaaucagcauucccaucacagcugccgcaugguauuugugggaggugaagaaacagcgagccgguguguuaugggaugucccuuccccacccccuauggggaaggcugaacuggaggacggagcauaccgcauaaaacaaaagggcauucucggcuacucacagaucggggccggaguguauaaggaagguaccuuucacacuauguggcauguuacacggggcgcgguacugaugcacaaagggaagagaaucgagccgaguugggcugaugugaaaaaggaccuuauuagcuacggaggcgguuggaaacuggagggggaauggaaggagggagaagagguccagguguuggcccuagaaccaggcaagaaucccagggcaguucagaccaaaccuggccuguucaagacgaacacugggaccaucggagccgugucucucgauuuuuccccagguacaucaggcagucccauaauugacaaaaaggggaaagucgugggacuguauggcaacgguguagucacccguagcggggcuuacguguccgccaucgcacaaacagagaagucuauugaggauaauccugaaaucgaggacgauauauuccgcaagcggagacuuacuauuauggacuuacacccgggagcuggcaaaaccaagagguaucugcccgccaucguucgagaagcgaucaaacggggccuccgcacguugauucuggccccaacaagaguggucgcagcugagauggaagaggcccucagggggcugccuauccgguaccagacucccgcuauucgagcagagcauaccggaagagaaauaguggaccuuaugugucacgccacauuuaccaugcgccuguugucgccaguuagggugccuaacuauaaucuaaucauuauggaugaggcccauuucacugaccccgcuagcaucgcggcacgugguuacaucucaacccgggucgaaaugggcgaggccgcugggauuuucaugacagccacgccaccgggauccagagauccuuuuccccagaguaacgcaccaauaaucgacgaggaaagggagauucccgaacgcucuuggaauagcggccacgagugggugacugauuucaaggguaaaaccguaugguuugugccuuccaucaaggccgggaacgacauugcugcgugccugcgaaagaauggcaagaaaguuauccaacucucaagaaaaacauucgauucugaauacgucaagacccggacuaacgacugggauuuuguggugacaaccgacauaagcgagaugggcgccaauuucaaagcagagagggucaucgauccacgccguuguaugaagcccguaauuuuaacggacggcgaagagagagugauccuggcugggccuaugccgguuacucauaguuccgccgcacagcggaggggacgcauuggucgaaaccccaaaaaugaaaacgaccaguauaucuacaugggcgagccccuugaaaaugaugaggacugcgcccacuggaaggaggcuaagaugcugcucgauaacauaaauacaccugaagggauuauccccagcauguuugagccagaaagagagaaaguggacgccauugauggagaauaucgguugaggggcgaggcgcgcaagaccuucgucgaccugaugagaaggggugaucucccuguguggcuggcauacaaaguugccgcugaggggaucaacuaugccgaccggcguugguguuuugauggcauaaagaacaaucagauccuugaagagaacauggaaguggagauuuggaccaaagagggagaacgcaagaagcuaaaaccccgauggcuggacgcuagaaucuacucugauccauuggcauuaaaggaguucaaagaauuugccgcuggcaggaagucacugacucucaaucugauuacagagauggggcggcuuccuaccuucaugacacagaaaacucgcgacgcccuggauaaccucgcagucuugcacacggcggaagccggagguagagcuuauaaucaugcccuguccgagcuaccggagacccuggaaacacuccuucuguuaacuuugcuggcaaccgugacaggcgggaucuuccucuuucugaugaguggaaggggcauagguaagaugacccuugggaugugcugcauuaucacugcuagcauccugcucugguacgcccagauucagccccacuggaucgcagccucgauaauuuuggaguucuuucugaucguauuacuaauuccagaaccugagaagcagcggacgccccaagacaaccagcugaccuacgugguuaucgcuauacucacagucguggcggccacuauggcaaaugaaaugggcuuccuugagaaaaccaagaaagaccugggauugggcucuaucgcuacacagcagccagaguccaacauucuggauaucgaccuccgaccugccagcgccuggacccuguaugcaguggcuacuacauuugucacgcccaugcuuagacauucaauugaaaauaguucuguuaacgugucccucaccgccaucgcgaaucaagcuacuguacugaugggguugggaaaggguuggccgcugagcaaaauggauauuggcgugccauuacuagccaucggguguuacucacaggucaacccuauaacacugaccgcagcccuccuucuguugguggcucacuaugcaauuaucggacccggccugcaggccaaggcgacccgcgaggcucagaagagggccgcagccgguaucaugaaaaauccaacaguugacgggauuacugugauagaucucgaccccaucccuuacgauccgaaguucgaaaaacaacugggccaggucaugcuuuuaauucugugcguaacacaggugcucaugaugcggaccacaugggcuuugugugaggcccugacucuagcaaccggacccaucaguacacugugggaaggcaacccagggcguuuuuggaauaccacuauugcuguuagcauggccaacaucuucagaggauccuaucucgcgggcgccggucuucuguuuucuauaaugaagaauacgacaaacaccaggcgcgggacuggaaacaucggcgagaccuugggugagaaauggaaaagccggcugaaugcacucggcaaauccgaguuccaaauuuacaagaagucagggauccaggagguggaccgaacacuggcuaaagaaggaauuaagagaggcgagacugaucaccaugccgucucuagggggagugcaaaauuacgcugguuuguggagcggaacauggucaccccugaaggaaaggugguugaccuuggcugcgguagagggggauggucguauuacuguggcggucugaaaaaugugcgugagguaaagggccucacaaaagggggacccggccacgaagaaccuaucccaaugagcacguacggguggaaccuagugaggcugcaguccggagucgauguuuucuuuauacccccugaaaaaugcgacaccuugcugugugauauuggcgagucuucaccaaaucccacuguggaggcuggucggacacuccgcauccuuaaccuggucgaaaauugguugaacaauaacacccaguucugcaucaaggugcugaauccguauaugccuagcguaauugagaaaauggaagcccuccaacgaaaguacgggggagccuuagugagaaacccacuguccaggaauaguacucaugagauguauuggguuucuaacgcgagcggcaauauagugucauccgucaacaugaucagucggaugcuuauuaaccgcuucacaaugagacacaaaaaggcuaccuacgaacccgacguggaccugggcagcgggacgaggaauaucggaauugagucugagaucccuaaccuagauauaaucgguaagcgaauugagaaaaucaagcaggagcaugaagcauccuggcacuaugaccaggaucacccauacaaaaccugggccuaucauggcucauacgagacaaagcagacugggagcgcuucgucuauggucaauggagugguucggcuccugaccaaacccugggacguauugccgacagugacucaaauggccaugaccgauacaaccccuuuuggccagcagcgugucuucaaggaaaagguggacacuagaacgcaggagcccaaagaggguacaaagaaacugaugaagauuaccgcagaauggcucuggaaagagcuugggaagaaaaagacuccacgcauguguaccagggaagaguuuacacggaagguuagaaguaacgccgcucugggagcgaucuucacggaugagaauaaauggaaguccgcccgcgaagcaguggaggacagcagguuuugggaauuagucgauaaagagcgaaaccugcacuuggaaggcaagugcgagaccuguguguacaauaugaugggcaaacgggagaagaagcucggggaguucggaaaagcuaaggguucaagagccauuugguauauguggcugggcgcaagguuucuagaguucgaagcccuuggguuucugaacgaggaccauugguucucccgcgaaaauucucucagcggaguagagggcgagggucugcacaaauugggguacauacugcgugaugugaguaagaaagaaggaggcgcuauguaugccgacgacacugcgggcugggauacacggaucacccucgaggaccuuaagaacgaagagaugguuacuaaucacauggaaggggagcauaagaaacuggcagaggccauuuuuaaguuaacauaccaaaacaaagucgugagagugcagaggccuaccccacgcggaacagucauggauaucaucucccgacgggaccagagagguagcggccaaguugggacuuauggacugaauaccuucacgaacauggaagcucaguugauuaggcagauggagggcgaagguguguuuaagaauauacagcaccucaccguaacagaggagguggccguccauaacuggcuggcacgcguggggugcgaaagacuaucucggauggcuaucucaggagaugacugcguugugaaaccacuugaugacagguucgccaacgcucugacugcccucaaugauaugggcaagauucguaaggacauccaacagugggagcccaguaaaggcuggaacgauuggacccaggucccuuucuguucccaccauuuucacgaacugauuaugaaggacgggcgaguguugguaguuccaugccgcaaucaggaugaguuaaucggcagagcacggauaagccaaggugcgggcuggucucugagggaaacagccugucucgggaaaucguacgcucagauguggucacuuauguauuuccaccgcagagaccugcggcuagccgcaaacgcuaucugcagcgccgugccgucccauuggguccccacaaguaggaccacguggucuauucacgcaaagcaugaguggaugacaaccgaggacaugcugacuguguggaaucgaguguggauccucgaaaacccuuggauggaggauaaaacaccagucgaaagcugggaggaaauucccuacuugggaaagcgugaggaccagugguguggcucccugaucggucuuaccucaagagccacuugggcgaagaauauacaggcugccauuaaccaaguucgcagucugaucgggaaugaggaauacaccgauuauaugccuucuaugaaacgguuuaggagagaggaagaggaagcaggagugcucugguga

SEQ ID NO: 14859 - RNA, 9876 nt, Artificial Sequence
  derived and/or modified CDS sequence (opt3) from DENV-2__EU482777__SS-prME
agcgcaggcaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcacuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggccggugucuuaugggaugugccuuccccacccccuauggggaaagccgaacuggaggacggagcuuaucgaauaaagcaaaagggcauucucggcuacucacagaucggggcaggaguuuacaaagaagguaccuuccacacuauguggcauguaacacgcggcgccgugcugaugcacaaggggaaacggaucgagccgaguugggcggaugucaagaaagaccuuauuagcuauggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccaggagcggggccuauguuuccgcuaucgcccaaacagagaagucuauugaggauaauccugaaaucgaggacgauauauuucguaaacgccggcuuacuauuauggacuuacacccgggagcaggcaagaccaaaagauaccugcccgcuaucgugagggaagccaucaagcgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaagguaagaccgugugguucguuccuuccaucaaggcagggaacgacauugccgcuugccugcgcaaaaauggaaagaaagucauccaacucucacgaaagacauuugauucugaauacgugaaaaccagaacuaacgacugggauuucguggucacaaccgacauaagcgagaugggcgcgaauuuuaaggccgagcggguaaucgauccaaggcgcuguaugaaacccgugauuuuaacggacggcgaagaacguguuauccuggcagggccuaugccggugacucauaguuccgcugcccagagacggggaaggauuggucgcaacccaaagaaugaaaacgaccaguacaucuauaugggcgagccccuugaaaaugaugaggacugcgcacacuggaaggaggccaaaaugcugcucgauaacauaaauacaccugaagggauuauccccagcauguucgagccagaacgagagaaggucgacgcuauugauggagaauacagauugcggggcgaggccaggaaaaccuuuguggaccugaugcgcagaggugaucucccuguuuggcuggcguauaagguggcagccgaggggaucaacuacgcugacaggcggugguguuucgauggcaucaaaaacaaucagauccuugaagagaacgucgaaguggagauuuggaccaaggagggagaacguaagaaacuaaagccccgcuggcuggacgcccgaaucuauucugauccauuggcuuuaaaagaguuuaaggaguucgcagccggcagaaaaucacugacucucaaucugauuacagagauggggaggcuuccuaccuucaugacacaaaagacucgggacgcucuggauaaccucgccguauugcacacggcagaagcgggaggucgcgccuacaaucaugcucuguccgagcuaccggagacccuggaaacacuccuucuguuaacuuugcuggccaccgugacaggcgggaucuuucucuuccugaugaguggaagaggcauagguaagaugacccuugggaugugcugcauuaucacugcaagcauccugcucugguaugcucagauucagccccacuggaucgccgcaucgauaauuuuggaguuuuuccugaucguuuuacuaauuccagaaccugagaaacagaggacgccccaagacaaccagcugaccuacgucgugaucgccauacucacaguggucgcugcgacuauggccaaugaaaugggcuuucuugagaagaccaaaaaggaccugggauugggcucuaucgcaacacagcagccagaguccaacauucuggauaucgaccuccggccugcuagcgccuggacccuguacgccguugcaacuacauucgugacgcccaugcuucgacauucaauugaaaauaguucuguaaacgugucccucaccgcuaucgccaaucaagcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaggccaccagagaggcgcagaaacgcgcugccgcagguaucaugaagaauccaacagucgacgggauuacuguaauagaucucgaccccaucccuuaugauccgaaauuugaaaagcaacugggccaggugaugcuuuuaauucugugcguuacacaggugcucaugaugaggaccacaugggccuugugugaggcucugacucuagccaccggacccaucaguacacugugggaaggcaacccagggcgguucuggaauaccacuauugcagucagcauggcuaacaucuuucguggauccuaccucgccggcgcgggucuucuguucucuauaaugaaaaauacgacaaacaccagaagggggacuggaaacaugggcgagaccuugggugagaaguggaaaagccgccugaaugcccucggcaaguccgaauuucaaaucuauaagaaaucagggauucaggagguggaccggacacuggcaaaggaaggaaucaaacgaggcgagacugaucaccaugcugucucuagagggagugccaaguuaaggugguucguggagcgcaacaugguuaccccugaaggaaaagugguagaccuuggcugcgguagagggggauggucguacuauuguggcggucugaagaaugugagagaggucaagggccucacaaaagggggacccggccacgaggaaccuauuccaaugagcacguacggguggaaccuaguucgucugcaguccggaguggaugucuuuuucauacccccugaaaagugcgacaccuugcugugugauauaggcgagucuucaccaaaucccacuguggaggcagguaggacacuccggguacuuaaccugguggaaaauugguugaacaauaacacccaguucugcauuaaaguucugaauccguacaugccuagcgugaucgagaagauggaagcucuccaacgcaaauaugggggagccuuaguccgaaacccacuguccagaaauaguacucaugagauguacugggugucuaacgccagcggcaauaucgucucauccgugaacaugauuaguaggaugcuuauaaaccgguuuacaaugcgccacaagaaggcgaccuaugaacccgacguugaccugggcagcgggacgagaaauaucggaauugagucugagaucccuaaccuagauauuaucgguaaaaggauagaaaagaucaaacaggagcaugaaaccuccuggcacuacgaccaggaucacccauauaagacaugggcuuaccauggcucauaugagacuaaacagaccgggagcgcaucgucuaugguaaauggagugguccgacuccugacaaagcccugggacguguugccgacuguuacccaaauggccaugacagauaccacuccuuucggccagcagcggguguuuaaggaaaaagucgacacgcguacacaggagcccaaggaggguaccaaaaagcugaugaaaauuacugcugaauggcucuggaaggagcuugggaaaaagaagaccccaagaauguguacacgcgaagaguucacgaggaaagugcggaguaacgccgcacugggagccaucuuuaccgaugagaauaaguggaaauccgcuagagaagcgguagaggacagccgcuucugggaauuaguggauaaggagaggaaccugcacuuggaaggcaaaugcgagacuuguguuuacaauaugaugggcaagcgagagaagaaacucggggaauuuggaaaggccaaagguucacgggcaauuugguacauguggcugggcgcuagauuccuagaguuugaagcccuuggguuccugaacgaggaccauugguuuuccagggaaaauucucucagcggagucgagggcgagggucugcacaaguugggguauauccugcgcgaugugaguaaaaaggaaggaggcgcaauguacgccgacgacacagcuggcugggauacccguauuacucucgaggaccuuaagaacgaagagauggugacaaaucacauggaaggggagcauaaaaagcuggccgaggcgauauucaaauuaaccuaucaaaacaaggucguucgggugcagagaccuacacccaggggaacuguaauggauaucauuucccgccgagaccagcgggguagcggccaaguggggaccuacggacugaauacguuuaccaacauggaagcacaguugaucagacagauggagggcgaaggugucuucaaaaauauccagcaccucacagugacugaggagguugccgugcaaaacuggcuggcuagggucgggcgcgaaagacuaucucggauggccauuucaggagaugacugcgugguaaagccacuugaugacagguucgcaaacgcucugaccgcccucaaugauaugggcaagauacguaaagacauccagcagugggagcccaguaagggcuggaacgauuggacacagguuccuuuuugcucccaucacuuccaugaacugauuaugaaagacgggcgaguguuggucgugccaugucgcaaucaagaugaguuaaucggacgggcucggauuagccagggugccggcuggucucugagggaaacugcaugccucgggaagucguaugcgcagauguggucacuuauguacuuucaccgcagagaccugcggcuagccgcuaacgccaucuguagcgcagugccgucccacuggguccccaccaguaggacgacauggucuauacaugcuaaacacgaguggaugaccacugaggacaugcugacaguuuggaaucgaguguggauccgugaaaacccuuggauggaggauaagaccccaguagaaagcugggaggaaauucccuaucucggaaagagagaggaccaguggugcggcuccuugaucggucugacuucacgcgccaccugggccaaaaauauucaagccgcgaucaaccaggugcggagucuuauagggaaugaggaauacacagauuacaugccuucuaugaagagguucagacgcgaggaagaggaagcuggaguccugugguga

SEQ ID NO: 14860 - RNA, 9876 nt, Artificial Sequence
  derived and/or modified CDS sequence (opt3) from DENV-2__EU482778__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagagcaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaagcuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaauucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaaauugccacuggccaaagucacauacgcuuuggagcaacggaguguuggaaucugagaugaucauucccaaauccuucgccggcccuguaagucagcacaacuaccgaccagguuauuacacacaaaccgcgggccccuggcaucucgggaagcuggaaauggauuuugacuucugugagggaacuaccgucgugguuacagaagauugcggcaauagagggccgagccuaaggacuaccacagccucuggaaaacugaucacggaguggugcugucgcuccugcacccucccuccacugcgguacagaggcgaggacgguuguugguaugggauggaaauuaggccccuuaaggagaaggaagagaacuuggugaauucacuggucacugcuggacacggccagauagauaacuuuaguuuaggugugcucggcauggcacuguuccuugaagagaugcugcgcacacgaguugggaccaaacaugccaucuugcucguggcuguaagcuuugucacucugauuacaggaaauaugucguuccgggaccuaggccgugugauggugauggucggggccgcaaugaccgaugacaucggaauuggcguuacguaccuggcgcuccuggccgcuuuuaaggugagaccuacuuucgccgcaggucuuuugcugaggaaauuaaccuccaaggagcucaugauggcuacaaucgggauagcccugcuuucucagagcaccauccccgaaacuauucuggagcuaacagaugcacucgcccugggaaugaugguauugaaaaucgugcgcaacauggaaaaguaucaacuggcugucaccauuauggcgaucucaugcgugccaaaugccguuauauuacagaacgcauggaaggugaguuguacaauucucgcuacugucuccgugucuccucugcuucugaccagcucccagcagaaagccgacuggauccccuuggcccucacgaucaagggccugaauccaacagcuauuuuucuaaccacucugucacggaccagcaaaaagagaaguuggccgcuuaacgaggcaauaauggccguuggcauggugucuauccucgcguccagccuguugaaaaaugacauuccuaugacagggccccuggucgcuggagguuuacucacuguaugcuacgugcugaccggcaggucggccgaucuugaacuggagcgagcaacggacguuaagugggaggaucaagccgaaaucucagggucuaguccaauuuuguccaucacaauagcugaggacggaagcaugucuaucaaaaacgaagaggaggaacagacccucacuauucugauccgcacaggccuacuggugauuagcggucuuuuccccgucuccaucccuauaaccgcagccgcgugguaucucugggaggugaagaagcagcgggcugggguacugugggaugugccaucacccccuccggucggaaaagccgaauuggaggacggcgcauacagaauuaagcagaaaggcaucuuaggguauagucaaaucggagccgguguuuacaaggaaggcacuuuucacacaauguggcacgugaccaggggggcugugcugaugcaucguggaaaacgcauugagccaagcugggccgaugucaagaaggaccucaucucuuacggcgguggguggaaacuggagggagaauggaaggagggcgaagaggugcagguucuugcacuggaacccggcaaaaauccucgggcuguacagacgaagccaggguuguucaaaacuaacaccggaacaauaggugccgugucccuagauuuuucacccggcaccagugggagcccuauugucgacaagaagggaaaagugguuggccuguaugguaaugggguggucacaagauccggagcguacgugucugccaucgcacagacugagaagucgauugaggauaacccggaaaucgaggacgauauauucaggaaaaagcgacucaccauuauggaccugcaccccggcgcuggcaaaacgaagcgguaucuuccagccaucguacgcgaagcuaucaagagaggguuaaggacacugauucucgcaccuacucgggucguggccgccgagauggaagaggcuuugcgaggacugcccaucagauaccaaaccccagcgauucgcgcagagcauacagguagggaaauaguugaccucaugugucacgccaccuucacuaugcgucugcuuagcccugugcggguccccaacuauaaucugaucauuauggaugaggcucauuuuaccgacccagccucaaucgcagccagaggcuacaucuccacaaggguggaaaugggggaggcugcgggaauuuucaugacggccacuccgccuggcagucgcgaucccuuuccacagucuaacgcacccauaauggacgaggaacgagagaucccugaaagaagcuggaauuccggucacgaguggguuaccgauuucaaagggaagacagugugguuugucccaucaauuaaagcuggaaacgacaucgccgcaugcuugcggaagaauggcaaaaaggugauucagcuaucuaggaagaccuucgauagcgaauauguaaaaacucgcacaaacgacugggauuuugugguuaccacggacaucagugagaugggcgccaauuucaaggcugagcgugucauagaucccagacgguguaugaaaccugugauccugacugacggggaagagagggugauucucgccggaccgaugccagucacacacuccagcgcggcacaacgccgagguagaaucggccggaaccccaagaaugaaaacgaccaguacauuuacaugggggagccuuuagaaaaugaugaggacugcgcccauuggaaagaggcuaagaugcugcuugauaacaucaauacccccgaaggaauaauuccaucuauguuugagccugaaagggagaaaguagacgccaucgauggcgaauaucgccugagaggugaggcuaggaagaccuucguggaccucaugcggcguggggauuugcccguuuggcuggcauaccgcguggccgcugagggcauuaacuaugccgaccgaagaugguguuuugauggagucaagaauaaccagauccucgaagagaacguggaaguugagauauggacuaaagagggcgaaaggaagaaacugaagccacgguggcuugacgcacgcaucuacucagauccucuagcgcugaaagaguucaaggaauucgccgcugggagaaaguccuugacauuaaaucugauuaccgagaugggaaggcucccgacauuuaugacucagaaagcccgggacgcacuggauaaccuugcugugcugcacacggccgaagcagguggccgagccuauaaucaugcucucagugaguugcccgagacccuggaaacacuacugcuccuuacucuguuagcgaccgucacagggggaaucuucuuguuucugaugagcggcaaggguguggggaaaaugacccucggcaugugcugcauuaucacugccucgauacugcuuuggcacgcacaaauucagccacacuggaucgcugccucuaucauucuggaguucuuucucaucguauugcugauaccugaacccgagaagcagagaacgccacaggacaaccaauuaaccuacgugguuauugccauccuaacagucguggcagcuacuauggccaaugaaaugggauuccuggagaaaaccaagaaggaccucggccuuggguccauugcgacacaggagccugaaagcaacauccuggauauagacuugcgccccgcuucagccuggacccuguaugcaguggccacuacauuugucacgccgaugcucaggcauaguaucgagaauucuuccguuaacgugagccugaccgcuauugcaaaucaggccacuguacuuaugggacucgguaaaggcuggccacugucaaagauggauaucggggugccuuugcuggcgauuggauguuacagucaggucaaccccaucacauuaaccgcugcccuacugcuccuuguggcacacuacgccauuaucggcccaggucugcaagcuaaagccacccgggaagcacagaagcgugcugccgcggggauaaugaaaaaucccacaguugacggcauuacugugaucgauuuggacccuaucccguaugaucccaaguucgagaagcagcugggacaggucaugcuccugauucuuugcguaacgcaaguguuaaugaugagaaccacaugggcccugugugaagcacucacuuuggcuaccggcccaauaagcacacugugggaggggaacccuggaagguuuuggaauaccacuaucgccguuuccauggcaaacauuuuccgcggcucuuaccuagcuggugccgggcugcucuuuagcaucaugaaaaauacgacaaacacccggcgaggaacuggcaauauuggugagacccuuggcgaaaaguggaaauccagacugaacgccuuggggaagucagaguuccagaucuauaaaaagucuggaauacaggaaguggacaggacacuggcgaaagagggcaucaagcgcggggagacugaucaucacgcugucagucggggaucggcaaagcucagaugguuuguggaacguaacauggucacccccgagggcaaagugguugaccuggguugcgggaggggaggcuggagcuacuauugugguggcuuaaagaaugugcgggaaguaaaagggcuuacaaagggaggcccugggcaugaggaaccagugcccauguccacguacggauggaaccugguccgccuccaaucuggcguugauguguucuucaccccuccagagaaaugcgacacucuacugugugauauuggugagucaagccccaauccgacaaucgaagccgggcgaaccuugagaguccugucccucguggagaacuggcuuaauaacgacacucaguuuugcauuaagguacugaauccuuauaugccaagugugaucgaaaagauggagacauugcagaggaaauacggaggcgcucugguucggaacccccucucucgcaauagcacccacgaaauguacugggugucaaacgccacgggcaauauagucuccagugugaacaugauuagcagaauguuaaucaauagguucaccaugaagcacaaaaaggcaacauaugagccugacgucgaucuggggucuggaacucgaaacaucgguauugaguccgaaauaccaaaucuugacaucauuggcaaacggaucgagaagauuaagcaggaacaugagaccucauggcacuacgaucaagaccaucccuauaaaacaugggccuaccacgggagcuaugaaacuaagcagaccggaucggcuucuaguauggugaacggcguuguacgucugcuaacaaaaccgugggauguggucccuauggugacccagauggcgaugacugacacgacacccuuuggucagcaaagaguuuucaaggagaaaguggauacccgcacucaggagccaaaggaagggaccaagaaacucaugaagaucacagccgaguggcuguggaaagaauugggaaagaaaaagacgccuaggauguguacccgggaggaguuuacuagaaaaguccgcuccaacgcagcucugggcgccauauucacagacgaaaauaaguggaagagcgcaagggaggccguggaagauucacgauuuugggagcucguagacaaagaacggaaccuucaccuggagggcaagugcgagaccuguguguacaauaugauggggaaaagagaaaagaaauuaggagaguucgguaaggcuaagggcuccagggccaucugguauauguggcugggggcgcgcuuuuuggaauucgaggcacucggauuucugaacgaagaucauugguucucucgugagaauagccuaaguggcguugagggugaagggcuucacaaacugggauacauucuccgggacgucuccaagaaagagggcggcgccauguacgcugacgauacugccgggugggacacaagaaucacccuggaagauuugaagaacgaggaaauggugacaaaucauauggagggagagcacaaaaagcuggcagaagcuauuuuuaagcucacuuaucagaacaaaguggucaggguucagcgccccaccccacgagguacggugauggacaucauuagccggagagaucaaaggggcucugggcagguaggaaccuacggccuuaauacauucacuaacauggaggcccagcugauacgccaaauggaaggugaggggaucuucaagucaauucagcauuuaaccgugacagaggaaaucgcuguccagaauuggcuggccagagugggacgggagagguugagucguauggcaaucuccggcgacgauugcguugugaaaccccucgacgaucgauuugcgagcgcccugacugcucuaaacgacaugggcaagguccgcaaagauauucagcaaugggaaccuucuagaggguggaaugacuggacccaggugccauucugcucgcaccacuuucaugagcuuauaaugaaggauggacggguacugguugugccguguaggaaccaggacgaacucaucggucgcgccagaauuucacagggcgcaggguggagccugaaggagacggcuugcuugggaaaauccuaugcccaaauguggaguuuaauguacuuccaccggagggaccugcgacucgcagccaaugcgaucuguucugcuguccccagccauugggugccuacaucccguaccacuuggucaauucacgccaagcacgaguggaugacaaccgaagauaugcuuacuguguggaacagagucuggauccaggagaacccauggauggaagacaaaacccccguugagaguugggaagaggugccuuaucugggcaagcgcgaggaucaguggugcgguucucuaauagggcugacaagccgggcaacgugggccaaaaauauccagaccgcuauuaaccaaguaaggucccucaucggaaaugaagaguacacugacuauaugccaucaaugaagagauuucgccgggaagaggaagaggccggcguguugugguga

SEQ ID NO: 14861 - RNA, 9876 nt, Artificial Sequence
  derived and/or modified CDS sequence (opt3) from DENV-2__EU482779__SS-prME
accgccggagugauaauuaugcugauacccacagcuauggcauuccaccucacuacgaggaauggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugcguugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuuggugaacagucuggucacugcuggacacggccagauagauaauuuuagcuuaggugugcucggcauggcacuguuccuugaagagaugcugcgcacacgaguugggaccaaacaugccaucuugcucgugacuguaucguuugucacacugauuaccggaaacauguccuuccgggaccuaggccgugugauggugauggucggggcugccaugacggaugacaucggaaugggcguuacuuaccuggcacuccuggcggccuuuaaggugagaccuaccuucgcugccggucuuuugcugaggaaauuaacaucuaaggagcucaugauggcaaccauugggaucgcucugcuuagccagucaacuauacccgaaacaauccuggagcuaaccgaugcccucgcacugggaaugaugguauugaaaauugugcgcaauauggaaaaguaucaacuggccgucacaaucauggcuauuaguugcgugccaaacgcgguuaucuuacagaaugccuggaagguguccuguacuauacucgcagcugucucugugagcccucugcuucugaccuccucacagcagaaagccgacuggauucccuuggcccucacgaucaagggccugaacccaacagcuaucuuucuaaccacucugagccggaccaguaaaaagagaucuuggccgcuuaaugaggcaauuauggccguuggcaugguguccauacucgcgagcucgcuguugaaaaacgacaucccuaugacagggccccuggucgcuggagguuuacucacuguaugcuacgugcugaccggcaggucagccgaucuugaacuggagcgagcaacggacguuaagugggaggaucaagccgaaauuucugggaguuccccaaucuugagcauuacaaucgcugaggacggaucuaugagcaucaagaaugaagaggaggaacagacccucacuauccugauucgcacaggccuacuggugaucuccggucuuuuccccgucucaauuccuaucaccgcagccgcgugguaucucugggaggugaagaagcagcgggcugggguacugugggaugugccaagucccccuccggucggaaaagccgaauuggaggacggcgcauacagaauaaagcagaaaggcauuuuaggguauagccaaaucggagccgguguuuacaaggaaggcacuuuucacacaauguggcacgugaccagaggggcugugcugaugcaucguggaaaacgcaucgagccaucuugggccgaugucaagaaggaccucauuuccuacggcgguggguggaaacuggagggagaauggaaggagggcgaagaggugcagguucuugcacuggaacccggcaaaaacccucgggcuguacagacgaagccaggguuguucaaaacuaauaccggaacaaucggugccgugucacuagauuuuagucccggcaccagcggguccccuauagucgacagaaagggaaaggugguuggccuguaugguaacgggguggucacaaggucuggagcguacgugucggccauugcacagacugagaaaagcaucgaggauaauccggaaauugaggacgauaucuuccgaaagaaacggcucaccauaauggaccugcaccccggcgcuggcaagacgaaacgcuaucuuccagccauuguaagagaagcuaucaagaggggguuacggacacugauccucgcaccuacucgagucguggccgccgagauggaagaggcuuugagaggacugcccauucgcuaccaaaccccagcgaucagggcagagcauacaggucgugaaauuguugaccucaugugucacgccaccuucacuaugcggcugcuuucaccugugagaguccccaacuauaaccugauaaucauggaugaggcucauuuuaccgacccagccuccauugcagccaggggcuacaucaguacacgcguggaaaugggggaggcugcgggaaucuucaugacggccacuccgccuggcucucgagaucccuuuccacagagcaaugcacccauuauggacgaggaaagagagauaccugaacgguccuggaacucaggucacgaguggguuaccgauuucaaggggaaaacagugugguuugucccaucuaucaaggcuggaaaugacauugccgcaugcuugaggaaaaacggcaagaaagugauccagcuaagccgcaagaccuucgauagugaauauguaaagacucguacaaaugacugggauuuugugguuaccacggacauuuccgagaugggcgccaacuucaaagcugagagagucaucgauccccggagguguaugaagccugugauacugacugacggggaagaacgcgugauccucgccggaccgaugccagucacacacagcucugcggcacaacgaagaggucggauuggcaggaaucccaaaaacgaaaaugaccaguacaucuacaugggggagccuuuagaaaacgaugaggacugcgcccauuggaaggaggcuaaaaugcugcuugauaauauuaacacccccgaaggaaucauaccaucaauguuugagccugaacgcgagaagguagacgccauugauggcgaauauagacugaggggugaggcucggaaaaccuucguggaccucaugcgucgcggggauuugcccguuuggcuggcauaccgaguggccgcugagggcaucaauuaugccgacagaaggugguguuuugauggagucaagaacaaucagauucucgaagagaacguggaaguugagaucuggacuaaggagggcgaacggaaaaagcugaaaccacgcuggcuugacgcaagaauauacuccgauccucuagcgcugaaggaguucaaagaguucgccgcugggaggaagaguuugacauuaaaccugaucaccgagaugggacggcucccgacauuuaugacucagaaggcccgagacgcacuggauaaucuugcugugcugcacacggccgaagcaggagguagagccuauaaccaugcucucagcgaguugcccgagacccuggaaacacuacugcuccuuacucuguuagcgaccgucacagggggaauuuucuuguuucugaugucgggcaaagguguggggaagaugacccucggcaugugcugcaucauuacugccucuauccugcuuugguacgcacaaauacagccacacuggauugcugccuccaucauccuggaguucuuucucauuguauugcugaucccugaacccgagaaacagcgcacgccacaggacaaucaauuaaccuaugugguuauagccauucuaacagucguggcagcuacuauggccaacgaaaugggauuccuggagaagaccaaaaaggaccucggccuugggagcaucgcgacacaggagccugaaucaaauauucuggauaucgacuugaggcccgcuagugccuggacccuguacgcaguggccacuacauuugucacgccgaugcuccggcacucuauagagaacuccagcguuaaugugucacugaccgcuaucgcaaaccaggccacuguacuuaugggacucgguaagggcuggccacugaguaaaauggauauuggggugccuuugcuggcgaucggauguuacagccaggucaaucccauuacauuaaccgcugcccuacugcuccuuguggcacauuaugccaucauuggcccaggucugcaagcuaaggccacccgugaagcacagaaaagagcugccgcggggaucaugaagaaccccacaguugacggcgugacugucauagauuuggacccuauuccguacgaucccaaauucgagaagcagcugggacagguaaugcuccugauccuuugcgugacgcaaguuuuaaugaugaggaccacaugggcccugugugaagcacucacuuuggcuaccggcccaaucuccacacugugggaggggaauccuggacgcuuuuggaacaccacuauugccgugucuauggcaaauauauuccggggcagcuaucuagcuggugccgggcugcucuuuuccaucaugaagaacacgacaaauacccgaagaggaacuggcaacauuggugagacccuuggcgaaaaauggaagucaaggcugaaugccuuggggaaaucugaguuccagaucuacaagaaaaguggcauucaggaagucgaccgcacacuggcgaaggagggcaucaaaagaggggaaacugaucaccaugcugugucgagaggaagcgcaaagcuccguugguuugucgaaaggaacauggugacccccgagggcaagguuguggaccuggguugcgggcggggaggcugguccuauuacugugguggcuuaaaagauguacgcgaagugaaggggcuuacaaaaggaggcccugggcacgaggaaccaauacccaugucuacguauggauggaaccugguccgacuccaaucaggcguugacguguucuucaccccuccagagaagugcgauacucuacugugugacaucggugagagcucccccaauccgacaauugaagccgggagaaccuugaggguccugagucucguggagaacuggcuuaauaacgacacucaguuuugcaucaaaguacugaauccuuacaugccaucugugauugaaaagauggagacauugcagcggaaguacggaggcgcucugguucgcaacccccucagcagaaauucaacccaugaaauguauuggguguccaacgccacgggcaauaucgucaguagcgugaacaugauaucuaggauguuaauuaaucgauucaccaugaaacacaagaaagcaacauacgagccugaugucgaccugggguccggaacucggaacaucgguaucgagucagaaauuccaaaucuugauauaaucggcaagcguauugagaaaaucaagcaggaacacgagaccagcuggcauuaugaccaagaucaccccuacaagacaugggccuaucaugggucguacgaaacuaaacagaccggaucugcuaguuccauggugaacggcguuguaagacugcuaacaaagccgugggacguggucccuauggugacccagauggcgaugacugauacgacacccuuuggucagcaacgcguuuucaaagagaagguggacaccaggacucaggagccaaaagaagggaccaagaagcucaugaaaauuacagccgaguggcuguggaaggaauugggcaaaaagaaaacgccucggauguguaccagagaggaguuuacucgcaaggucaggagcaaugcagcucugggcgccaucuucacagaugaaaacaaauggaagucagcacgagaggccguggaagacucccgguuuugggagcucguagauaaggaaagaaaccuucaccuggagggcaaaugcgagaccuguguguauaauaugauggggaagagggagaaaaaguuaggagaguucgguaaagcuaagggcucucgcgccauaugguacauguggcugggggcgagauuuuuggaguucgaggcacucggauuucugaacgaagaccacugguucagccgggagaauagucuauccggcguugagggugaagggcuucauaagcugggauacauccucagagacgucagcaaaaaggagggcggcgccauguaugcugaugacacugccgggugggauacaaggauuacccuggaagacuugaaaaacgaggaaauggugacaaaucacauggagggagagcauaagaaacuggcagaagcuaucuuuaagcucacuuaccagaacaaggugguccgcguucagcgacccaccccacgggguacggugauggauauuaucucuagaagggaccaacgcggcucagggcagguaggaaccuauggccuuaauacauucacuaacauggaggcccagcugauuagacaaauggaaggugaggggguguucaaaaguauacagcgguuaaccgucacagaggaaaucgcugugcagaauuggcuggccaggguuggacgugagcgauugucccgcauggcaauuagcggcgaugacugcguggucaagccccucgaugacagauuugcgucugcccugacugcucuaaacgauaugggcaaagugcggaaggacauccagcaaugggaaccuucgaggggguggaaugauuggacccagguaccauucugcucacaccauuuucacgagcuuaucaugaaagacggacgcguucugguggucccguguagaaaccaggacgaacucauuggucgggccaggauaagccagggcgcaggguggucccugaaggagacggcuugcuugggaaagaguuacgcccaaauguggucuuuaauguauuuccaccgacgugaucugagacucgcagccaaugcgaucuguagcgcugugcccucccauugggugccuacaucacgcaccacuuggaguauucacgccaaacaugaguggaugacaaccgaagacaugcuuacugucuggaaccggguuuggauccaggagaauccauggauggaagauaagacccccguggagucuugggaagagguaccuuaccugggcaaaagggaggaccaguggugcgguagccuaauugggcugacauccagagcaacgugggccaagaacauccagaccgcuauaaaccaagugcgcucacucaucggaaaugaagaguauacugauuacaugccaagcaugaaacgguuuaggcgagaagaggaagaggccggcgucuugugguga

SEQ ID NO: 14862 - RNA, 9876 nt, Artificial Sequence
  derived and/or modified CDS sequence (opt3) from DENV-2__EU482780__SS-prME
accgccggagugauaauuaugcugauacccacagcuauggcauuccaccucacuacgaggaauggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugcguugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuuggugaacagucuggucacugcuggacacggccagauagauaauuuuagcuuaggugugcucggcauggcacuguuccuugaagagaugcugcgcacacgaguugggaccaaacaugccaucuugcucgugacuguaucguuugucacacugauuaccggaaacauguccuuccgggaccuaggccgugugauggugauggucggggcugccaugacggaugacaucggaaugggcguuacuuaccuggcacuccuggcggccuuuaaggugagaccuaccuucgcugccggucuuuugcugaggaaauuaacaucuaaggagcucaugauggcaaccauugggaucgcucugcuuagccagucaacuauacccgaaacaauccuggagcuaaccgaugcccucgcacugggaaugaugguauugaaaauugugcgcaauauggaaaaguaucaacuggccgucacaaucauggcuauuaguugcgugccaaacgcgguuaucuuacagaaugccuggaagguguccuguacuauacucgcagcugucucugugagcccucugcuucugaccuccucacagcagaaagccgacuggauucccuuggcccucacgaucaagggccugaacccaacagcuaucuuucuaaccacucugagccggaccaguaaaaagagaucuuggccgcuuaaugaggcaauuauggccguuggcaugguguccauacucgcgagcucgcuguugaaaaacgacaucccuaugacagggccccuggucgcuggagguuuacucacuguaugcuacgugcugaccggcaggucagccgaucuugaacuggagcgagcaacggacguuaagugggaggaucaagccgaaauuucugggaguuccccaaucuugagcauuacaaucgcugaggacggaucuaugagcaucaagaaugaagaggaggaacagacccucacuauccugauucgcacaggccuacuggugaucuccggucuuuuccccgucucaauuccuaucaccgcagccgcgugguaucucugggaggugaagaagcagcgggcugggguacugugggaugugccaagucccccuccggucggaaaagccgaauuggaggacggcgcauacagaauaaagcagaaaggcauuuuaggguauagccaaaucggagccgguguuuacaaggaaggcacuuuucacacaauguggcacgugaccagaggggcugugcugaugcaucguggaaaacgcaucgagccaucuugggccgaugucaagaaggaccucauuuccuacggcgguggguggaaacuggagggagaauggaaggagggcgaagaggugcagguucuugcacuggaacccggcaaaaacccucgggcuguacagacgaagccaggguuguucaaaacuaauaccggaacaaucggugccgugucacuagauuuuagucccggcaccagcggguccccuauagucgacagaaagggaaaggugguuggccuguaugguaacgggguggucacaaggucuggagcguacgugucggccauugcacagacugagaaaagcaucgaggauaauccggaaauugaggacgauaucuuccgaaagaaacggcucaccauaauggaccugcaccccggcgcuggcaagacgaaacgcuaucuuccagccauuguaagagaagcuaucaagaggggguuacggacacugauccucgcaccuacucgagucguggccgccgagauggaagaggcuuugagaggacugcccauucgcuaccaaaccccagcgaucagggcagagcauacaggucgugaaauuguugaccucaugugucacgccaccuucacuaugcggcugcuuucaccugugagaguccccaacuauaaccugauaaucauggaugaggcucauuuuaccgacccagccuccauugcagccaggggcuacaucaguacacgcguggaaaugggggaggcugcgggaaucuucaugacggccacuccgccuggcucucgagaucccuuuccacagagcaaugcacccauuauggacgaggaaagagagauaccugaacgguccuggaacucaggucacgaguggguuaccgauuucaaggggaaaacagugugguuugucccaucuaucaaggcuggaaaugacauugccgcaugcuugaggaaaaacggcaagaaagugauccagcuaagccgcaagaccuucgauagugaauauguaaagacucguacaaaugacugggauuuugugguuaccacggacauuuccgagaugggcgccaacuucaaagcugagagagucaucgauccccggagguguaugaagccugugauacugacugacggggaagaacgcgugauccucgccggaccgaugccagucacacacagcucugcggcacaacgaagaggucggauuggcaggaaucccaaaaacgaaaaugaccaguacaucuacaugggggagccuuuagaaaacgaugaggacugcgcccauuggaaggaggcuaaaaugcugcuugauaauauuaacacccccgaaggaaucauaccaucaauguuugagccugaacgcgagaagguagacgccauugauggcgaauauagacugaggggugaggcucggaaaaccuucguggaccucaugcgucgcggggauuugcccguuuggcuggcauaccgaguggccgcugagggcaucaauuaugccgacagaaggugguguuuugauggagucaagaacaaucagauucucgaagagaacguggaaguugagaucuggacuaaggagggcgaacggaaaaagcugaaaccacgcuggcuugacgcaagaauauacuccgauccucuagcgcugaaggaguucaaagaguucgccgcugggaggaagaguuugacauuaaaccugaucaccgagaugggacggcucccgacauuuaugacucagaaggcccgagacgcacuggauaaucuugcugugcugcacacggccgaagcaggagguagagccuauaaccaugcucucagcgaguugcccgagacccuggaaacacuacugcuccuuacucuguuagcgaccgucacagggggaauuuucuuguuucugaugucgggcaaagguguggggaagaugacccucggcaugugcugcaucauuacugccucuauccugcuuugguacgcacaaauacagccacacuggauugcugccuccaucauccuggaguucuuucucauuguauugcugaucccugaacccgagaaacagcgcacgccacaggacaaucaauuaaccuaugugguuauagccauucuaacagucguggcagcuacuauggccaacgaaaugggauuccuggagaagaccaaaaaggaccucggccuugggagcaucgcgacacaggagccugaaucaaauauucuggauaucgacuugaggcccgcuagugccuggacccuguacgcaguggccacuacauuugucacgccgaugcuccggcacucuauagagaacuccagcguuaaugugucacugaccgcuaucgcaaaccaggccacuguacuuaugggacucgguaagggcuggccacugaguaaaauggauauuggggugccuuugcuggcgaucggauguuacagccaggucaaucccauuacauuaaccgcugcccuacugcuccuuguggcacauuaugccaucauuggcccaggucugcaagcuaaggccacccgugaagcacagaaaagagcugccgcggggaucaugaagaaccccacaguugacggcgugacugucauagauuuggacccuauuccguacgaucccaaauucgagaagcagcugggacagguaaugcuccugauccuuugcgugacgcaaguuuuaaugaugaggaccacaugggcccugugugaagcacucacuuuggcuaccggcccaaucuccacacugugggaggggaauccuggacgcuuuuggaacaccacuauugccgugucuauggcaaauauauuccggggcagcuaucuagcuggugccgggcugcucuuuuccaucaugaagaacacgacaaauacccgaagaggaacuggcaacauuggugagacccuuggcgaaaaauggaagucaaggcugaaugccuuggggaaaucugaguuccagaucuacaagaaaaguggcauucaggaagucgaccgcacacuggcgaaggagggcaucaaaagaggggaaacugaucaccaugcugugucgagaggaagcgcaaagcuccguugguuugucgaaaggaacauggugacccccgagggcaagguuguggaccuggguugcgggcggggaggcugguccuauuacugugguggcuuaaaagauguacgcgaagugaaggggcuuacaaaaggaggcccugggcacgaggaaccaauacccaugucuacguauggauggaaccugguccgacuccaaucaggcguugacguguucuucaccccuccagagaagugcgauacucuacugugugacaucggugagagcucccccaauccgacaauugaagccgggagaaccuugaggguccugagucucguggagaacuggcuuaauaacgacacucaguuuugcaucaaaguacugaauccuuacaugccaucugugauugaaaagauggagacauugcagcggaaguacggaggcgcucugguucgcaacccccucagcagaaauucaacccaugaaauguauuggguguccaacgccacgggcaauaucgucaguagcgugaacaugauaucuaggauguuaauuaaucgauucaccaugaaacacaagaaagcaacauacgagccugaugucgaccugggguccggaacucggaacaucgguaucgagucagaaauuccaaaucuugauauaaucggcaagcguauugagaaaaucaagcaggaacacgagaccagcuggcauuaugaccaagaucaccccuacaagacaugggccuaucaugggucguacgaaacuaaacagaccggaucugcuaguuccauggugaacggcguuguaagacugcuaacaaagccgugggacguggucccuauggugacccagauggcgaugacugauacgacacccuuuggucagcaacgcguuuucaaagagaagguggacaccaggacucaggagccaaaagaagggaccaagaagcucaugaaaauuacagccgaguggcuguggaaggaauugggcaaaaagaaaacgccucggauguguaccagagaggaguuuacucgcaaggucaggagcaaugcagcucugggcgccaucuucacagaugaaaacaaauggaagucagcacgagaggccguggaagacucccgguuuugggagcucguagauaaggaaagaaaccuucaccuggagggcaaaugcgagaccuguguguauaauaugauggggaagagggagaaaaaguuaggagaguucgguaaagcuaagggcucucgcgccauaugguacauguggcugggggcgagauuuuuggaguucgaggcacucggauuucugaacgaagaccacugguucagccgggagaauagucuauccggcguugagggugaagggcuucauaagcugggauacauccucagagacgucagcaaaaaggagggcggcgccauguaugcugaugacacugccgggugggauacaaggauuacccuggaagacuugaaaaacgaggaaauggugacaaaucacauggagggagagcauaagaaacuggcagaagcuaucuuuaagcucacuuaccagaacaaggugguccgcguucagcgacccaccccacgggguacggugauggauauuaucucuagaagggaccaacgcggcucagggcagguaggaaccuauggccuuaauacauucacuaacauggaggcccagcugauuagacaaauggaaggugaggggguguucaaaaguauacagcgguuaaccgucacagaggaaaucgcugugcagaauuggcuggccaggguuggacgugagcgauugucccgcauggcaauuagcggcgaugacugcguggucaagccccucgaugacagauuugcgucugcccugacugcucuaaacgauaugggcaaagugcggaaggacauccagcaaugggaaccuucgaggggguggaaugauuggacccagguaccauucugcucacaccauuuucacgagcuuaucaugaaagacggacgcaugcugguugugccguguagaaaccaggacgaacucauuggucgggccaggauaagccagggcgcaggguggucccugaaggagacggcuugcuugggaaagaguuacgcccaaauguggucuuuaauguauuuccaccgacgugaucugagacucgcagccaaugcgaucuguagcgcuguccccucccauugggugccuacaucacgcaccacuuggaguauucacgccaaacaugaguggaugacaaccgaagacaugcuuacuguguggaaccgggucuggauccaggagaauccauggauggaagauaagacccccguugagucuugggaagaggugccuuaccugggcaaaagggaggaccaguggugcgguagccuaauugggcugacauccagagcaacgugggccaagaacauccagaccgcuauaaaccaaguacgcucacucaucggaaaugaagaguauacugauuacaugccaagcaugaaacgguuuaggcgagaagaggaagaggccggcguguugugguga

SEQ ID NO: 14863 - RNA, 9876 nt, Artificial Sequence
  derived and/or modified CDS sequence (opt3) from DENV-2__EU482781__SS-prME
accgcaggagugauaauuaugcugauacccaccgcuauggcauuccaccucacuacgcggaacggggagccucauaugaucgucggaaggcaggaaaaggguaaaagccuucuguuuaagaccgaggacggaguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccguacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcagccaggcaagcgcucucucagaccgcaacccacagaacugaaauauucguggaagacgugggggaaggcaaaaaugcuuagcaccgagucccauaaccagacuuucuugauugauggaccugaaacagcggagugcccaaauaccaacagggcuuggaacucacuggagguggaagacuacggcuuugguguguucacaacuaacaucuggcucaagcugcgugagaaacaggacgucuuuugugauaguaaguuaaugucugccgcaauaaaagacaaucgggccguucacgcugauaugggguauuggauugaaagcgcccugaacgacaccuggaagauggagaaggcauccuucaucgaggugaaaucaugccacuggcccaagagccauacgcuuuggucuaauggaguguuggaauccgagaugaucauuccuaaaaguuucgcuggcccaguaagccagcacaacuaccgacccgguuauuacacacaaaccgccggcccguggcaucucgggaagcuggaaauggauuuugacuucugugagggaacuaccgucgugguuacagaagauugcggcaacagagggccuucucuaaggacuaccacagcguccggaaaacugaucacggaguggugcugucgcucaugcacccucccaccccugcgguacagaggcgaggacgguuguugguaugggauggaaauuaggccucuuaaggagaaggaagagaauuuggugaacagucuggucacugccggacacggccagauagauaauuuuagcuuaggugugcucggcauggcucuguuccuugaagagaugcugcgcacacgaguugggaccaaacaugcaaucuugcucgugacuguaucguuugucacacugauuaccggaaacauguccuuccgggaccuaggccgugugauggugauggucggggccgcuaugacggaugacaucggaaugggcguuacuuaccuggcccuccuggcagcguuuaaggugagacccaccuucgccgcuggucuuuugcugaggaaauuaacaucuaaggagcucaugauggccaccauugggaucgcacugcuuagccagucaacuauaccagaaacaauccuggagcuaaccgaugcucucgcccugggaaugaugguauugaaaauugugcgcaauauggaaaaguaucaacuggcagucacaaucauggccauuaguugcgugccuaacgcuguuaucuuacagaaugcguggaagguguccuguacuauacucgccgcagucucugugagcccccugcuucugaccuccucacagcagaaagcugacuggauuccauuggcccucacgaucaagggccugaacccgacagccaucuuucuaaccacucugagccggaccaguaaaaagagaucuuggccucuuaaugaggcuauuauggcaguuggcaugguguccauacucgccagcucgcuguugaaaaacgacauccccaugacagggccacuggucgcgggagguuuacucacuguaugcuacgugcugaccggcaggucagcugaucuugaacuggagcgagccacggacguuaagugggaggaucaagcagaaauuucugggaguucccccaucuugagcauuacaaucgccgaggacggaucuaugagcaucaagaaugaagaggaggaacagacccucacuauccugauucgcacaggccuacuggugaucuccggucuuuucccugucucaauuccaaucaccgcugcagccugguaucucugggaggugaagaagcagcgggcggggguacugugggaugugcccaguccuccgccagucggaaaagcugaauuggaggacggcgccuacagaauaaagcagaaaggcauuuuaggguauagccaaaucggagcagggguuuacaaggaaggcacuuuucacacaauguggcacgugaccaggggugcagugcugaugcaucguggaaaacgcaucgagcccucuugggcugaugucaagaaggaccucauuuccuacggcgguggguggaaacuggagggagaauggaaggagggcgaagaggugcagguucuugcccuggaaccuggcaaaaacccacgggcaguacagacgaagcccggguuguucaaaacuaauaccggaacaaucggugcugugucacuagauuuuaguccuggcaccagcggguccccgauagucgacagaaagggaaaggugguuggccuguaugguaacgggguggucacaaggucuggagccuacgugucggcgauugcccagacugagaaaagcaucgaggauaaucccgaaauugaggacgauaucuuccgaaagaaacggcucaccauaauggaccugcacccaggcgcaggcaagacgaaacgcuaucuuccugcuauuguaagagaagccaucaagaggggguuacggacacugauccucgcucccacucgagucguggcagccgagauggaagaggccuugagaggacugccaauucgcuaccaaaccccugcuaucagggcggagcauacaggucgugaaauuguugaccucaugugucacgcaaccuucacuaugcggcugcuuucacccgugagagucccaaacuauaaccugauaaucauggaugaggcccauuuuaccgacccggcuuccauugccgcaaggggcuacaucaguacacgcguggaaaugggggaggccgcuggaaucuucaugacggcgacuccucccggcucucgagauccauuuccccagagcaaugccccuauuauggacgaggaaagagagauaccagaacgguccuggaacucaggucacgaguggguuaccgauuucaaggggaaaacagugugguuuguccccucuaucaaggcaggaaaugacauugcugccugcuugaggaaaaacggcaagaaagugauccagcuaagccgcaagaccuucgauagugaauauguaaagacucguacaaaugacugggauuuugugguuaccacggacauuuccgagaugggcgcaaacuucaaagccgagagagucaucgauccucggagguguaugaagccggugauacugacugacggggaagaacgcgugauccucgcuggaccaaugcccgucacacacagcucugccgcgcaacgaagaggucggauuggcaggaauccuaaaaacgaaaaugaccaguacaucuacaugggggagcccuuagaaaacgaugaggacugcgcacauuggaaggaggccaaaaugcugcuugauaauauuaacaccccagaaggaaucauaccuucaauguuugagcccgaacgcgagaagguagacgcuauugauggcgaauauagacugaggggugaggcccggaaaaccuucguggaccucaugcgucgcggggauuugccaguuuggcuggcuuaccgaguggcagccgagggcaucaauuaugcugacagaaggugguguuuugauggagucaagaacaaucagauucucgaagagaacguggaaguugagaucuggacuaaggagggcgaacggaaaaagcugaaaccucgcuggcuugacgccagaauauacuccgauccgcuagcacugaaggaguucaaagaguucgcggccgggaggaagaguuugacauuaaaccugaucaccgagaugggacggcuccccacauuuaugacucagaaggcucgagacgcccuggauaaucuugcagugcugcacacggcugaagccgguggcagagcauauaaccaugcccucagcgaguugccagagacccuggaaacacuacugcuccuuacucuguuagcuaccgucacagggggaauuuucuuguuucugaugucgggcaaagguguggggaagaugacccucggcaugugcugcaucauuacugcgucuauccugcuuugguacgcccaaauacagccucacuggauugcagcuuccaucauccuggaguucuuucucauuguauugcugauccccgaaccagagaaacagcgcacgccucaggacaaucaauuaaccuaugugguuauagccauucuaacagucguggccgcaacuauggcuaacgaaaugggauuccuggagaagaccaaaaaggaccucggccuugggagcaucgccacacaggagcccgaaucaaauauucuggauaucgacuugaggccggcgagugcuuggacccuguacgccguggcaacuacauuugucacgccaaugcuccggcacucuauagagaacuccagcguuaaugugucacugaccgccaucgcuaaccaggcaacuguacuuaugggacucgguaagggcuggccucugaguaaaauggauauuggggugcccuugcuggccaucggauguuacagccaggucaauccaauuacauuaaccgcggcucuacugcuccuuguggcccauuaugcaaucauuggccccggucugcaagccaaggcuacccgugaagcccagaaaagagcagcugccgggaucaugaagaacccuacaguugacggcgugacugucauagauuuggacccgauucccuacgauccaaaauucgagaagcagcugggacagguaaugcuccugauccuuugcgugacgcaaguuuuaaugaugaggaccacaugggcgcugugugaagcccucacuuuggcaaccggcccuaucuccacacugugggaggggaaucccggacgcuuuuggaacaccacuauugcugugucuauggccaauauauuccggggcagcuaucuagccggugcugggcugcucuuuuccaucaugaagaacacgacaaauacccgaagaggaacuggcaacauuggugagacccuuggcgaaaaauggaagucaaggcugaaugccuuggggaaaucugaguuccagaucuacaagaaaaguggcauucaggaagucgaccgcacacuggccaaggagggcaucaaaagaggggagacugaucaccaugcggugucgagaggaagcgcuaagcuccguugguuugucgaaaggaacauggugaccccugagggcaagguuguggaccuggguugcgggcggggaggcugguccuauuacugugguggcuuaaaagauguacgcgaagugaaggggcuuacaaaaggaggcccagggcacgaggaacccauaccuaugucuacguauggauggaaccugguccgacuccaaucaggcguugacguguucuucaccccacccgagaagugcgauacucuacugugugacaucggugagagcuccccgaauccuacaauugaagcagggagaaccuugaggguccugagucucguggagaacuggcuuaauaacgacacucaguuuugcaucaaaguacugaauccauacaugcccucugugauugaaaagauggagacauugcagcggaaguacggaggcgcccugguucgcaacccucucagcagaaauucaacccaugaaauguauuggguguccaacgcuacgggcaauaucgucaguagcgugaacaugauaucuaggauguuaauuaaucgauucaccaugaaacacaagaaagccacauacgagccagaugucgaccugggguccggaacucggaacaucgguaucgagucagaaauucccaaucuugauauaaucggcaagcguauugagaaaaucaagcaggaacacgagaccagcuggcauuaugaccaagaucacccguacaagacaugggcauaucaugggucguacgaaacuaaacagaccggaucugccaguuccauggugaacggcguuguaagacugcuaacaaagccuugggacgugguccccauggugacccagauggcuaugacugauacgacaccauuuggucagcaacgcguuuucaaagagaagguggacaccaggacucaggagccuaaagaagggaccaagaagcucaugaaaauuacagcggaguggcuguggaaggaauugggcaaaaagaaaacgccccggauguguaccagagaggaguuuacucgcaaggucaggagcaaugccgcacugggcgcuaucuucacagaugaaaacaaauggaagucagcccgagaggcaguggaagacucccgguuuuggaagcucguagauaaagagagaaaccuucaccuggaaggcaagugcgagaccuguguguauaauaugauggggaaaagggagaagaaauuaggagaguucgguaaggccaagggcucucgcgcuauaugguacauguggcugggggccagauuuuuggaguucgaagcgcucggauuucugaacgaggaccacugguucagccgggaaaauagucuauccggcguugagggugaggggcuucauaaacugggauacauccucagagacgucagcaagaaagaaggcggcgcaauguaugccgaugacacugcugggugggauacaaggauuacccuggaggacuugaagaacgaagagauggugacaaaucacauggaaggagagcauaaaaagcuggccgaggcaaucuuuaagcucacuuaccagaacaaagugguccgcguucagcgaccaacaccccgggguacggugauggauauuaucucuagaagggaccaacgcggcucagggcagguaggaaccuauggccuuaauacauucacuaacauggaagcucagcugauuagacaaauggagggugaagggguguucaagaguauacagcgguuaaccgucacagaggagaucgccgugcagaauuggcuggcuaggguuggacgugaacgauugucccgcauggccauuagcggcgaugacugcguggucaaaccucucgaugacagauuugcaucugcgcugacugcccuaaacgauaugggcaaggugcggaaagacauccagcaaugggagccaucgaggggguggaaugauuggacccagguaccguucugcucacaccauuuucacgaacuuaucaugaaggacggacgcguucuggugguccccuguagaaaccaggacgagcucauuggucgggcuaggauaagccagggcgccggguggucccugaaggaaacggcaugcuugggaaaaaguuacgcucaaauguggucuuuaauguauuuccaccgacgugaucugagacucgccgcaaaugccaucuguagcgcggugccuucccauugggugccaacaucacgcaccacuuggaguauucacgcuaagcaugaguggaugacaaccgaggacaugcuuacugucuggaaccggguuuggauccaggaaaaucccuggauggaggauaaaaccccuguggaaucuugggaggaaguaccauaccugggcaagagggaggaccaguggugcgguagccuaauugggcugacauccagagccacgugggccaaaaauauccagaccgccauaaaccaagugcgcucacucaucggaaaugaggaauauacugauuacaugcccagcaugaagcgguuuaggcgagaggaagaggaagcuggcgucuugugguga

SEQ ID NO: 14864 - RNA, 9876 nt, Artificial Sequence
  derived and/or modified CDS sequence (opt3) from DENV-2__EU482782__SS-prME
agcgccggaaugaucauuaugcugauaccaaccgugauggcuuuccaccucacuacuagaaacggggaaccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauacgggggaucaugcaagccggaaaacgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucaacacaauuaccggccuggcuaccacacgcagauugcugguccauggcaucugggcaagcuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaucggggagaggacggcuguugguacgguauggaaauaagaccauugaaagagaaggaagagaaucuggugaacucauuaguuacggcggggcacggacagguggauaauuucagucucggcguacuggguauggcccuuuuucuggaagagauguugaggacccgcgucggcacuaaacaugcuauccuccugguggcagugagcuucgucacacuaauuaccgggaacaugucguuuaaggaccugggacgaguugugguaauggugggcgccacuauggcugaugacaucgggaugggagucacauaucucgcccugcuugcagcguucaaagugcggcccaccuuuguugccggcuugcuguuacguaagcucacguccaaggagcugaugaugacuaccauugguaucgugcuucugucucaaagcacaauaccugaaaccguccuagagcucacugaugcucuggccuuggggaugauggugcugaaaaucguuagaaauauggaaaaguaccaguuagcagugacaauuauggcuauccucugcguccccaacgccguaauucugcagaaugcauggaaagugucauguaccauccuugccguugugagugucuccccacuguugcucacaucuagccagcaaaagacugacuggauaccucuggcucuaaccauuaaaggacugaaccccacggcgaucuuccuuacaacccucuccaggacuaauaagaaacgcucauggccacugaacgaggccaucauggcagugggcaugguaagcauuuuggcuaguucucuguuaaagaaugacauaccgaugaccggcccucucguggccgggggacugcuuacagucugcuauguucugacuggucgguccgccgauuuggaacucgagagagcuaccgacgugaagugggaggaucaggcagaaaucagcggcucgucacccauucugucuaucacgauuagugaggacggguccaugagcaucaaaaacgaagaggaggaacagacacuaaccauacugaucaggacuggacuucucgugauuucuggccuguuuccaaucagcauucccaucacagccgcggcuugguacuugugggaggucaagaaacagcgagccgguguguuaugggauguuccuuccccacccccuauggggaaggcagaacuggaggacggagccuaucgcauaaaacaaaagggcauucucggcuacucacagaucggggcuggaguauacaaggaagguaccuuccacacuauguggcaugugacacggggcgcaguccugaugcacaaagggaagagaaucgagccgaguugggccgaugugaaaaaggaccuuauuagcuauggaggcgguuggaaacuggagggggaauggaaggagggagaagagguucagguguuggcgcuagaaccaggcaagaaucccagggcuguccagaccaaaccuggccuguuuaagacgaacacugggaccaucggagccgugucucucgauuucuccccagguacaucaggcagucccauaauugacaaaaaggggaaaguagucggacuguacggcaacggugugguuacccguagcggggcauauguguccgccaucgcucaaacagagaagucuauugaggauaauccugaaaucgaggacgauauauuucgcaagcggagacuuacuauuauggacuuacacccgggagccggcaaaaccaagagguaccugcccgcaaucguccgagaagcuaucaaacggggccuccgcacguugauucuggccccaacaagagugguugcggccgagauggaagaggcacucagggggcugccuauccgguaucagacucccgcuauucgagccgagcauaccggaagagaaauaguggaccuuaugugucacgcuacauucaccaugcgccuguugucgccagucagggugccuaacuacaaucuaaucauuauggaugaggcacauuucacugaccccgccagcaucgccgcucgugguuauaucucaacccggguagaaaugggcgaggcggcagggauuuuuaugacagccacgccaccgggauccagagauccuuucccccagaguaacgcuccaauaaucgacgaggaaagggagauucccgaacgcucuuggaauagcggccacgagugggugacugauuuuaaggguaaaaccguuugguucgucccuuccaucaaggccgggaacgacauugcagccugccugcgaaagaauggcaagaaggugauccaacucucaagaaaaacauuugauucugaauacgugaagacccggacuaacgacugggauuucgucguaacaaccgacauaagcgagaugggcgcuaauuuuaaagcggagagggugaucgauccacgccguuguaugaagcccguuauuuuaacggacggcgaagagagagugauccuggccgggccuaugccggucacucauaguuccgcagcucagcggaggggacgcauuggucgaaaccccaaaaaugaaaacgaccaguacaucuauaugggcgagccccuugaaaaugaugaggacugcgcccacuggaaggaggcaaagaugcugcucgauaacauaaauacaccugaagggauuauccccagcauguucgagccagaaagagagaaaguggacgccauugauggagaauaccgguugaggggcgaggcucgcaagaccuuuguugaccugaugagaaggggugaucucccuguguggcuggccuauaaagucgcggcagaggggaucaacuacgccgaccggcguugguguuucgauggcauaaagaacaaucagauccuugaagagaacguggaaguagagauuuggaccaaagagggagaacgcaagaagcuaaaaccccgauggcuggacgcuagaaucuauucugauccauuggccuuaaaggaguuuaaagaguucgcugcaggcaggaagucacugacucucaaucugauuacagagauggggcggcuuccuaccuucaugacacagaaaacucgcgacgcccuggauaaccucgcuguguugcacacggccgaagcaggagguagagcguacaaucaugcccuguccgagcuaccggagacccuggaaacacuccuucuguuaacuuugcuggcuaccguuacaggcgggaucuuucucuuccugaugaguggaaggggcauagguaagaugacccuugggaugugcugcauuaucacugccagcauccugcucugguaugcacagauucagccccacuggaucgcugccucgauaauuuuggaguuuuuccugaucgucuuacuaauuccagaaccugagaagcagcggacgccccaagacaaccagcugaccuacguggugaucgcaauacucacagucguugccgcuacuauggcgaaugaaaugggcuuucuugagaaaaccaagaaagaccugggauugggcucuaucgccacacagcagccagaguccaacauucuggauaucgaccuccgaccugcaagcgcuuggacccuguacgccguggccacuacauucguaacgcccaugcuuagacauucaauugaaaauaguucugugaacgucucccucaccgcaaucgcuaaucaagccacugugcugaugggguugggaaaggguuggccgcugagcaaaauggauauuggcguuccauuacuagcgaucggguguuauucacaggugaacccuauaacacugaccgcugcccuccuucuguuggucgcacacuacgccauuaucggacccggccugcaggcuaaggcaacccgcgaggcccagaagagggcggcugccgguaucaugaaaaauccaacaguagacgggauuacugugauagaucucgaccccaucccuuaugauccgaaguuugaaaaacaacugggccagguuaugcuuuuaauucugugcgugacgcagguccucaugaugcggaccacaugggcauugugugaggcccugacucuagcuaccggacccaucaguacacugugggaaggcaacccagggcguuucuggaauaccacuauugccgugagcauggcaaacaucuuuagaggauccuaccucgcuggcgccggucuucuguucucuauaaugaagaauacgacaaacaccaggcgcgggacuggaaacaucggcgagaccuugggugagaaauggaaaagccggcugaaugcgcucggcaaauccgaauuucaaauuuauaagaagucagggauccaggaggucgaccgaacacuggccaaagaaggaauuaagagaggcgagacugaucaccaugcagugucuagggggagugcuaaauuacgcugguucguugagcggaacauggugaccccugaaggaaagguaguggaccuuggcugcgguagagggggauggucguacuauuguggcggucugaaaaauguccgugagguuaagggccucacaaaagggggacccggccacgaagaaccuaucccaaugagcacguacggguggaaccuagugaggcugcaguccggagucgauguguuuuucauacccccugaaaaaugcgacaccuugcugugugauauuggcgagucuucaccaaaucccacuguagaggccggucggacacuccgcgugcuuaaccugguugaaaauugguugaacaauaacacccaguucugcaucaaggugcugaauccguacaugccuagcgucaucgagaaaauggaagcacuccaacgaaaguaugggggagcuuuagugagaaacccacuguccaggaauaguacucaugagauguacugggucucuaacgccagcggcaauauugugucauccguuaacaugauaagucggaugcuuaucaaccgcuuuacaaugagacacaaaaaggccaccuaugaacccgacguagaccugggcagcgggacgaggaauauuggaaucgagucugagauuccuaaccuagauaucauagguaagcgaaucgagaaaauuaagcaggagcaugaaaccuccuggcacuacgaccaggaucacccauauaaaacaugggcguaccauggcucauaugagacuaagcagaccgggagcgcuucgucuauggugaauggagucgugcggcuccugacaaaacccugggacguuuugccgacugugacccaaauggcaaugacagauaccacuccuuucggccagcagcgugucuuuaaggaaaagguggacacgagaacacaggagcccaaagaggguaccaagaaacugaugaagaucacugccgaauggcucuggaaagagcuugggaagaaaaagaccccacgcauguguacaagggaagaguucacgcggaagguaagaaguaacgcugcccugggagcaauuuuuaccgaugagaauaaauggaaguccgcccgcgaagcuguggaggacagcagguucugggaauuaguugauaaagagcgaaaccugcacuuggaaggcaagugcgagacuugugucuacaauaugaugggcaaacgggagaagaagcucggggaauuuggaaaagcgaaggguucaagagccaucugguacauguggcugggcgcaagguuccuagaguuugaagcucuuggguuccugaacgaggaccauugguuuucccgcgaaaauucucucagcggaguggagggcgagggucugcacaaauugggguauauucugcgugaugugaguaagaaagaaggaggcgccauguacgcagacgacacagccggcugggauacccggauaacucucgaggaccuuaagaacgaagagauggucacaaaucacauggaaggggagcauaagaaacuggcugaggccaucuucaaguuaaccuaucaaaacaaaguugugagaguacagaggccuacaccccgcggaacugugauggauauuaucucccgacgggaccagagagguagcggccaagucgggaccuacggacugaauacguuuaccaacauggaagcgcaguugaucaggcagauggagggcgaagguguguucaagaauauucagcaccucacaguuacugaggagguggcaguccauaacuggcuggcccgcguggggagagaacggcuaucuaggauggcuauaucaggagaugacugcguaguuaaaccacuugaugaccguuucgccaacgcacugaccgcucucaaugauaugggcaagauccgaaaggacauucaacagugggagcccaguaaaggcuggaacgauuggacacaggugccuuuuugcucccaccauuuccacgaacugaucaugaaggacgggcgcgucuugguggugccauguagaaaucaggaugaguuaauuggacgggccaggaucagccaaggugcuggcuggucucugcgcgaaacugccugccucgggaaaucguaugcacagauguggucacuuauguacuuucacagacgggaccugaggcuagcggccaacgcuauauguagcgccgucccgucccauuggguucccaccagucgaacgacauggucuauccacgcaaagcaugaguggaugaccacugaggacaugcugacaguguggaaucguguauggauuagagaaaacccuuggauggaggauaaaaccccaguggaaagcugggaggaaauccccuaucucggaaagcgcgaggaccaguggugcggcuccuugauuggucugacuucacgggcuaccugggccaagaauauccaggcagccauaaaccaagucaggagucuuauugggaaugaggaauacacagauuacaugccuucuaugaaaagauuccgccgggaggaagaggaagcgggagugcugugguga

SEQ ID NO: 14865 - RNA, 9876 nt, Artificial Sequence
  derived and/or modified CDS sequence (opt3) from DENV-2__EU482783__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagagcaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaagcuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccgggggaauuaaaggcaucaugcaggcagggaagcgcucucucagaccacaaccgacagaacugaaauauucguggaagacguggggaaaggcgaaaaugcuuagcaccgagucccauaaccagacuuucuugauugacggccccgaaacagcugagugcccuaauaccaacagggccuggaauucacuggagguggaagauuacgguuuugggguguucacaacuaacaucuggcucaagcugcgugagaaacaggacgucuuuugugacaguaaguuaaugucugcagccauaaaagauaaucgggcuguucacgccgacaugggauauuggauugaaagcgcacugaacgauaccuggaagauggagaaggcuuccuucaucgaggugaaaucaugccacuggccaaagagccauacgcuuuggucuaauggcguguuggaauccgagaugaucauucccaaaaguuucgccgguccuguaagccagcacaacuaccgaccaggcuauuacacacaaaccgcggggcccuggcaucucggaaagcuggaaauggacuuugauuucugugagggcacuaccgucgugguuacagaagacugcgggaacagaggaccgucucuaaggacuaccacagccuccggcaaacugaucacggaguggugcugucgcucaugcacccucccuccacugcgguacagaggugaggauggguguugguauggaauggaaauuaggccccuuaaggagaaggaagagaauuuggugaacagucuggucacugcuggccacggucagauagacaauuuuagcuuaggcgugcucgggauggcacuguuccuugaagagaugcugcgcacacgaguuggaaccaaacaugccaucuugcucgugacuguaucguuugucacacugauuaccggcaacauguccuuccgggaucuagggcgugugauggugauggucggagcugccaugacggacgauaucggcauggguguuacuuaccuggcacuccuggcggccuuuaaggugagaccuaccuucgcugccgggcuuuugcugaggaaauuaacaucuaaggagcucaugauggcaaccauuggaaucgcucugcuuagccagucaacuauacccgaaacaauccuggagcuaaccgacgcccucgcacugggcaugaugguauugaaaauugugcgcaauauggaaaaguaucaacuggccgucacaaucauggcuauuaguugcgugccaaacgcgguuaucuuacagaaugccuggaagguguccuguacuauacucgcagcugucucugugagcccucugcuucugaccuccucacagcagaaagccgauuggauucccuuggcccucacgaucaagggccugaacccaacagcuaucuuucuaaccacucugagccggaccaguaaaaagagaucuuggccgcuuaaugaggcaauuauggccguugggaugguguccauacucgcgagcucgcuguugaaaaacgacaucccuaugacaggaccccuggucgcugguggcuuacucacuguaugcuacgugcugaccgggaggucagccgaccuugaacuggagcgagcaacggauguuaagugggaggaccaagccgaaauuucuggaaguuccccaaucuugagcauuacaaucgcugaggauggcucuaugagcauaaaaaaugaagaggaggaacagacccucacuauccugauucgcacaggucuacuggugaucuccgggcuuuuccccgucucaauuccuaucaccgcagccgcgugguaucucugggaggugaagaagcagcgggcuggaguacugugggacgugccaagucccccuccggucggcaaagccgaauuggaggauggcgcauacagaauaaagcagaaagggauuuuaggauauagccaaaucggugccggcguuuacaaggaagggacuuuucacacaauguggcacgugaccaggggagcugugcugaugcaucguggcaaacgcaucgagccaucuugggccgacgucaagaaggaucucauuuccuacggugggggauggaaacuggagggcgaauggaaggagggcgaagaggugcagguucuugcacuggaacccgggaaaaacccucgggcuguacagacgaagccaggauuguucaaaacuaauaccgguacaaucggcgccgugucacuagacuuuagucccgggaccagcggauccccuauagucgauagaaagggcaaggugguuggucuguaugggaacggaguggucacaaggucuggcgcguacgugucggccauugcacagacugagaaaagcaucgaggacaauccggaaauugaggaugacaucuuccgaaagaaacggcucaccauaauggaucugcaccccggcgcugggaagacgaaacgcuaucuuccagccauuguaagagaagcuaucaagaggggauuacggacacugauccucgcaccuacucgagucguggccgccgagauggaagaggcuuugagaggucugcccauucgcuaccaaaccccagcgaucagggcagagcauacaggccgugaaauuguugaccucaugugucacgccaccuucacuaugcggcugcuuucaccugugagaguccccaacuauaaccugauaaucauggacgaggcucauuuuaccgauccagccuccauugcagccaggggguacaucaguacacgcguggaaaugggagaggcugcgggcaucuucaugacggccacuccgccugguucucgagaccccuuuccacagagcaaugcacccauuauggaugaggaaagagagauaccugaacgguccuggaacucagggcacgaguggguuaccgacuucaagggaaaaacagugugguuugucccaucuaucaaggcuggcaaugauauugccgcaugcuugaggaaaaacggcaagaaagugauccagcuaagccgcaagaccuucgacagugaauauguaaagacucguacaaaugauugggacuuugugguuaccacggauauuuccgagaugggggccaacuucaaagcugagagagucaucgacccccggagguguaugaagccugugauacugacugauggagaagagcgcgugauccucgccgguccgaugccagucacacacagcucugcggcacaacgaagaggccggauugggaggaaucccaaaaacgaaaaugaccaguacaucuacaugggagagccuuuagaaaacgacgaggauugcgcccauuggaaggaggcuaaaaugcugcuugacaauauuaacacccccgaaggcaucauaccaucaauguuugagccugaacgcgagaagguagaugccauugacggugaauauagacugaggggggaggcucggaaaaccuucguggaucucaugcgucgcggcgacuugcccguuuggcuggcauaccgaguggccgcugagggaaucaauuaugccgauagaaggugguguuuugacggcgucaagaacaaucagauucucgaagagaacguggaaguugagaucuggacuaaggagggggaacggaaaaagcugaaaccacgcuggcuugaugcaagaauauacuccgacccucuagcgcugaaggaguucaaagaauucgccgcuggaaggaagaguuugacauuaaaccugaucaccgagaugggucggcucccgacauuuaugacucagaaggcccgagaugcacuggacaaucuugcugugcugcacacggccgaagcaggcgggagagccuauaaccaugcucucagcgaguugcccgagacccuggaaacacuacugcuccuuacucuguuagcgaccgucacaggaggcauuuucuuguuucugaugucggguaaaggggugggcaagaugacccucggaaugugcugcaucauuacugccucuauccugcuuugguacgcacaaauacagccacacuggauugcugccuccaucauccuggaguucuuucucauuguauugcugaucccugaacccgagaaacagcgcacgccacaggauaaucaauuaaccuaugugguuauagccauucuaacagucguggcagcuacuauggccaacgaaaugggcuuccuggagaagaccaaaaaggaccucgggcuuggaagcaucgcgacacaggagccugaaucaaauauucuggacaucgauuugaggcccgcuagugccuggacccuguacgcaguggccacuacauuugucacgccgaugcuccggcacucuauagagaacuccagcguuaaugugucacugaccgcuaucgcaaaccaggccacuguacuuaugggucucggcaagggguggccacugaguaaaauggacauuggagugccuuugcuggcgaucggcuguuacagccaggucaaucccauuacauuaaccgcugcccuacugcuccuuguggcacauuaugccaucauugguccagggcugcaagcuaaggccacccgugaagcacagaaaagagcugccgcgggcaucaugaagaaccccacaguugauggaauaacugugauugacuuggauccuaucccguacgaccccaaauucgagaagcagcugggccaggucaugcuccugauccuuugcguaacgcaaguguuaaugaugaggaccacaugggcccugugugaagcacucacuuuggcuaccgggccaauuuccacacugugggagggaaauccuggccgcuuuuggaacaccacuauagccguuucuauggcaaauaucuuccgggguagcuaucuagcuggggccggacugcucuuuuccauuaugaagaacacgacaaauacccgaagaggcacugguaacaucggcgagacccuuggggaaaaauggaagucaaggcugaaugccuugggaaaaucugaguuccagauuuacaagaaaaguggcauccaggaaguggaucgcacacuggcgaaggaggggauaaaacggggagagacugaccaccaugcugucucgagaggcagcgcaaagcuccguugguuuguggaaaggaacauggucacccccgaggguaaggugguugaucuggggugcggacggggcgguugguccuauuacuguggcggguuaaaagacgugcgcgaaguaaagggacuuacaaaaggcgggccuggacacgaggaaccaauccccaugucuacguauggcuggaaccuggugcgacuccaaucaggugucgauguuuucuucaccccuccagagaagugcgacacucuacugugugauauuggggagagcucccccaauccgacaaucgaagccggaagaaccuugagggugcugagucucgucgagaacuggcuuaauaacgacacucaguuuugcauuaaagugcugaauccuuacaugccaucuguaaucgaaaagauggagacauugcagcggaaguacggcggcgcucuggugcgcaacccccucagcagaaauucaacccaugaaauguauuggguuuccaacgccacggggaauauagugaguagcgucaacaugauuucuaggauguuaaucaaucgauucaccaugaaacacaagaaagcaacauacgagccugacguggaucugggauccgguacucggaacaucggcauugagucagaaauaccaaaucuugacaucauugggaagcguaucgagaaaauuaagcaggaacacgagaccagcuggcauuaugaucaagaccaccccuacaagacaugggccuaucauggaucguacgaaacuaaacagaccggcucugcuaguuccauggucaacggugugguuagacugcuaacaaagccgugggauguagugccuauggucacccagauggcgaugacugacacgacacccuuugggcagcaacgcguguucaaagagaagguugauaccaggacucaggagccaaaagaaggaaccaagaagcucaugaaaaucacagccgaguggcuguggaaggaauugggcaaaaagaaaacgccucggauguguaccagagaggaguuuacucgcaaggugaggagcaaugcagcucugggcgccauauucacagacgaaaacaaauggaagucagcacgagaggccgucgaagauucccgguuuugggagcucguggacaaggaaagaaaccuucaccuggaggggaaaugcgagaccuguguauauaauaugaugggaaagagggaaaaaaaguuaggugaguucggcaaagcuaaggggucucgcgccaucugguacauguggcugggagcgcguuuuuuggaauucgaggcacucggcuuucugaacgaagaucacugguucagccgggagaauagucuauccgguguggagggggaaggacuucauaagcugggcuacauucucagagacguuagcaaaaaggagggcggggccauguaugcugacgauacugccggaugggacacaaggaucacccuggaagauuugaaaaacgaggaaauggucacaaaucacauggagggugagcauaagaaacuggcagaagcuauuuuuaagcucacuuaccagaacaagguggugcgcguccagcgacccaccccacggggcacgguuauggacaucauuucuagaagggaucaacgcgggucaggacaggugggcaccuauggucuuaauacauucacuaacauggaggcccagcugauaagacaaauggaaggggagggaguauucaaaaguauccagcgguuaaccgugacagaggaaauugcuguccagaauuggcuggccagggugggccgugagcgauugucccgcauggcaaucagcggcgacgauugcguugugaagccccucgacgauagauuugcgucugcccugacugcucuaaacgacauggggaaaguccggaaggauauccagcaaugggaaccuucgaggggauggaaugacuggacccaggugccauucugcucacaccauuuucacgagcuuauuaugaaagauggucgcguacugguugugccguguagaaaccaggacgaacucauaggccgggccaggaucagccagggggcaggauggucccugaaggagacggcuugcuugggcaagaguuacgcccaaauguggucuuuaauguauuuccaccgacgugaccugagacucgcagccaaugcgauuuguagcgcuguccccucccauugggugccuacaucacgcaccacuuggaguauccacgccaaacaugaguggaugacaaccgaagauaugcuuacuguguggaaccgggucuggauucaggagaauccauggauggaagacaagacccccguugagucuugggaagaggugccuuaccuggguaaaagggaggaucaguggugcgggagccuaaucggacugacauccagagcaacgugggccaagaacauacagaccgcuaucaaccaaguacgcucacucauuggcaaugaagaguauacugacuacaugccaagcaugaaacgguuuaggcgagaagaggaagaggccggcguguugugguga

SEQ ID NO: 14866 - RNA, 9876 nt, Artificial Sequence
  derived and/or modified CDS sequence (opt3) from DENV-2__EU482784__SS-prME
agcgccggcaugaucauuaugcugauaccaaccgugauggcuuuccaccucacuacuaggaauggggaaccucauaugaucgucgguauucaagaaaagggaaaaucccuucuguuuaagacggaggacggcguuaauaugugcaccuugauggcaauggauuuaggggaacugugugaggacacaaucacuuacaaaugcccacuucucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaggaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauacgggggaucaugcaagccggaaaacgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacguauuuugugacucuaaguuaaugagcgcggcuauuaaggauucccgugccguccaugcagacauggguuauuggaucgagucagcccugaaugauacuuggaaaauagagaaggcuagcuucauugaagugaaaucuugccacuggccuaagucccauacccuuuggaguaacgggguuuuggagagcgaaaugaucauccccaagaauuucgccggacccgugucucaacacaacuaccggccuggcuaccacacgcagacagcagguccauggcaucucggccgacuggagauggacuuugauuucugugaagggaccacugucgugguuaccgaggacugcggaaacagaggccccucccuaaggacaacuaccgcuucagggaagcugauuacagaguggugcugucgcaguugcacgcucccgccucugcgguauagaggagaagauggcuguugguacgguauggagaucaggccacuuaaggaaaaagaggaaaauuuggugaacagccugguaaccgccgggcacggacagauugacaauuuuucguuaggcguccucgguauggcgcuguuccuugaggagaugcugcgcacucgaauaggcacaaagcaugccaucuugcucguggcuguguccuuugucacccugauuacugggaacaugucuuuccgggaucuaggacguguuauggugaugguaggcgcaacaaugaccgacgauaucgggaugggagugacguaucuggcccuccuggcugccuuuaaagucagacccacuuucgcagcgggccuuuugcugaggaaguuaaccagcaaagaacucaugaugacaaccauugguaucgugcugcuuucacaaaguacuauaccugagacaguucuggaacuaaccgacgcccucgcucuggggaugaugguguugaagaucguccgcaauauggagaaguaccagcuggccgugacaauuauggcaaucuuaugcguucccaacgcugugauucuccagaaugccuggaaagucuccuguacuauccuggcaguagugucuguuagcccacuucuguugaccuccucacagcaaaagacggauuggauaccucucgcccugacaauuaaaggacuaaaccccaccgcuaucuuucugacuacccuuagccggacaaauaagaaaagaaguuggccacucaacgaagcgaucauggccgugggcauggucucuauucuggcauccagcuugcugaagaaugacauaccgaugacuggcccuuuaguggcugggggacuccugaccguaugcuaugugcuuacggguaggucggccgaccuggaguuggagcgagccacagaugucaaaugggaagaccaggcugagaucucaggcucuagucccauucucuccaucaccauuagcgaagaugggucuaugagcaucaagaacgaggaggaagaacagacucugacaauacuaauccgcaccggacugcuuguuauuuccggccucuucccaaucucaauucccaucacugcagccgcgugguaccugugggaagugaagaaacagcgggcugguguguugugggacgucccuaguccacccccuauggggaaggccgaguuagaagauggagcauauagaauaaaacaaaagggcauucugggcuacagccagaucggggccggaguguacaaagaggguacauuucacaccauguggcauguuacgaggggcgcuguacucaugcacaaggggaagcguaucgagccgucuugggcagacgugaaaaaggaucugauuuccuauggaggcgguuggaaacuugaaggggaguggaaggaaggagaggaaguccaggugcuggccuuggagccaggcaaaaauccccgcgcgguucagacuaagccuggccuauucaagaccaacacagggaccaucggagcugugucacuggacuuuaguccagguacaagcggcucccccauaauugauaaaaaggggaaagucgugggacucuacggcaaugguguagucacucggucuggggccuaugugucggcaaucgcccaaaccgaaaagagcauugaagacaacccugagaucgaagaugacauauucagaaaaaggcgacugacgauuauggaucuucacccgggagcuggcaagacaaagcgguacuuacccgccaucguucgcgaggcaaucaaaagaggccugaggacucucauuuuggcuccaacccggguggucgccgcggaaauggaggaggcccugcgagggcucccuaucagauaucagacacccgcaauucgcgcugaacauaccggaagggagauaguggaccugaugugucacgccacuuucaccaugcgucuucugucaccaguucgggugccuaacuacaauuugaucauuauggacgaagcucauuuuacagaucccgcauccaucgccgccagagguuauaucaguacgagggucgagaugggcgaggcugcggggauuuucaugacugcaaccccaccgggaucucgcgacccuuuuccccagagcaacgccccaauaaucgaugaagaacgagaaauucccgagagauccuggaacucaggccacgaaugggugacagacuucaaggguaaaaccguaugguuugugccuucuaucaaggcugggaacgauauugccgcaugccuacggaaaaauggaaagaagguuauccaacugagcaggaaaacuuucgacagugaguacgucaagacacgcaccaacgauugggacuuuguggugacgacugauauauccgagaugggcgccaauuucaaagcugaacgugucaucgacccaagacgguguaugaagcccguaauucucacagauggcgaggaaagggugaucuuagcggggccuaugccgguuacccauagcucugccgcacagcgccgaggaagaauuggucggaaccccaaaaaugagaacgaccaguacaucuauaugggcgaaccccuggagaaugacgaggauugcgcucacuggaaggaagccaaaaugcuucuggacaacauaaauaccccugaggggauuauccccucaauguuugaaccagagagggaaaagguggaugcaauugacggagaguaccgccucagaggcgaggccaggaagacuuucgucgauuugaugcggcguggugaccugccuguguggcucgcuuauaaaguugccgcggaagggaucaacuacgcagaucgccgaugguguuuugacggcauaaagaauaaccagauccuggaggaaaacguggaggucgagauuuggacaaaagaaggagagagaaagaaacuuaagcccagguggcuagaugcccggaucuauuccgacccacuggcuuugaaggaguucaaagaguucgccgcuggccgcaagaguuuaacccugaaucucauuacagaaauggggagacugccuacuuuuaugacgcagaaaaccagggaugcacuugacaaccuggccgugcuccacacagcugaggccggaggucgggcauacaaucaugcguugagcgagcugccggaaacucuagagacccugcuccuucugacauuauuggccaccguaacuggcgggaucuuccuguuucucaugucgggacgaggcauagguaagaugacgcuggggaugugcugcauuaucaccgcuucuauccuucugugguaugcccagauucagccccacuggaucgcagcuuccauaauucucgaguucuuuuugaucgugcuguuaauuccagagccugaaaaacagagaacaccccaagauaaccagcuaacuuacguugucaucgccauacugaccgugguggcagccacaauggcuaaugagaugggcuuccucgagaagaccaagaaagaccuuggacugggcagcaucgcgacucagcagccagaaucaaacauuuuggacaucgaucugcgcccugccagugcauggacacucuacgcugucgccacgaccuuuguuacucccaugcugaggcauucuauugaaaauuccagcgugaacguaucacuuacagccaucgcaaaucaagcuaccgugcucauggggcugggaaaggguuggccguugaguaaaauggacauuggcgucccacuguuagccaucggguguuauagccaggugaacccuauaacccuaacagcggcucugcuccuucugguugcccacuacgcaauuaucggacccggcuugcaggccaaggcuacucgggaagcacagaaacgugccgcggcugguaucaugaagaauccaacgguggaugggauuaccgucauagaccuggaucccaucccuuaugacccgaaguucgagaaacaacucggccagguaaugcugcuuauuuuaugcgugacacagguucugaugaugagaacuaccugggcccucugugaagcauugacacuggccaccggacccaucuccacucuaugggagggcaacccagggagguuuuggaauacgacaauugcugugucuauggccaacaucuuccgcggaagcuaccuggcaggcgcuggucuccuauuuuccauaaugaagaauaccacuaacacccggcgagggacaggaaauaucggcgagacucugggugaaaaauggaagucaagauugaacgcccugggcaaaucugaguuccaaauuuauaagaaaagugggauccaggaagucgauaggacccucgcgaaggagggaauuaagcgcggcgagacagaccaccaugccgugucgcgggggagcgcaaaacugagaugguuugucgaacguaacauggugacgccugagggaaagguuguggauuuaggcugcgguagagggggaugguccuacuauuguggcggucuuaaaaauguacgggaagugaagggccugaccaaagggggacccggccacgaggaaccuaucccaaugucuacuuacggguggaaccucguccgccuacagucaggaguugacguguucuucauacccccugagaagugcgauacacuguugugugacauuggcgagagcuccccaaaucccaccgucgaagcuggucgaacucugagagugcucaaccuuguagagaauuggcugaacaauaacacacaguuuugcaucaagguguugaauccguacaugccuaguguuaucgagaaaauggaggcccugcaaaggaaguaugggggagcacucgugcggaacccauuaucucgcaauagcacccaugaaauguacugggucucaaacgcuuccggcaauauugugaguagcgucaacaugauaucuagaaugcugaucaauagguucacgaugcgacacaaaaaggccaccuaugagcccgauguggaccuuggcuccgggacacggaacauuggaaucgagucagaaauuccuaaccuggacaucauagguaaacguaucgagaagauuaagcaggaacaugagacuagcuggcacuacgaucaggaccacccauauaaaaccugggccuaccauggcucguaugaaacaaagcagacugggucugcgaguuccaugguuaauggaguagugagacuacucaccaaacccugggauguccugccgacagugacccaaauggcuaugacugacacgacaccuuuuggccagcagcgcguuuucaaggagaaaguggauaccaggacucaggagcccaaggaagguaccaagaaauugaugaagaucacagcagaguggcuguggaaagaacucgggaagaaaaagacgccacggauguguaccagagaggaguuuacucgcaaagucaggagcaacgccgcucuuggagccauuuucacagacgaaaauaaguggaagucagcacgagaggccguggaagauucccgguuuugggagcugguagacaaagaaagaaacuuacaccuggagggcaagugcgagaccuguguguacaauaugaugggcaaaagggaaaagaaauugggggaguucggaaaggcuaaggguucucgcgcgaucugguacauguggcucggcgcccguuuucuggaguucgaggcacuaggguuucuuaacgaagaucauugguucagccgggagaauagucuguccggaguugagggcgaaggucuccacaaacugggguauauuuugagagacgucagcaagaaagagggaggcgcuauguacgccgaugacacugcaggcugggacacaaggauaacccuggaagaucucaagaacgaggaaauggugacaaaucacauggagggggagcauaagaaacuugccgaagcuaucuuuaaacugacuuaucaaaacaaagugguccgcguucagcgaccuaccccacggggaacggugauggacauuaucucuagaagggaucagcgcgguucaggccaaguagggaccuacggauuaaauacauucacuaacauggaggcccagcugaucagacagauggaaggcgaggguguguucaagaauauucagcacuugaccgucacagaggaaguggcgguucauaacuggcucgcacggguggggagggagcgucugagucgaauggccauauccggagacgauugcgucgugaaaccacuagacgaucgcuuugcuaaugcccuuacugcacugaacgacaugggcaagaucagaaaagauauucaacagugggaacccagcaagggcuggaacgacuggacccagguaccuuucugcucucaccauuuucacgagcucaucaugaaggaugggcggguucugguggucccauguaggaaucaggacgaauugauuggacgcgcuagaaucucgcaaggugccggcuggucauuacgggagacggcuugccuggggaaaagcuaugcccagauguggucccucauguacuuccacaggcgagaucuucgucuggcagcgaacgccauauguagugcugugccgucucauugggugcccacaagcagaaccacuugguccauccacgccaagcaugaguggaugacaaccgaagacaugcuaacugucuggaaucgcguuuggauucgggagaacccuuggauggaagacaaaaccccaguggagucaugggaagagauccccuaucugggaaagagggaggaucaguggugcggcagucucauugguuugacaucuagagcaacgugggcuaaaaauauccaggccgcaauaaaccaaguacgcagccugauugggaaugaagaguacaccgacuacaugccuuccaugaagcgguuuaggcgagaagaggaagaggccggagugcuuugguga

SEQ ID NO: 14867 - RNA, 9876 nt, Artificial Sequence
  derived and/or modified CDS sequence (opt3) from DENV-2__EU482785__SS-prME
accgccggcgugaucauuaugcugauacccacagcuauggcauuccaccucacuacgcguaauggggaaccucauaugaucgucggaaggcaggaaaaggguaaaagccuucuguuuaagaccgaagacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuuggugaacagucuggucacugcuggacacggccagauagauaauuuuagcuuaggugugcucggcauggcacuguuccuugaagagaugcugcgcacacgaguugggaccaaacaugccaucuugcucgugacuguaucguuugucacacugauuaccggaaacauguccuuccgggaccuaggccgugugauggugauggucggggcugccaugacggaugacaucggaaugggcguuacuuaccuggcacuccuggcggccuuuaaggugagaccuaccuucgcugccggucuuuugcugaggaaauuaacaucuaaggagcucaugauggcaaccauugggaucgcucugcuuagccagucaacuauacccgaaacaauccuggagcuaaccgaugcccucgcacugggaaugaugguauugaaaauugugcgcaauauggaaaaguaucaacuggccgucacaaucauggcuauuaguugcgugccaaacgcgguuaucuuacagaaugccuggaagguguccuguacuauacucgcagcugucucugugagcccucugcuucugaccuccucacagcagaaagccgacuggauucccuuggcccucacgaucaagggccugaacccaacagcuaucuuucuaaccacucugagccggaccaguaaaaagagaucuuggccgcuuaaugaggcaauuauggccguuggcaugguguccauacucgcgagcucgcuguugaaaaacgacaucccuaugacagggccccuggucgcuggagguuuacucacuguaugcuacgugcugaccggcaggucagccgaucuugaacuggagcgagcaacggacguuaagugggaggaucaagccgaaauuucugggaguuccccaaucuugagcauuacaaucgcugaggacggaucuaugagcaucaagaaugaagaggaggaacagacccucacuauccugauucgcacaggccuacuggugaucuccggucuuuuccccgucucaauuccuaucaccgcagccgcgugguaucucugggaggugaagaagcagcgggcugggguacugugggaugugccaagucccccuccggucgaaaaagccgaguuggaagacggagcauacagaauaaagcagaaaggcauuuuaggcuauagccaaaucggggccggaguuuacaaggaggguacuuuucacacaauguggcacgugaccaggggcgcugugcugaugcaucgugggaaacgcaucgagccaucuugggccgaugucaagaaggaccucauuuccuacggaggcgguuggaaacuggaaggggaguggaaggaaggagaggaagugcagguucuugcacuggagcccggcaaaaacccucgggcuguacagacgaagccaggcuuguucaaaacuaauaccgggacaaucggagccgugucacuagauuuuagucccgguaccagcggcuccccuauagucgacagaaaggggaaggugguuggacuguauggcaacgguguggucacaaggucuggggcguacgugucggccauugcacagacugagaaaagcaucgaagauaauccggagauugaagacgauaucuuccgaaagaaacggcucaccauaauggaccugcaccccggagcuggcaagacgaaacgcuaucuuccagccauuguaagagaggcuaucaagaggggcuuacggacacugauccucgcaccuacucgagucguggccgccgaaauggaggaggcuuugagagggcugcccauucgcuaccaaaccccagcgaucagggcagaacauacaggacgugagauuguugaccucaugugucacgccaccuucacuaugcggcugcuuucaccugugagaguccccaacuauaaccugauaaucauggaugaagcucauuuuaccgacccagccuccauugcagccagggguuacaucaguacacgcguggagaugggcgaggcugcggggaucuucaugacggccacuccgccuggaucucgagaucccuuuccacagagcaaugcacccauuauggacgaagagagagaaauaccugagcgguccuggaacucaggccacgaauggguuaccgauuucaaggguaaaacagugugguuugucccaucuaucaaggcugggaaugacauugccgcaugcuugaggaaaaacggaaagaaagugauccagcuaagccgcaagaccuucgauagugaguauguaaagacucguacaaaugacugggauuuugugguuaccacggacauuuccgagaugggcgccaacuucaaagcugaaagagucaucgauccccggagguguaugaagccugugauacugacugacggcgaggaacgcgugauccucgccgggccgaugccagucacacacagcucugcggcacaacgaagaggacggauugguaggaaucccaaaaacgagaaugaccaguacaucuacaugggcgaaccuuuagagaacgaugaggacugcgcccauuggaaggaagcuaaaaugcugcuugauaauauuaacacccccgaggggaucauaccaucaauguuugaaccugagcgcgaaaagguagacgccauugauggagaguauagacugaggggcgaggcucggaaaaccuucguggaccucaugcgucgcggugauuugcccguuuggcuggcauaccgaguggccgcugaagggaucaauuaugccgacagaaggugguguuuugauggcgucaagaacaaucagauucucgaggaaaacguggagguugagaucuggacuaaggaaggagagcggaaaaagcugaaaccacgcuggcuugacgcaagaauauacuccgauccucuagcgcugaaggaguucaaagaguucgccgcuggcaggaagaguuugacauuaaaccugaucaccgaaauggggcggcucccgacauuuaugacucagaaggcccgagacgcacuggauaaucuugcugugcugcacacggccgaggcaggagguagagccuauaaccaugcucucagcgaguugcccgaaacccuggagacacuacugcuccuuacucuguuagcgaccgucacaggcgggauuuucuuguuucugaugucgggaaaaggcguggguaagaugacccucgggaugugcugcaucauuacugccucuauccugcuuugguacgcacaaauacagccacacuggauugcugccuccaucauccuggaguucuuucucauuguauugcugaucccugagcccgaaaaacagcgcacgccacaggacaaucaauuaaccuaugugguuauagccauucuaacagucguggcagcuacuauggccaacgagaugggcuuccuggagaagaccaaaaaggaccucggacuuggcagcaucgcgacacaggaaccugagucaaauauucuggauaucgacuugaggcccgcuagugccuggacccuguacgcaguggccacuacauuugucacgccgaugcuccggcacucuauagaaaacuccagcguuaaugugucacugaccgcuaucgcaaaccaggccacuguacuuauggggcucggaaaggguuggccacugaguaaaauggauauuggcgugccuuugcuggcgaucggguguuacagccaggucaaucccauuacauuaaccgcugcccuacugcuccuuguggcacauuaugccaucauuggaccaggccugcaagcuaaggccacccgugaggcacagaaaagagcugccgcggguaucaugaagaaccccacaguugacggggugacugucauagauuuggacccuauuccguacgaucccaaauucgaaaagcagcugggccagguaaugcuccugauccuuugcgugacgcaaguuuuaaugaugaggaccacaugggcccugugugaggcacucacuuuggcuaccggaccaaucuccacacugugggagggcaauccugggcgcuuuuggaacaccacuauugccgugucuauggcaaauauauuccggggaagcuaucuagcuggcgccggucugcucuuuuccaucaugaagaacacgacaaauacccgaagagggacuggaaacauuggcgaaacccuuggugagaaauggaagucaaggcugaaugccuugggcaaaucugaguuccagaucuacaagaaaagugggauucaggaggucgaccgcacacuggcgaaggagggaaucaaacggggcgaaacugaucaccaugcugugucgagagggagcgcaaagcuccguugguuugucgagaggaacauggugacccccgaaggaaagguuguggaccugggcugcggucgcgggggaugguccuauuacuguggcgguuuaaaagauguacgggaggugaagggccuuacaaaagggggaccuggccacgaagaaccaauacccaugucuacguauggguggaaccugguccgacuccaaucaggaguugacguguucuucaccccuccagagaagugcgauacucuacugugugacaucggcgaaagcucccccaauccgacaauugaggccgguagaaccuugaggguccugagucucguggaaaacuggcuuaauaacgacacucaguuuugcaucaaaguacugaauccuuacaugccaucugugauugagaagauggaaacauugcagcggaaguacgggggagcucugguucgcaacccccucagcagaaauucaacccaugagauguauuggguguccaacgccacgggcaauaucgucaguagcgugaacaugauaucuaggauguuaauuaaucgauucaccaugaaacacaagaaagcaacauacgagccugaugucgaccugggcuccgggacucggaacaucggaaucgaaucagagauuccaaaucuugauauaaucgguaagcguauugagaaaauaaagcaggaacacgaaaccagcuggcauuaugaccaagaucaccccuacaagacaugggccuaucauggcucguacgagacuaaacagaccgggucugcuaguuccauggugaacggaguuguaagacugcuaacaaagccgugggacguggucccuauggugacccagauggcgaugacugauacgacacccuuuggccagcaacgcguuuucaaagagaagguggacaccaggacucaggaaccaaaagaggguaccaagaagcucaugaaaauuacagccgaauggcuguggaaggaguuggggaaaaagaaaacgccucggauguguaccagagaggaauuuacucgcaaggucaggagcaaugcagcucugggagccaucuucacagaugagaacaaauggaagucagcacgagaagccguggaggacucccgguuuugggaacucguagauaaggagagaaaccuucaccuggagggcaaaugcgaaaccuguguguauaauaugaugggcaagagggagaaaaaguuaggggaguucggaaaagcuaaggguucucgcgccauaugguacauguggcugggcgcgagauuuuuggaguucgaagcacucggguuucugaacgaggaccacugguucagccgggagaauagucuauccggaguugaaggcgagggucuucauaagcugggguacauccucagagacgucagcaaaaaggaaggaggcgccauguaugcugaugacacugccggcugggauacaaggauuacccuggaggacuugaaaaacgaagagauggugacaaaucacauggagggggaacauaagaaacuggcagaggcuaucuuuaagcucacuuaccagaacaaggugguccgcguucagcgacccaccccacggggaacggugauggauauuaucucuagaagggaccaacgcgguucaggccagguagggaccuauggacuuaauacauucacuaacauggaagcccagcugauuagacaaauggagggcgaggguguguucaaaaguauacagcgguuaaccgucacagaagagaucgcugugcagaauuggcuggccaggguugggcgugaacgauugucccgcauggcaauuagcggagaugacugcguggucaagccccucgaugacagauuugcgucugcccugacugcucuaaacgauaugggcaaagugcggaaggacauccagcaaugggagccuucgaggggcuggaaugauuggacccagguaccauucugcucacaccauuuucacgaacuuaucaugaaagacgggcgcguucugguggucccguguagaaaccaggacgagcucauuggacgggccaggauaagccagggugcaggcuggucccugaaggagacggcuugcuuggggaagaguuacgcccaaauguggucuuuaauguauuuccaccgacgugaucugagacucgcagccaaugcgaucuguagcgcugugcccucccauugggugccuacaucacgcaccacuuggaguauucacgccaaacaugaauggaugacaaccgaggacaugcuuacugucuggaaccggguuuggauccaggaaaauccauggauggaggauaagacccccguggaaucuugggaggagguaccuuaccugggaaaaagggaagaccaguggugcggcagccuaauuggucugacauccagagcaacgugggccaagaacauccagaccgcuauaaaccaagugcgcucacucaucgggaaugaggaauauacugauuacaugccaagcaugaaacgguuuaggcgagaggaagaggaggccggagucuugugguga

SEQ ID NO: 14868 - RNA, 9876 nt, Artificial Sequence
  derived and/or modified CDS sequence (opt3) from DENV-2__EU482786__SS-prME
agcgcaggcaugaucauuaugcugauccccaccgugauggcuuuccaccucacuacuagaaacggggagccucauaugaucgucgguauucaagaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccggcaaggauagcccuguuaacaucgaggcugaacccccauuuggagacucguacauuaucaucggcguggagccugggcaguuaaagcugaauugguucaaaaagggaucuuccauuggucaaauguuugagacgaccaugcggggcgccaaacgaauggcuauacuaggggauacagccugggacuucggaucacucggcgguguauuuacaaguaucgggaaggcacugcaucaggucuucggcgccauuuauggagcugcguuuagcggcguguccuggaccaugaaaauccuuauugggguuaucauaacauggaucggaaugaacucucgcagcacuucauugagugugucccugguccucgugggcauuguaacccuguaccuuggugugaugguucaggcagauagcgggugugucgugucuuggaagaauaaggaacugaaaugcggaucaggcaucuucauuacggacaacgugcacacauggaccgagcaguauaaguuucaacccgaaaguccaagcaaauuggccuccgcuauccagaaggcccaggaggaagguauauguggcauuagaucugucacuaggcucgagaaucugauguggaaacagaucacacccgaguuaaaccacauucuggcagaaaaugagguuaagcuaaccaucaugacuggggauauaaaaggaaucaugcaagccggcaagcggucgcuccgcccucagccaaccgaacugaaguacagcuggaaaacaugggggaaggcuaaaaugcuuuccacggagucauauaaccagaccuucuugauugacggaccggaaacugccgagugccccaauacaaacagagcauggaauagucuggagguggaagauuacggcuuugguguguucaccacaaacaucuggcucaagcugaaagagaagcaggacgcguuuugugacucuaaguuaaugagcgcugccauuaaagauaauagggcaguacaugccgacaugggguauuggaucgaauccgcucugaacgauacuuggaagauagagaaagccucauucauugaggucaagaauugccacuggccuaaaagccauacccuuuggucuaacggaguguuggaauccgagaugaucaucccaaagaaccucgcaggccccguuagucaacacaauuaccguccugguuaccacacgcagauugcuggcccauggcaucuggggaagcuagaaauggacuucgauuuuugugacggaacaaccgugaucgucacugaggauugcggcaaccgggggcccagccugcgaaccacaacugccucuggaaaacucauuaccgaauggugcuguagauccugcacacugccgccucuuagguaucgcggcgaggacgguuguugguacgggauggagauacggccauugaaggaaaaagaggaaaaucuggugaacucauuaguuacggcgggacacggccagguggauaauuucagucucgguguacugggcauggcccuuuuucuggaggaaauguugagaaccagggucgggacuaagcaugcuauccuccugguggcagugagcuucgucacacuaauuaccggaaacaugucguuuaaagaccugggccgcguugugguaauggugggggccacuauggcugaugacaucggaaugggcgucacauaucucgcccugcuugcagcguucaaggugcgacccaccuuugccgcugguuugcuguuacggaagcucacguccaaagagcugaugaugacuaccauugggaucguucuucugucucaaagcacaauaccugagaccgugcuagaacucacugaugcccuggcauugggaaugaugguccugaagaucgugcguaauauggagaaauaccaguuagcuguuacaauuauggccauccucugcgugcccaacgcagucguacugcagaaugccuggaaggugucauguaccauucuugcuguugugagugucuccccacuguugcucacaucuagccagcagaagacugacuggaucccucuggcgcuaaccauaaagggccugaaccccacggccauuuuccuuacaacccucuccagaacuaauaaaaagaggucauggccacugaacgaagcaaucauggcugugggcaugguaagcaucuuggccaguucucuguuaaagaaugacauuccgaugaccgggccucucguggccggaggucugcuuacagucugcuauguucugacuggccgcuccgcugauuuggagcucgaacgggcaaccgacgugaaaugggaggaucaggccgagauaagcgggucgucacccauccugucuauuacgaucagugaagacggauccaugagcauuaagaacgaggaagaggagcagacacuaaccauccugauaagaacuggccuucucgugaucucuggucuguuuccaauuagcauccccauuacagcggcugccugguacuugugggaagucaaaaagcagagggcagggguguuaugggauguuccuuccccacccccuaugggaaaagccgagcuggaagacggcgcuuaucgaaucaagcaaaagggcauacucggguacucacagauuggagcaggaguauacaaagagggcaccuuccacacuauguggcaugugacacgcggggccguccugaugcacaagggaaaacggaucgaaccgaguugggcggaugugaagaaagaccuuaucagcuauggcgguggguggaagcuggagggagaguggaaggaaggcgaggaaguucagguguuggcucuagagccaggcaaaaaucccagagccguccagaccaagccugggcuguuuaaaacgaacacuggaaccauuggugcagugucucucgauuucuccccaggcacaucagggagucccaucauagacaagaaaggaaagguagucggccuguacgguaacggggugguuaccaggagcggagccuauguguccgcuauugcccaaacagaaaagucuaucgaggauaauccugagauugaagacgauaucuuucguaaacgccggcuuacuauaauggacuuacacccgggcgcaggcaagaccaaaagauaccugcccgcuauugucagggaggccaucaagcgagggcuccggacguugauccuggcgccaacacgcgugguugccgcagaaauggaggaagcucucagaggacugccuauuagguaucagacucccgccaucaaagcugagcauaccggucgggagauuguggaccuuaugugucacgcaacauucaccaugcgacuguugucgccagucagagugccuaacuacaaucuaauaaucauggaugaagcccauuucacugaccccgccagcauugcugcgcgcggcuauaucucaaccaggguagagaugggggaagcagccggaaucuuuaugacagcuacgccaccgggcucccgugauccuuucccccagaguaacgccccaauuauagacgaggagcgggaaauccccgagagaucuuggaauagcggucacgaaugggugacugauuuuaaggggaagaccguuugguucgucccuuccauuaaagcaggaaacgacaucgccgcuugccugaggaagaauggcaaaaaggugauucaacucucacgcaaaacauuugauucugaguacgugaagacccgaacuaacgacugggauuucgucguaacaaccgacaucagcgaaaugggcgcgaauuuuaaagccgagagagugauagauccacggagguguaugaagcccguuaucuuaacggacggggaggaacgcgugauucuggcaggaccuaugccggucacucauaguuccgcugcccagcguagaggucggaucggcaggaacccaaagaaugagaacgaccaguacauuuauaugggggaaccccuugagaaugauggagacugcgcacacuggaaagaagccaagaugcugcucgauaacaucaauacaccugagggcauaauucccagcauguucgagccagaacgcgagaaaguggacgcuaucgauggugaauaccgauugagaggggaggcccggaagaccuuuguugaccugaugaggcgcggcgaucucccuguguggcuggcguauaaagucgcagccgaaggaauuaacuacgcugacagaaggugguguuucgauggcaucaagaacaaucagauacuugaggagaacguggaaguagagaucuggaccaaggaaggggagcggaaaaagcuaaaaccccguuggcuggacgcccgcauuuauucugauccauuggcuuuaaaggaguuuaaagaguucgcagccggacgaaagucacugacucucaaucugaucacagagauggguagacuuccuaccuucaugacacaaaagacuagggacgcucuggauaaccucgccguguugcacacggcagaagcgggcgggcgggccuacaaucaugcucuguccgagcuaccggaaacccuggagacacuccuucuguuaacuuugcuggccaccguuacaggaggcauuuuucucuuccugaugaguggucgcgggaucggcaaaaugacccuuggaaugugcugcauaauuacugcaagcauccugcucugguaugcucagauccagccccacuggauugccgcaucgaucauauuggaguuuuuccugauugucuuacuaaucccagaaccugagaagcagagaacgccccaagacaaccagcugaccuacguggugauugccauccucacagucguugcugcgacuauggccaaugaaaugggcuuucuugagaaaaccaagaaagaccugggguugggaucuauagcaacacagcagccagaauccaacauccuggauauugaccucaggccugcuagcgccuggacccuguacgccguggcaacuacauucguaacgcccaugcuucggcauucaaucgagaauaguucugugaacgucucccucaccgcuauugccaaucaagcgacugugcugauggguuugggcaagggguggccgcugagcaagauggauaucggaguuccauuacuagcuauuggcuguuauucacaggugaacccuaucacacugaccgccgcacuccuucuguuggucgcccacuacgcuauaauuggucccgggcugcaggcaaaagccacccgagaggcgcagaagagagcugccgcaggcaucaugaaaaauccaacaguagacggaaucacugugauugaucucgaccccauaccuuaugauccgaaguuugaaaaacaacugggccagguuaugcuuuuaauccugugcgugacgcagguccucaugaugcgcaccacaugggccuugugugaggcucugacucuagccaccgggcccauuaguacacugugggaaggaaacccaggcagguucuggaauaccacuaucgcagugagcauggcuaacauuuuucgggguuccuaccucgccggggcgggacuucuguucucuaucaugaagaauacgacaaacacccguagaggcacugguaacauaggcgagaccuugggggaaaaauggaaaagcaggcugaaugcccucggaaaguccgaguuucaaaucuauaaaaagucaggcauucaggaggucgaccgcacacuggcaaaagaagggaucaagcggggagagacugaucaccaugcugugucucgaggcagugccaaauuaagaugguucguugaaaggaacauggugaccccugaggguaagguaguggaccuugggugcggacgcggcgguuggucguacuauuguggcgggcugaagaauguccgggagguuaaaggacucacaaagggcgggcccggacacgaagaaccuauuccaaugagcacguacggcuggaaccuagugagacugcaguccggugucgauguguuuuucauacccccugaaaaaugcgacaccuugcugugugauauaggggagucuucaccaaaucccacuguagaagcaggacguacacucagggugcuuaaccugguugagaauugguugaacaauaacacccaguucugcauuaaggugcugaauccguacaugccuagcgucaucgagaaaauggaagcucuccaacggaaguauggcggcgccuuagugcgcaacccacugucccgaaauaguacucaugagauguacugggucucuaacgccagcgggaauaucgugucauccguuaacaugauuaguagaaugcuuauaaacagguuuacaaugcggcacaagaaagcgaccuaugaacccgacguagaccugggaagcgguacgcgcaauaucggcauugagucugaaaucccuaaccuagauauuaucgggaagagaauagagaaaaucaagcaggagcaugaaaccuccuggcacuacgaccaggaucacccauauaaaacaugggcuuaccauggaucauaugagacuaagcagaccggcagcgcaucgucuauggugaauggugucgugaggcuccugacaaagcccugggacguuuugccgacugugacccaaauggccaugacagauaccacuccuuucgggcagcagcgagucuuuaaagaaaagguggacacgcggacacaggagcccaaagaaggaaccaagaaacugaugaagauuacugcuaaauggcucuggaaggagcuuggcaagaaaaagaccccacguauguguacaagagaggaguucacgcgcaaaguaaggaguaacgccgcacugggcgccaucuuuaccgaugagaauaaguggaaauccgcucgggaagcgguggaggacagcagauucugggaguuaguugauaaggaacgcaaccugcacuuggaggggaagugcgaaacuugugucuacaauaugaugggaaaaagggagaagaaacucggugaauuuggcaaggccaaagggucacgagcaauuugguacauguggcugggagcucgguuccuagaguuugaggcccuuggcuuccugaacgaagaccauugguuuuccagagaaaauucucucagcgguguggaaggggagggacugcacaaguugggcuauauccugagggaugugaguaagaaagaaggcggggcaauguacgccgacgacacagcuggaugggauacccgcauuacucucgaggaccuuaagaacgaggaaauggucacaaaucacauggagggugaacauaaaaagcuggccgaggcgauauucaaauuaaccuaucaaaacaagguugugcguguacagcggccuacacccagaggcacugugauggauaucauuuccaggcgcgaccagcgagggagcggacaagucggcaccuacggucugaauacguuuaccaacauggaagcacaguugauccggcagauggagggggagggaguguucaagaauauccagcaccucacaguuacugaagagguggccguccaaaacuggcuggcuagagugggcagggaacgccuaucuagaauggccauuucaggcgaugacugcguaguuaaaccacuugaugaccgguucgcaaacgcucugaccgcccucaaugauauggggaagauaaggaaagacauccagcagugggagcccaguaagggauggaacgauuggacacaggugccuuuuugcucccaucacuuccaugagcugauuaugaaagacggucgugucuugguggugccaugucgaaaucaagaugaauuaaucggccgcgcuagaauuagccagggggccggauggucucugcgggagacugcaugccucggcaagucguaugcgcagauguggucacuuauguacuuucacaggcgcgaccugagacuagccgcuaacgccaucuguagcgcagucccgucccacuggguucccaccagucggacgacauggucuauacaugcuaagcacgaauggaugaccacugaggacaugcugacaguguggaauaggguauggauccgagaaaacccuuggauggaggauaaaaccccaguggagagcugggaagagauucccuaucucgguaagcgugaagaccaguggugcggguccuugaucggacugacuucaagagccaccugggccaaaaauauucaagccgcgaucaaccagguccgcagucuuauaggcaaugaggaauacacagauuacaugccuucuaugaagcgguucaggagagaggaggaagaggcuggcgugcugugguga

SEQ ID NO: 14869 - RNA, 9876 nt, Artificial Sequence
  derived and/or modified CDS sequence (opt3) from DENV-2__EU482787__SS-prME
accgccggagugauaauuaugcugauacccacagcuauggcauuccaccucacuacgaggaauggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaaugaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugcguugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagaacaggacaaacgauuugugugcaagcauucuauggucgauaggggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuuggugaacagucuggucacugcuggacacggccagauagauaauuuuagcuuaggugugcucggcauggcacuguuccuugaagagaugcugcgcacacgaguugggaccaaacaugccaucuugcucgugacuguaucguuugucacacugauuaccggaaacauguccuuccgggaccuaggccgugugauggugauggucggggcugccaugacggaugacaucggaaugggcguuacuuaccuggcacuccuggcggccuuuaaggugagaccuaccuucgcugccggucuuuugcugaggaaauuaacaucuaaggagcucaugauggcaaccauugggaucgcucugcuuagccagucaacuauacccgaaacaauccuggagcuaaccgaugcccucgcacugggaaugaugguauugaaaauugugcgcaauauggaaaaguaucaacuggccgucacaaucauggcuauuaguugcgugccaaacgcgguuaucuuacagaaugccuggaagguguccuguacuauacucgcagcugucucugugagcccucugcuucugaccuccucacagcagaaagccgacuggauucccuuggcccucacgaucaagggccugaacccaacagcuaucuuucuaaccacucugagccggaccaguaaaaagagaucuuggccgcuuaaugaggcaauuauggccguuggcaugguguccauacucgcgagcucgcuguugaaaaacgacaucccuaugacagggccccuggucgcuggagguuuacucacuguaugcuacgugcugaccggcaggucagccgaucuugaacuggagcgagcaacggacguuaagugggaggaucaagccgaaauuucugggaguuccccaaucuugagcauuacaaucgcugaggacggaucuaugagcaucaagaaugaagaggaggaacagacccucacuauccugauucgcacaggccuacuggugaucuccggucuuuuccccgucucaauuccuaucaccgcagccgcgugguaucucugggaggugaagaagcagcgggcugggguacugugggaugugccaagucccccuccggucggaaaagccgaauuggaggacggcgcauacagaauaaagcagaaaggcauuuuaggguauagccaaaucggagccgguguuuacaaggaaggcacuuuucacacaauguggcacgugaccagaggggcugugcugaugcaucguggaaaacgcaucgagccaucuugggccgaugucaagaaggaccucauuuccuacggcgguggguggaaacuggagggagaauggaaggagggcgaagaggugcagguucuugcacuggaacccggcaaaaacccucgggcuguacagacgaagccaggguuguucaaaacuucaaccggaacaaucggugccgugagucuagauuuuagccccggcaccuccgggucuccuauagucgacagaaagggaaaggugguuggccuguaugguaaugggguggucacaaggucgggagcguacgugagcgccauugcacagacugagaaaucaaucgaggauaacccggaaauugaggacgauaucuuccgaaagaaacggcucaccauaauggaccugcaccccggcgcuggcaagacgaaacgcuaucuuccagccauuguaagagaagcuaucaagaggggguuacggacacugauccucgcaccuacucgagucguggccgccgagauggaagaggcuuugagaggacugcccauucgcuaccaaaccccagcgaucagggcagagcauacaggucgugaaauuguugaccucaugugucacgccaccuucacuaugcggcugcuuuccccugugagaguccccaauuauaaccugauaaucauggaugaggcucauuuuaccgacccagccaguauugcagccaggggcuacaucucuacacgcguggaaaugggggaggcugcgggaaucuucaugacggccacuccgccuggcagccgagaucccuuuccacaguccaacgcacccauuauggacgaggaaagagagauaccugaacggucauggaacucuggucacgaguggguuaccgauuucaaggggaaaacagugugguuugucccaagcaucaaggcuggaaacgacauugccgcaugcuugaggaaaaauggcaagaaagugauccagcuaagucgcaagaccuucgauuccgaauauguaaagacucguacaaacgacugggauuuugugguuaccacggacauuagcgagaugggcgccaauuucaaagcugagagagucaucgauccccggagguguaugaagccugugauacugacugacggggaagaacgcgugauccucgccggaccgaugccagucacacacucuucagcggcacaacgaagaggucggauuggcaggaaccccaaaaaugaaaacgaccaguacaucuacaugggggagccuuuagaaaaugaugaggacugcgcccauuggaaggaggcuaaaaugcugcuugauaacauuaauacccccgaaggaaucauaccauccauguuugagccugaacgcgagaagguagacgccauugauggcgaauauagacugaggggugaggcucggaaaaccuucguggaccucaugcgucgcggggauuugcccguuuggcuggcauaccgaguggccgcugagggcaucaacuaugccgacagaaggugguguuuugauggagucaagaauaaccagauucucgaagagaauguggaaguugagaucuggacuaaggagggcgaacggaaaaagcugaaaccacgcuggcuugacgcaagaauauacagugauccucuagcgcugaaggaguucaaagaguucgccgcugggagaaagagcuugacauuaaaccugaucaccgagaugggacggcucccgacauuuaugacucagaaggcccgagacgcacuggauaaccuugcugugcugcacacggccgaagcaggagguagagccuauaaucaugcucucucggaguugcccgagacccuggaaacacuacugcuccuuacucuguuagcgaccgucacagggggaauuuucuuguuucugaugucuggcaaagguguggggaagaugacccucggcaugugcugcaucauuacugccuccauccugcuuugguacgcacaaauacagccacacuggauugcugccagcaucauccuggaguucuuucucauuguauugcugaucccugaacccgagaaacagcgcacgccacaggacaaccaauuaaccuaugugguuauagccauucuaacagucguggcagcuacuauggccaaugaaaugggauuccuggagaagaccaaaaaggaccucggccuugggucaaucgcgacacaggagccugaaaguaacauucuggauaucgacuugaggcccgcuucugccuggacccuguacgcaguggccacuacauuugucacgccgaugcuccggcacuccauagagaauagcucaguuaacgugagucugaccgcuaucgcaaaucaggccacuguacuuaugggacucgguaagggcuggccacugagcaaaauggauauuggggugccuuugcuggcgaucggauguuacucccaggucaaccccauuacauuaaccgcugcccuacugcuccuuguggcacauuaugccaucauuggcccaggucugcaagcuaaggccacccgugaagcacagaaaagagcugccgcggggaucaugaagaaucccacaguugacggcgugacugucauagauuuggacccuauuccguacgaucccaaauucgagaagcagcugggacagguaaugcuccugauccuuugcgugacgcaaguuuuaaugaugaggaccacaugggcccugugugaagcacucacuuuggcuaccggcccaaucucuacacugugggaggggaacccuggacgcuuuuggaauaccacuauugccgugagcauggcaaacauauuccggggcuccuaucuagcuggugccgggcugcucuuuucaaucaugaagaauacgacaaacacccgaagaggaacuggcaauauuggugagacccuuggcgaaaaauggaagucuaggcugaacgccuuggggaaaagugaguuccagaucuacaagaaaucgggcauucaggaagucgaccgcacacuggcgaaggagggcaucaaaagaggggaaacugaucaccaugcugugagcagaggauccgcaaagcuccguugguuugucgaaaggaauauggugacccccgagggcaagguuguggaccuggguugcgggcggggaggcuggucuuauuacugugguggcuuaaaagauguacgcgaagugaaggggcuuacaaaaggaggcccugggcacgaggaaccaauacccaugucaacguauggauggaaccugguccgacuccaaagcggcguugacguguucuucaccccuccagagaagugcgauacucuacugugugacaucggugaguccagucccaacccgacaauugaagccgggagaaccuugaggguccugucucucguggagaauuggcuuaacaaugacacucaguuuugcaucaaaguacugaacccuuacaugccaagcgugauugaaaagauggagacauugcagcggaaguacggaggcgcucugguucgcaauccccucucaagaaacuccacccaugaaauguauugggugaguaaugccacgggcaacaucgucagcucugugaauaugauauccaggauguuaauuaaccgauucaccaugaaacacaagaaagcaacauacgagccugaugucgaccuggggucaggaacucggaauaucgguaucgagagcgaaauuccaaaccuugauauaaucggcaagcguauugagaaaaucaagcaggaacacgagaccucguggcauuaugaccaagaucaccccuacaagacaugggccuaucaugggucuuacgaaacuaaacagaccggaagugcuuccagcauggugaauggcguuguaagacugcuaacaaagccgugggacguggucccuauggugacccagauggcgaugacugauacgacacccuuuggucagcaacgcguuuucaaagagaagguggacaccaggacucaggagccaaaagaagggaccaagaagcucaugaaaauuacagccgaguggcuguggaaggaauugggcaaaaagaaaacgccucggauguguaccagagaggaguuuacucgcaaggucaggucaaacgcagcucugggcgccaucuucacagaugaaaauaaauggaaguccgcacgagaggccguggaagacucucgguuuugggagcucguagauaaggaaagaaaccuucaccuggagggcaaaugcgagaccuguguguauaacaugauggggaagagggagaaaaaguuaggagaguucgguaaagcuaagggcagccgcgccauaugguacauguggcugggggcgagauuuuuggaguucgaggcacucggauuucugaaugaagaccacugguucagucgggagaacucccuaagcggcguugagggugaagggcuucauaagcugggauacauccucagagacgucucuaaaaaggagggcggcgccauguaugcugaugacacugccgggugggauacaaggauuacccuggaagacuugaaaaaugaggaaauggugacaaaccacauggagggagagcauaagaaacuggcagaagcuaucuuuaagcucacuuaccagaauaaggugguccgcguucagcgacccaccccacgggguacggugauggauauuaucucaagaagggaccaacgcggcagugggcagguaggaaccuauggccuuaacacauucacuaauauggaggcccagcugauuagacaaauggaaggugaggggguguucaaauccauacagcgguuaaccgucacagaggaaaucgcugugcagaacuggcuggccaggguuggacgugagcgauugagccgcauggcaauuucuggcgaugacugcguggucaagccccucgaugacagauuugcgucggcccugacugcucuaaaugauaugggcaaagugcggaaggacauccagcaaugggaaccuucaaggggguggaacgauuggacccagguaccauucugcagccaccauuuucacgagcuuaucaugaaagacggacgcguucugguggucccguguagaaaucaggacgaacucauuggucgggccaggauaucccagggcgcaggguggagucugaaggagacggcuugcuugggaaagucuuacgcccaaauguggagcuuaauguauuuccaccgacgugaucugagacucgcagccaacgcgaucuguuccgcugugcccucacauugggugccuacaagucgcaccacuuggucuauucacgccaaacaugaguggaugacaaccgaagacaugcuuacugucuggaaucggguuuggauccaggagaacccauggauggaagauaagacccccguggagagcugggaagagguaccuuaccugggcaaaagggaggaccaguggugcgguucccuaauugggcugacaucaagagcaacgugggccaagaauauccagaccgcuauaaaccaagugcgcagccucaucggaaacgaagaguauacugauuacaugccaucuaugaaacgguuuaggcgagaagaggaagaggccggcgucuugugguga

SEQ ID NO: 14870 - RNA, 9876 nt, Artificial Sequence
  derived and/or modified CDS sequence (opt3) from DENV-2__EU482788__SS-prME
accgccggcgugauaauuaugcugauacccacagcuauggcauuccaccucacuacgaggaauggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugcguugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaggaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuuggugaacagucuggucacugcuggacacggccagauagauaauuuuagcuuaggugugcucggcauggcacuguuccuugaagagaugcugcgcacacgaguugggaccaaacaugccaucuugcucgugacuguaucguuugucacacugauuaccggaaacauguccuuccgggaccuaggccgugugauggugauggucggggcugccaugacggaugacaucggaaugggcguuacuuaccuggcacuccuggcggccuuuaaggugagaccuaccuucgcugccggucuuuugcugaggaaauuaacaucuaaggagcucaugauggcaaccauugggaucgcucugcuuagccagucaacuauacccgaaacaauccuggagcuaaccgaugcccucgcacugggaaugaugguauugaaaauugugcgcaauauggaaaaguaucaacuggccgucacaaucauggcuauuaguugcgugccaaacgcgguuaucuuacagaaugccuggaagguguccuguacuauacucgcagcugucucugugagcccucugcuucugaccuccucacagcagaaagccgacuggauucccuuggcccucacgaucaagggccugaacccaacagcuaucuuucuaaccacucugagccggaccaguaaaaagagaucuuggccgcuuaaugaggcaauuauggccguuggcaugguguccauacucgcgagcucgcuguugaaaaacgacaucccuaugacagggccccuggucgcuggagguuuacucacuguaugcuacgugcugaccggcaggucagccgaucuugaacuggagcgagcaacggacguuaagugggaggaucaagccgaaauuucugggaguuccccaaucuugagcauuacaaucgcugaggacggaucuaugagcaucaagaaugaagaggaggaacagacccucacuauccugauucgcacaggccuacuggugaucuccggucuuuuccccgucucaauuccuaucaccgcagccgcgugguaucucugggaggugaagaagcagcgggcugggguacugugggaugugccaagucccccuccggucggaaaagccgaauuggaggacggcgcauacagaauaaagcagaaaggcauuuuaggguauagccaaaucggagccgguguuuacaaggaaggcacuuuucacacaauguggcacgugaccagaggggcugugcugaugcaucguggaaaacgcaucgagccaucuugggccgaugucaagaaggaccucauuuccuacggcgguggguggaaacuggagggagaauggaaggagggcgaagaggugcagguucuugcacuggaacccggcaaaaacccucgggcuguacagacgaagccaggguuguucaaaacuaauaccggaacaaucggugccgugucacuagauuuuagucccggcaccagcggguccccuauagucgacagaaagggaaaggugguuggccuguaugguaacgggguggucacaaggucuggagcguacgugucggccauugcacagacugagaaaagcaucgaggauaauccggaaauugaggacgauaucuuccgaaagaaacggcucaccauaauggaccugcaccccggcgcuggcaagacgaaacgcuaucuuccagccauuguaagagaagcuaucaagaggggguuacggacacugauccucgcaccuacucgagucguggccgccgagauggaagaggcuuugagaggacugcccauucgcuaccaaaccccagcgaucagggcagagcauacaggucgugaaauuguugaccucaugugucacgccaccuucacuaugcggcugcuuucaccugugagaguccccaacuauaaccugauaaucauggaugaggcucauuuuaccgacccagccuccauugcagccaggggcuacaucaguacacgcguggaaaugggggaggcugcgggaaucuucaugacggccacuccgccuggcucucgagaucccuuuccacagagcaaugcacccauuauggacgaggaaagagagauaccugaacgguccuggaacucaggucacgaguggguuaccgauuucaaggggaaaacagugugguuugucccaucuaucaaggcuggaaaugacauugccgcaugcuugaggaaaaacggcaagaaagugauccagcuaagccgcaagaccuucgauagugaauauguaaagacucguacaaaugacugggauuuugugguuaccacggacauuuccgagaugggcgccaacuucaaagcugagagagucaucgauccccggagguguaugaagccugugauacugacugacggggaagaacgcgugauccucgccggaccgaugccagucacacacagcucugcggcacaacgaagaggucggauuggcaggaaucccaaaaacgaaaaugaccaguacaucuacaugggggagccuuuagaaaacgaugaggacugcgcccauuggaaggaggcuaaaaugcugcuugauaauauuaacacccccgaaggaaucauaccaucaauguuugagccugaacgcgagaagguagacgccauugauggcgaauauagacugaggggugaggcucggaaaaccuucguggaccucaugcgucgcggggauuugcccguuuggcuggcauaccgaguggccgcugagggcaucaauuaugccgacagaaggugguguuuugauggagucaagaacaaucagauucucgaagagaacguggaaguugagaucuggacuaaggagggcgaacggaaaaagcugaaaccacgcuggcuugacgcaagaauauacuccgauccucuagcgcugaaggaguucaaagaguucgccgcugggaggaagaguuugacauuaaaccugaucaccgagaugggacggcucccgacauuuaugacucagaaggcccgaaaugcacuggacaaccuugcugugcugcacacggccgaagcaggagguagagccuauaaucaugcucucagcgaguugcccgagacccuggaaacacuacugcuccuuacucuguuagcgaccgucacagggggaauuuucuuguuucugaugucgggcaaagguguggggaagaugacccucggcaugugcugcaucauuacugccucuauccugcuuugguacgcacaaauacagccacacuggauugcugccuccaucauccuggaguucuuucucauuguauugcugaucccugaacccgagaaacagcgcacgccacaggauaaccaauuaaccuaugugguuauagccauucuaacagucguggcagcuacuauggccaaugaaaugggauuccuggagaagaccaaaaaggaccucggccuugggagcaucgcgacacaggagccugaaucaaacauucuggacaucgauuugaggcccgcuagugccuggacccuguacgcaguggccacuacauuugucacgccgaugcuccggcacucuauagaaaauuccagcguuaacgugucacugaccgcuaucgcaaaucaggccacuguacuuaugggacucgguaagggcuggccacugaguaaaauggacauuggggugccuuugcuggcgaucggauguuacagccaggucaaccccauuacauuaaccgcugcccuacugcuccuuguggcacauuaugccaucauuggcccaggucugcaagcuaaggccacccgugaagcacagaaaagagcugccgcggggaucaugaagaaucccacaguugauggcauaacugugauugacuuggauccuaucccguacgaccccaaauucgagaagcagcugggacaggucaugcuccugauccuuugcguaacgcaaguguuaaugaugaggaccacaugggcccugugugaagcacucacuuuggcuaccggcccaauuuccacacugugggaggggaacccuggacgcuuuuggaauaccacuauagccguuucuauggcaaacaucuuccggggcagcuaucuagcuggugccgggcugcucuuuuccauuaugaagaauacgacaaacacccgaagaggaacuggcaauaucggugagacccuuggcgaaaaauggaagucaaggcugaacgccuuggggaaaucugaguuccagauuuacaagaaaaguggaauccaggaaguggaucgcacacuggcgaaggagggcauaaaaagaggggaaacugaccaccaugcugucucgagaggaagcgcaaagcuccguugguuuguggaaaggaacauggucacccccgagggcaaggugguugaucuggguugcgggcggggaggcugguccuauuacugugguggcuuaaaagacgugcgcgaaguaaaggggcuuacaaaaggaggcccugggcacgaggaaccaauccccaugucuacguauggauggaaucuggugcgacuccaaucaggcgucgauguuuucuucaccccuccagagaagugcgacacucuacugugugauauuggugagagcucccccaacccgacaaucgaagccgggagaaccuugagggugcugagucucgucgagaauuggcuuaacaaugacacucaguuuugcauuaaagugcugaacccuuacaugccaucuguaaucgaaaagauggagacauugcagcggaaguacggaggcgcucuggugcgcaauccccucagcagaaacucaacccaugaaauguauuggguuuccaaugccacgggcaacauagugaguagcgucaauaugauuucuaggauguuaaucaaccgauucaccaugaaacacaagaaagcaacauacgagccugacguggaucugggguccggaacucggaauaucgguauugagucagaaauaccaaaccuugacaucauuggcaagcguaucgagaaaauuaagcaggaacacgagaccagcuggcauuaugaucaagaccaccccuacaagacaugggccuaucaugggucguacgaaacuaaacagaccggaucugcuaguuccauggucaauggcgugguuagacugcuaacaaagccgugggauguagugccuauggucacccagauggcgaugacugacacgacacccuuuggucagcaacgcguguucaaagagaagguugauaccaggacucaggagccaaaagaagggaccaagaagcucaugaaaaucacagccgaguggcuguggaaggaauugggcaaaaagaaaacgccucggauguguaccagagaggaguuuacucgcaaggugaggagcaacgcagcucugggcgccauauucacagacgaaaacaaauggaagucagcacgagaggccgucgaagauucccgguuuugggagcucguggacaaggaaagaaaucuucaccuggagggcaaaugcgagaccuguguauauaacaugauggggaagagggagaaaaaguuaggagaguucgguaaagcuaagggcucucgcgccaucugguacauguggcugggggcgagauuuuuggaguucgaggcacucggauuucugaaugaagaucacugguucagccgggagaacagucuauccggcguggagggugaagggcuucauaagcugggauacauucucagagacguuagcaaaaaggagggcggcgccauguaugcugacgauacugccgggugggacacaaggaucacccuggaagauuugaaaaaugaggaaauggucacaaaccacauggagggagagcauaagaaacuggcagaagcuauuuuuaagcucacuuaccagaauaagguggugcgcguccagcgacccaccccacgggguacgguuauggacaucauuucuagaagggaucaacgcggcucaggacaggugggaaccuauggccuuaacacauucacuaauauggaggcccagcugauaagacaaauggaaggugaggggguauucaaaaguauccagcgguuaaccgugacagaggaaauugcuguccagaacuggcuggccagggugggacgugagcgauugucccgcauggcaaucagcggcgacgauugcguugugaagccccucgacgauagauuugcgucugcccugacugcucuaaaugacaugggcaaaguccggaaggauauccagcaaugggaaccuucgaggggguggaacgacuggacccaggugccauucugcucacaccauuuucacgagcuuauuaugaaagauggacgcguacugguugugccguguagaaaucaggacgaacucauaggucgggccaggaucagccagggcgcaggguggucccugaaggagacggcuugcuugggaaagaguuacgcccaaauguggucuuuaauguauuuccaccgacgugaccugagacucgcagccaacgcgauuuguagcgcuguccccucccauugggugccuacaucacgcaccacuuggaguauccacgccaaacaugaguggaugacaaccgaagauaugcuuacuguguggaaucgggucuggauucaggagaacccauggauggaagacaagacccccguugagucuugggaagaggugccuuaccugggcaaaagggaggaucaguggugcgguagccuaaucgggcugacauccagagcaacgugggccaagaacauacagaccgcuaucaaucaaguacgcucacucauuggaaacgaagaguauacugacuacaugccaagcaugaaacgguuuaggcgagaagaggaagaggccggcguguugugguga

SEQ ID NO: 14871 - RNA, 9876 nt, Artificial Sequence
  derived and/or modified CDS sequence (opt3) from DENV-2__EU482697__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuaugacagaugacaucgggaugggagucaccuaucucgcucugcuugccgcauucaaagugcgacccacguuugcggccggcuugcuguuacggaagcucacuuccaaggagcugaugaugaccacaauugguaucguucuucugucucagagcaccauaccugaaacugugcuagagcucacagaugcucuggccuuggggaugaugguccugaaaaucgugcguaauauggaaaaguaccaguuagcaguuaccauuauggcuauccucugcgugcccaacgccgucauucugcagaaugcauggaaaguaucauguacaauccuugccgugguuaguguguccccacuguugcucacuucuagccaacagaagaccgacuggauaccucuggcucuaacgauuaaaggacugaaccccacagcgaucuuccuuaccacucucuccagaaccaauaagaaaaggucauggccacugaacgaggccaucauggcagucggcauggugagcauuuuggcuaguucucuguuaaagaaugacauaccgaugacaggcccucucguagccgggggacugcuuacugugugcuauguccugaccggucgcuccgccgauuuggaacucgagcgggcuacggacguuaagugggaggaucaggcagaaaucagcggcucgucacccauucugucuaucacaauuagugaggacggguccaugagcaucaaaaacgaagaggaggaacagacccuaacuauacugaucagaacaggacuucucgugauuucuggccuguuuccaaucagcauucccaucaccgccgcggcuugguacuugugggaggugaagaaacaaagggccggugucuuaugggaugugccuuccccacccccuauggggaaggcagaacuggaggacggagccuaucgaauaaaacagaagggcauucucggcuacucacagaucggggcuggaguuuaccgcgaagguacuuuccacacaauguggcauguaacccggggcgcagugcugaugcacaaggggaaaagaaucgagccgaguugggccgaugucaagaaagaccuuauuagcuauggaggcgguuggaagcuggagggggaauggaaagagggagaagaggugcagguuuuggcgcuagaaccaggcaagaaucccagggcugugcaaacgaagccuggccuguuuaaaacuaacaccgggacaaucggagccgucucucucgauuucuccccagguaccucaggcagucccauaauugacaagaaagggaaggugguaggacuguacggcaacggugucgugacacguagcggggcauauguuuccgccaucgcucagacugagaaaucuauugaggauaauccugaaaucgaggacgauauauuucgcaagcggagacuuaccauuauggacuuacacccgggagccggcaagacgaaaagguaccugcccgcaaucgugcgagaagcuaucaagcggggccuccgcacauugauucuggccccaacuagagucguggcggccgagauggaagaggcacucagggggcugccuauccgguaucagacccccgcuauucgagccgagcauacaggaagagaaauaguugaccuuaugugucacgcuaccuucacuaugcgccuguugucgccagugagggucccuaacuacaaucuaaucauuauggaugaggcacauuucaccgaccccgccagcaucgccgcucgugguuauaucucaacacggguggaaaugggcgaggcggcagggauuuuuaugacggccacuccaccgggauccagagauccuuucccccaaaguaacgcuccaauaaucgacgaggaaagggagauucccgaacgcucuuggaauagcggccacgaguggguaaccgauuuuaaagguaagacagugugguucguuccuuccaucaaagccgggaacgacauugcagccugccugcgaaagaauggaaagaaagucauccagcucucaagaaagaccuuugauucugaauacgugaaaacucggacaaacgacugggauuucguggucaccacggacauaagcgagaugggcgcuaauuuuaaggcggagaggguaaucgauccacgccguuguaugaaacccgugauuuuaacugacggcgaagagagaguuauccuggccgggccuaugccggugacacauaguuccgcagcucagcggaggggacgcauuggucgaaacccaaagaaugaaaacgaccaguacaucuauaugggcgagccccuugaaaaugaugaggacugcgcccacuggaaagaggcaaagaugcugcucgauaacauaaauaccccugaagggauuauccccagcauguucgagccagaaagagagaaggucgacgccauugauggagaauaccgguugaggggcgaggcucgcaaaaccuuuguggaccugaugagaaggggugaucucccuguuuggcuggccuauaagguggcggcagaggggaucaacuacgccgaccggcguugguguuucgauggcauaaaaaacaaucaaauccuugaagagaacgucgaaguggagauuuggacuaaggagggagaacgcaaaaagcuaaagccccgauggcuggacgcuagaaucuauucugauccauuggccuuaaaagaguuuaaggaauucgcugcaggcaggaaaucacugacacucaaucugauuaccgagauggggcggcuuccuacauucaugacucagaagacgcgcgacgcccuggauaaccucgcuguauugcacaccgccgaagcaggagguagagcguacaaucaugcccuguccgagcuaccggagacacuggaaacucuccuucuguuaaccuugcuggcuacagugaccggcgggaucuuucucuuccugaugaguggaaggggcauagguaaaaugacucuugggaugugcugcauuaucacggccagcauccugcucugguaugcacagauucagccccacuggaucgcugccucgauaauuuuggaguuuuuccugaucguuuuacuaauuccagaaccugagaagcaacggaccccccaggacaaccagcugacauacgucgugaucgcaauacucacuguggucgccgcuaccauggcgaaugaaaugggcuuucuugagaagacaaaaaaggaccugggauugggcucuaucgccacccagcaaccagaguccaacauucuggauaucgaccuccgaccugcaagcgcuuggacucuguacgccguugccacaacguucgugacccccaugcuuagacauucaauugaaaauaguucuguaaacgugucccucacugcaaucgcuaaucaggccacaguccugaugggguugggaaaagguuggccgcugagcaagauggauauuggcgugccauuacuagcgaucggguguuauucacagguuaacccuauaacccugaccgcugcccuccuucuguugguggcacacuacgccauuaucggacccggccugcaggcuaaagcaacacgcgaggcccaaaagagggcggcugccgguaucaugaagaauccaacugucgacgggauuacgguaauagaucucgaccccaucccuuaugauccgaaauuugaaaagcagcugggccaggugaugcuuuuaauucugugcguuacccaagugcucaugaugcggacaacuugggcauugugugaggcccugacccuagcuacaggacccaucaguacccugugggaaggcaacccagggcguuucuggaauacuacgauugccgucagcauggcaaacaucuuuagaggauccuaccucgcuggcgccggucuucuguucucuauaaugaaaaauacaaccaacacuaggcgcgggaccggaaacaugggcgagacauugggugagaaguggaaaagccggcugaaugcgcucggcaaguccgaauuucagaucuauaaaaagucagggauucaggagguggaccgaacucuggccaaggaaggaaucaaaagaggcgagaccgaucaccaugcagucucuagggggagugcuaaguuacgcugguucguggagcggaacaugguuacaccugaaggaaaagugguagaccuuggcugcgguagagggggauggucguacuauuguggcggucugaagaaugugcgugaggucaaaggccucacgaaggggggacccggccacgaagagccuauuccaaugagcaccuacggguggaaccuaguuaggcugcaguccggaguggaugucuuuuucauccccccugaaaagugcgacacuuugcugugugauauaggcgagucuucaccaaaucccacaguggaggccggucggacccuccgcguacuuaaccugguggaaaauugguugaacaauaacacucaauucugcauuaaaguucugaauccguacaugccuagcgugaucgagaagauggaagcacuccagcgaaaauaugggggagcuuuagucagaaacccacuguccaggaauaguacacaugagauguacugggugucuaacgccagcggcaauaucgucucauccgugaacaugauuagucggaugcuuauaaaccgcuuuaccaugagacacaagaaagccacguaugaacccgacguugaccugggcagcgggaccaggaauaucggaacagagucugagauuccuaaccuagauaucauugguaagcgaaucgaaaagauaaaacaggagcaugaaacuuccuggcacuacgaccaggaucacccauauaagaccugggcguaccauggcucauaugagacaaaacaaacugggagcgcuucgucuaugguaaauggagugguccggcuccugaccaagcccugggacguguugccgaugguuacacagauggcaaugaccgauacuacgccuuucggccagcagcguguguuuaaagaaaaggucgacacaagaacccaagagcccaaggaggguacuaaaaagcugaugaaaaucaccgccgaauggcucuggaaggagcuugggaaaaagaaaacaccacgcauguguacgagggaagaguucacccggaaggugagaaguaacgcugcccugggagcaauuuuuacugaugagaauaaguggaaauccgcccgcgaagcuguagaggacagcagguucugggaauuaguggauaaggagcgaaacuuucaccuggaaggcaaaugcgagacauguguuuacaauaugaugggcaagcgggagaaaaaguugggggaauucggaaaggcgaaagguucaagagccaucugguacauguggcucggcgcaagguuucuggaguucgaagcucuaggguuucuuaacgaggaccauugguucucccgcgaaaauucucugagcggagucgagggcgagggucuccacaagcugggguauauuuugcgugaugugaguaaaaaggaaggaggcgccauguacgcagacgacaccgccggcugggauacucggaucacacuggaggaccucaaaaacgaagagauggugaccaaucacauggaaggggagcauaagaagcuugcugaggccauuuuuaaacugacauaucagaacaaggucguuagagugcagaggccuacuccccgcggaaccguaauggauauaaucucccgacgggaccaaagagguagcggccagguggggacguacggauuaaauaccuucacaaacauggaagcgcagcugauuaggcagauggagggcgaaggugucuucaaaaauauccaacacuugacugugaccgaggagguugcagugaagaacuggcucgcccgcgucgggagagaacggcugucuaggauggcuaucucaggagaugacugcgugguaaaaccacuagaugaccguuuugccaacgcacuuacagcucugaaugauaugggcaagauucgaaaggacauacagcagugggagcccaguaaaggcuggaacgauuggacucagguuccuuucugcucccaucacuuucaugaacucaucaugaaggacgggcgcgugcuggucgugccauguagaaaucaagaugaguugauuggacgggccaggaucagccagggugcuggcuggucuuuacgcgaaaccgccugccuggggaaaucguaugcacagauguggucacucauguacuuccacagacgggaccuuaggcuggcggccaacgcuauuuguagcgccgugccgucccacuggguccccacgagucgaacaaccuggucuauccaugcaaagcacgaguggaugacuacagaggacaugcuaaccguuuggaaucguguguggauaagagaaaacccuuggauggaggauaaaacuccaguagaaagcugggaggaaauccccuaucugggaaagcgcgaggaccaguggugcggcucccucauugguuugaccucacgggcuacaugggccaagaauauccaagcagccauuaaccaggugaggagucugaucgggaaugaggaauacacggauuacaugccuucuaugaaaagauuucgccgggaggaagaggaagcgggaguccuuugguga

SEQ ID NO: 14872 - RNA, 9876 nt, Artificial Sequence
  derived and/or modified CDS sequence (opt3) from DENV-2__EU482699__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaagcuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggaaaaaagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacuaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucacauaaccagaccuucuugauugacgggccggagacugccgagugccccaauacaaacagagcauggaauagucuggaaguggaggauuauggauuuggcguguucaccacaaacaucuggcucaggcugaaggaaaaacaggacgcguuuugugacucuaaguuaaugagcgcugccauuaaggauaaucgugcaguacacgccgacauggguuacuggaucgaguccgcucugaacgauacuuggaaaauagagaaggccucauucauugaagucaaaaauugccauuggccuaagagccacacccuuuggucuaacgggguguuggaguccgaaaugaucaucccaaaaaaccucgcaggacccguuagucaacacaauuaucggccuggcuaccauacgcagauugcugguccauggcaccugggcaagcuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaccggggagaggacggcuguugguaugguauggaaauaagaccauugaaagagaaggaagagaaucuggugaacucauuaguuacggcggggcauggacagguggauaauuucagucucggcauccuggguauggcccuuuuucuggaagagauguugaggacccgcguaggcacuaaacacgcuauucuccuggcagccgucagcuucgugacacuaaucaccgggaacaugucguuuaaggaccugggacgagugauggucaugguuggcgcuacuauggccgaugacauugggaugggagugacauaccucgcacugcuugcggccuucaaaguacggcccaccuuugcugccggcuugcuguuacguagacucacguccaaggagcugaugaugacuaccaucgguauagugcuucugucucaaagcacaaucccugaaaccguccuagagcucacugaugcacuggcuuuggggaugauggugcugaagauuguuaggaaaauggaaaaguaucaguuagccgugacaaucauggcaauucucugcguccccaaugccgugauccugcagaacgcuuggaaaguuucauguaccauacuugcgguggucaguguauccccacuguugcucacaucuagccagcaaaagacugacuggauuccucuggcccuaaccaucaaaggacugaaucccacggcaaucuuccuuacaacccucucccgcacuaacaagaaacggucauggccacugaaugaggcuauuauggccgugggcaugguuagcauauuggccaguucucuguuaaagaacgacaucccgaugaccggcccucucguggcugggggacugcuuacagucugcuacgugcugacugguagauccgcagauuuggaacucgagagggccaccgacguaaagugggaggaucaggcggaaauuagcggcucgucacccauccugucuauuacgaucagugaggacggguccaugagcauaaaaaaugaagaggaggaacagacacuaaccauccugauucgaacuggacuucucgugaucucuggccuguuuccaauuagcauccccauaacagcugccgcaugguauuugugggaggucaagaaacagcgcgccgguguuuuaugggaugugccuuccccacccccuguggggaaggcugaacuggaggacggagcauaccggauuaaacaaaagggcauccucggcuauucacagaucggggccggagucuacaaggaagguaccuuccauacuauguggcacgugacaagaggcgcgguucugaugcacaaagggaagaggauugagccgaguugggcugauguaaaaaaggaccuuaucagcuacggaggcgguuggaaacuggagggggaauggaaggagggagaagaggugcaggucuuggcccuagaaccaggcaagaacccccgugcagugcagaccaaaccuggccuguuuaagacgaauacugggaccauaggagccguuucucucgauuucuccccagguacaucaggcagucccauuaucgacaaaaaggggaaaguggucggacuguauggcaacggugugguaacccgcagcggggcuuacgucuccgccauugcacaaacagagaagucuaucgaggauaacccugaaauagaggacgauauuuuucggaagagaaggcuuacuaucauggacuuacauccgggagcuggcaaaaccaagcgauaucugcccgccaucgugcgggaagcgauuaaacgcggccucagaacguugauccuggccccaacaaggguuguggcagcugagauggaagaggcccuccgggggcugccuauucgauaccagacucccgcuauaagagcagagcacaccggacgcgaaaucgucgaccuuaugugucaugccacauucaccaugaggcuguugucgccagugcguguuccuaauuauaaccuaauuaucauggaugaggcccacuucacugaccccgcuagcaucgcggcacgggguuacauuucaaccagaguggaaaugggcgaggccgcugggauauuuaugacagccacgccaccgggauccagggauccuuucccccagaguaaugcaccaaucauugacgaggaacgcgagauccccgaacgaucuuggaacagcggccaugagugggucacugauuuuaaggguaaaaccgugugguucguaccuuccauuaaggccgggaaugacaucgcugcgugccugagaaagaacggaaaaaaggugauacaacucucacggaaaacauuugauucugaauauguuaagaccaggacuaaugacugggauuucgucgugacaaccgacaucagcgagaugggcgccaacuuuaaagcagagcgcgugauugauccacguagauguaugaagcccgucaucuuaacggacggcgaagagcggguaauucuggcugggccuaugccggugacucacaguuccgccgcacagaggcgcggacgaaucgguagaaauccaaaaaacgaaaaugaccaguacauauacaugggcgagccccuugaaaacgaugaggacugcgcccacuggaaggaggcuaagaugcugcucgauaauauuaacacaccugaagggaucauucccagcauguucgagccagaacgggagaaaguugacgccaucgauggagaauauagguugcgcggcgaggcgagaaagaccuuuguggaccugaugaggcggggugaucucccugucuggcuggcauacaaaguggccgcugaggggauaaauuaugccgaccgucgcugguguuucgauggcaucaagaacaaccagauucuugaagagaauguugaaguggagaucuggaccaaaggaggcgagaagaagaaacuaaagccccgauggcuggacgcuagaauuuacucugauccauuggcauuaaaagaauuuaaggaguucgccgcugggaggaaaucacugacucucaaccugaucacagaaaugggacggcuuccuaccuucaugacacaaaagacucgcgacgcccuggauaaucucgcagucuugcauacggcggaggccgguggcagagcuuauaaccacgcccuguccgaacuaccggagacccuggagacacuccuucuguuaacuuugcuggcaaccgugacagggggaauauuucucuuccugaugaguggcagggguauugggaagaugacccuuggcaugugcugcaucaucacugcuagcauucugcucugguacgcccagauccagccccauuggauagcagccucgauuaucuuggaauuuuuccugauuguauuacuaaucccagagccugaaaaacagcggacgccccaagacaaucagcugaccuaugugguuauagcuauccucacagucguggcggccacuauggcaaacgagaugggauuucuugaaaagaccaaaaaggaccugggcuuggggucuauugcuacacagcagccagaguccaauauccuggauauugaccuccgaccugccagcgccuggacccuguacgcaguggcuacuacauucgucacgcccaugcuuagacacucaaucgagaacaguucuguuaaugugucccucaccgccauugcgaaccaagcuacuguacugaugggauuggguaaaggcuggccgcugagcaagauggauaucggggugccauuacuagccauaggauguuacucacaggucaauccuauuacacugaccgcagcccuccuucuguugguggcucacuaugcaaucaucggccccggucugcaggccaaggcgacccgcgaagcucagaaaagggccgcagccgggauuaugaagaacccaacaguugacggcauaacugugaucgaucucgaccccauuccuuacgauccgaaauuugagaagcaacugggacaggucaugcuuuuaauccugugcguaacgcaggugcucaugaugcggaccacaugggcuuugugugaagcccugacucuagcaaccggccccauuaguacacugugggaggggaauccaggacguuucuggaacaccacuaucgcuguuagcauggccaauauauuuagaggcuccuaucucgcgggugccgggcuucuguucucuaucaugaaaaacacgacaaauaccaggcgcggaacuggcaacaugggugaaaccuugggcgagaaguggaaaagccggcugaacgcacucgggaaguccgaguuucaaauuuacaagaaaucaggaauccaggaaguggaccgaacacuggcuaaggagggcauuaaaagaggggaaacugaucaucacgccgucucuaggggaagugcaaaguuacgcugguucguggagcggaauauggucaccccugagggcaaagugguugaccuugguugcgggagaggaggcuggucguauuacugugguggccugaagaacgugcgugaaguaaaggggcucacaaaaggaggccccgggcaugaggaaccuaucccaaugagcacguauggauggaaucuagugaggcugcaguccggcgucgauguuuuuuucauacccccugagaagugcgacaccuugcugugugauauuggugaaucuucaccaaaccccacuguggaggcugggcggacacuccgcguccuuaaucugguggagaacugguugaauaacaauacccaguucugcaucaaaguacugaacccguacaugccuagcgugaucgaaaagauggaggcccuccaacgaaaauacggaggcgccuuaguuagaaauccacuguccaggaacaguacucacgaaauguauugggugucuaaugcgagcggcaacauugucucauccgugaauaugauaagucggaugcuuaucaaccgcuuuacaaugagacauaagaaggcuaccuacgagcccgacgucgaccuggggagcggaacgaggaacauugguaucgaaucugagauuccuaaucuagauaucauaggcaaacgaaucgagaagauuaaacaggaacacgagaccuccuggcacuaugaccaggaucauccauacaagacaugggcauaucacgggucauacgaaacuaaacagaccggaagcgccucgucuauggugaacggcguuguacggcuccugacaaagcccugggacguguugccgacugucacccaaauggcuaugacagauaccacuccuuucggucagcagcguguguuuaaggagaaaguugacacgagaacacaggaacccaaggaggggaccaaaaagcugaugaaaaucacugccgaguggcucuggaaggaacuuggaaaaaagaagaccccacgcauguguacaagggaggaauucacgcggaaagugagaaguaaugcagcccugggcgcuauuuuuaccgaugagaacaaguggaaauccgcgcgcgaggccgucgaagacagcagguucugggaguuaguggauaaggaacgaaaucugcauuuggagggcaaaugcgaaacuuguguauauaacaugauggggaagcgggagaagaaacucggagaguuugguaaggcaaaaggcucaagagcuaucugguacauguggcugggggccagguuccuagaauuugaggcacuuggauuccugaaugaagaccacugguuuucccgcgagaacucucucagcggcguggaaggugaggggcugcacaaguugggauacauucugcgugauguuaguaaaaaggagggcggcgccauguaugcugacgacacagccgggugggauacccggauaacucucgaagaccuuaagaaugaggaaauggucacaaaccauauggagggagaacacaaaaagcuggcggaggcaaucuucaaauuaaccuaccaaaauaagguggugagaguccagaggccuacaccccgcgguacuguuauggauauuaucucccgacgggaccagagaggcagcgggcaagugggaaccuauggccugaacacguuuaccaauauggaggcccaguugaucaggcagauggaaggugaggggguauucaaaaacauucagcaucucacagugacugaagaggucgcugugcaaaauuggcuggcccgcguuggaagagagcggcuaucuaggauggcaauaucaggcgaugacugcguggucaagccacuugaugaccguuucgcuaacgcccugaccgcucucaacgauaugggcaagauccgaaaagacauucagcagugggaacccaguaagggguggaaugauuggacacaggugccuuuuugcucccaccauuuccacgagcugaucaugaaagacggacgcguauugguugugccauguagaaaccaagaugaauuaauuggucgggccaggaucagccagggcgcaggguggucucugcgcgagacugcgugccucggaaagucguacgcccagauguggucacuuauguauuuucacagacgggaccugaggcuagcugccaaugcaauauguagcgcugucccgucccauugggugcccaccagucgaacgacauggucuauccacgccaaacaugaauggaugaccacugaggacaugcugacaguguggaaccgugucuggauuagagagaauccuuggauggaagauaagaccccaguugagagcugggaagagauccccuaccucggcaagcgcgaagaccaguggugcgguuccuugauugggcugacuucacgggcaaccugggccaaaaacauccaagcggcuauaaaucaggugaggagucuuauuggaaacgaggaguauacagauuacaugccuucuaugaagagauuccgccgggaagaggaagaggccggcguacugugguga

SEQ ID NO: 14873 - RNA, 9876 nt, Artificial Sequence
  derived and/or modified CDS sequence (opt3) from DENV-2__EU482701__SS-prME
agcgccggaaugaucauuaugcugauccccacagugauggcuuuccaccucacaacucggaacggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccacuacucaagcaaaacgaaccggaggauauugacuguuggugcaauucuaccucaacaugggugaccuauggaacuuguacaaccacgggcgagcacaggcgggaaaaacgcaguguagcccuggugccccaugucgguauggggcuugagacucgaaccgaaacauggaugagcuccgagggagcguggaagcacgcucagcguaucgagacuuggauacugagacauccuggcuucaccaucauggccgcaauuuuggccuacacaaucggcaccacgcacuuucagagggugcucauuuucauccugcugacugcuguugcaccaucuaugacaaugcggugcauagggauuucgaaccgcgauuuuguggaaggagucucagguggcagcuggguggacaucguacucgagcacgggaguuguguuaccacuauggccaagaauaaacccacauuagauuucgaacugauuaagaccgaggcuaaacagccugccacgcuuagaaaguauugcaucgaagcgaaauugaccaacacaacuaccgaguccagguguccaacacaaggagagcccucucugaaggaggaacaggacaagcgguuugugugcaaacauagcauggucgaucgcggcugggguaauggguguggacuauucggcaagggcgggaucgugacuugcgcaauguuuaccugcaaaaagaacauggaaggaaaaauugugcagccugagaaucucgaauacacaauagucguuaccccacacuccggugaggagcaugccgugggcaacgacacugggaagcacggaaaagaaaucaagguaacgccgcagucaaguauuacagaggcugaacugaccggcuaugguacugugaccauggaguguagcccccgaacagggcuugauuucaaugaaaugguccuguugcaaauggagaacaaggccuggcucgugcacagacagugguuucuggacuuaccucugccauggcuccccggcgcagauaaacaggagucuaauuggauccagaaggaaacccuuguuacuuucaaaaacccucaugcuaagaaacaagacguggucgugcugggaucccaggagggcgccaugcacgcggccuugacaggggcaacggaaauacagaugucaagcggaaaucuacuguuuaccggucaucucaagugcaggcugcggauggacaaacuucaacugaaaggcaugaguuacucuauguguacugggaaguucaaaguaguuaaggagauugcugagacacagcacggaaccaucgugauccguguccaguaugaaggcgaugguuccccaugcaaaauucccuucgagaucauggacuuggaaaagcgcuacgugcucgggagacugauuacagucaacccgauagugacugagaaggauagcccuguuaacaucgaagccgagcccccauuuggcgacucguacauuaucaucggaguggagccuggccaguuaaaacugaauugguucaagaaagggucuuccauuggacaaauguuugaaaccacgaugaggggugcuaagcggauggccauacuaggcgauaccgcaugggacuucgggucacucggaggcguauuuacaaguaucgguaaagcccugcaucaggucuucggggcuauuuauggcgcggcauuuagcggaguguccuggacuaugaagauccuuauuggcguuaucauaaccuggaucgggaugaacucucgaagcacaucauugagugugucccugguccucgugggaauuguaacucuguaccuuggcgugaugguucaggccgauagcgguugugucgugucuuggaagaauaaagagcugaagugcgggucaggaaucuucauuaccgacaacgugcacacguggacagaacaguauaaauuucaacccgagaguccaagcaaguuggcuuccgccauccagaaagcacaggaagagggcauaugugguauucgcucugucaccagacucgagaaucugauguggaagcagaucacucccgaauuaaaccacauucuggccgagaaugaaguuaaacuaacaaucaugaccggcgauauaaaggggaucaugcaagcuggaaagaggucgcuccggccucagccaacugagcugaaauacagcuggaagaccuggggcaaagccaagaugcuuuccacagaaucacauaaccagacguucuugauugacgggccggagaccgcagagugccccaauacuaaccgcgcguggaauagucuggaaguggaggauuauggauuuggcguguucacaaccaacaucuggcucagacugaaagaaaagcaggacgcuuuuugugacucuaaguuaaugagcgccgcaguaaaagauaauagggccguccacgcugacauggguuacuggauugaguccgcccugaacgauacauggaagaucgagaaagcaucauucauagaagugaagaauugccauuggccuaaaagccacacucuuuggucuaacgggguuuuggaguccgaaauggugauuccaaagaaccucgcuggacccgucagucaacacaauuaucguccuggcuaccauacccagaucgccgguccauggcaccugggcaagcuagagauggacuucgauuuuugugacgggacgacagugaucguuaccgaagauugcggaaaccggggccccagccugcgaacuaccacagcgucugggaaacucauuacugaguggugcuguagauccugcacccugccgccucuuagguaccgcggagaggacggcuguugguaugguauggaaauccggccauugaaggagaaagaagagaaucuggugaacucauuaguaacagccgggcauggacaggucgauaauuucagucucggcauucuggguauggcucuuuuucuggaagagauguugagaacgagggugggcaccaagcacgcaauacuccugguggccgucagcuucguuacucuaaucacagggaacaugucguuuaaagaccugggacgcgugguagugauggucggcgcuaccauggccgaugacauugggaugggagugacuuaccucgcacugcuugcggccuucaagguucgacccacauuugcugccggcuugcuguuacggaagcucaccuccaaagagcugaugaugacgacuaucggugugguccuucugucucaaagcaccauuccugauacagugcuagaacucaccgacgcacuggcuuuggggaugaugguucugaagaucgugcguaauauggagaaauaucaguuagccgucacuauaauggcaauccucugcguacccaacgccgugauucugcagaaugcuuggaagguuucauguacaauccuugcgguggucaguguguccccacuguugcucaccucuagccagcaaaagacugacuggauuccucuggcccuaacuaucaagggacugaaccccaccgcaauauuccuuacgacacucuccagaaccaauaaaaagaggucauggccacugaacgaagcuauuauggccguaggcauggugagcaucuuggccaguucucuguuaaagaaugauaucccgaugacuggcccucucgucgcugggggacugcuuaccguuugcuacgugcugacaggucgcuccgcagacuuggagcucgaacgggccacugaugugaaaugggaggaccaggcggagauuagcggcucgucacccauacugucuaucaccauuagugaagauggguccaugagcaucaagaacgaggaagaggagcagacgcuaacaauucugaucagaaccggacuucucgucauaucuggccuguuuccaaucagcauucccaucacugcugccgcaugguauuugugggaagugaaaaagcagagggccgguguuuuaugggacguaccuuccccacccccuauggggaaagcugagcuggaagauggagcauaccgaauuaagcaaaagggcauccucggcuauucacagauaggggccggaguguacaaagaggguacauuccauaccauguggcacgucacucgcggcgcggugcugaugcacaaggggaaacggauugaaccgaguugggcugacguuaagaaagaucuuaucagcuacggaggcgguuggaagcuggagggggaguggaaggaaggagaggaagugcaggucuuggcccuagagccaggcaaaaaucccagagcagugcagacaaagccuggccuguuuaaaaccaacacggggacuaucggagccguaucucucgacuucuccccagguaccucaggcagucccauuaucgauaagaaagggaaggucgugggacuguauggcaacgguguugugacaaggagcggggcuuacgucuccgccauagcacaaaccgaaaagucuauugaggacaauccugagaucgaagaugacauuuuucguaaacgccggcuuacaaucauggacuuacauccgggagcuggcaagacuaaaagauaucugcccgccauagugagggaggcgauuaagcgaggccuccggaccuugauccuggccccaacgcgcguuguggcagcugaaauggaggaagcccucagagggcugccuaucagguaccagacacccgcuauucgggcagagcacacuggacgagagaucgucgaucuuaugugucaugccaccuucacaaugagacuguugucgccagugcgcguaccuaacuauaaucuaauuauaauggacgaagcccacuucaccgaucccgcuagcaucgcggcaagggguuacauuucaacucguguggagaugggcgaagccgcugggaucuuuaugaccgccacaccaccgggaucccgggacccuuucccccagaguaacgcaccaaucauugaugaggagagagaaauacccgagaggucuuggaauagcggccaugaauggguuacggacuuuaaagguaagacugucugguucgugccuuccaucaaggccgggaacgauauugcugcgugccugcgcaaaaauggaaagaaagugauccaacucucacgaaagaccuuugacucugaguaugucaaaacaagaaccaacgauugggacuucguagugacuacagauauuagcgaaaugggcgccaauuuuaaggcagagcggguuaucgacccaaggcgcuguaugaaacccgugauauuaaccgacggcgaggaacgugucauccuggcugggccuaugccggugacgcacaguuccgccgcacagagacggggaaggauuggucgcaacccaaagaaugagaacgaucaguacaucuacaugggcgaaccccuugagaaugacgaagauugcgcccacuggaaggaggcuaaaaugcugcucgacaacauuaauacuccugaggggaucauacccagcauguucgaaccagagcgagaaaagguugaugccauugacggagaguauagauugcggggcgaagcgaggaaaacauuuguggaucugaugcgcagaggugaccucccugucuggcuggcauacaagguggccgcugaggggaucaacuaugccgauaggcggugguguuucgacggcauuaaaaacaaucagauccuugaggaaaacguagagguggaaauauggaccaaggagggagagcguaagaaacuaaagccccgcuggcuggaugcucgaaucuacucugacccauuggcauuaaaagaauuuaaggaguucgccgcuggcagaaaaucacugacccucaaucugauuacugaaauggggaggcuuccuacauucaugacccaaaagacacgggaugcccuggacaaccucgcaguuuugcauacugcggaggccggaggucgcgcuuauaaucacgcccuguccgaacuaccggagacgcuggagacccuccuucuguuaacauugcuggcaacugucaccggcgggaucuuucucuuccugaugaguggaagaggcauugguaagaugacacuugggaugugcugcaucauaaccgcuagcauucugcucugguacgcccagauccagccccauuggaucgcagccucgauuaucuuggaauuuuuccugauaguguuacuaauuccagagccugaaaaacagaggacuccccaagacaaccagcugacguauguggucaucgcuauucucaccguuguggcggccacaauggcaaaugagaugggcuuucuugaaaagacuaaaaaggaucugggauugggcucuaucgcuacccagcagccagaguccaacauacuggacaucgaucuccggccugccagcgccuggacacuguacgcaguagcuaccacuuucgugacacccaugcuucgacacucaauugagaauaguucugucaacgugucccucacggccaucgcgaaucaagcuaccguucugaugggguugggaaaagguuggccgcugagcaagauggacauuggcgugccauuacuagccaucggguguuacucacaggucaacccuauuacucugacagcagcccuccuucuguugguagcucacuaugcaaucauaggacccggccugcaggccaaggcgaccagagaagcucagaaacgcgccgcagccgguauuaugaagaauccaaccguggaugggaucacaguuaucgaccucgaucccauuccuuacgacccgaaauuugagaagcaacugggccaggugaugcuuuuaauacugugcgucacucaggugcucaugaugaggacgaccugggcuuugugugaagcccugacacuagcaacuggacccaucaguacccugugggagggcaacccagggcgguucuggaauacaaccauugcugucagcauggccaacaucuuucguggauccuaucucgcgggcgccggucuucuguucucuauuaugaaaaauacuacgaacacaagaagggggaccggaaacaugggcgaaacuuugggugagaaguggaaaagccgccugaaugcacucggcaaguccgaguuucaaaucuacaagaaaucagggauacaggaaguggaucggacccuggcuaaggagggaaucaaacgaggcgaaacagaccaucacgccguuucuagagggagugcaaaguuaaggugguucguggagcgcaacaugguaacuccugagggaaaaguggucgaucuuggcugcgguagagggggauggucguauuacuguggcggucugaagaauguuagagaagugaagggccucaccaaagggggacccggccaugaggaaccuauuccaaugagcacauauggguggaaccuaguccgucugcaguccggaguggacguauuuuucauacccccugagaagugcgauacguugcugugugacauuggcgaaucuucaccaaaucccaccguggaggcugguaggacucuccggguucuuaaccugguggagaauugguugaacaauaacacacaguucugcaucaaaguccugaauccguacaugccuagcgugauagaaaagauggaggcccuccaacgcaaauacgggggagccuuaguccgaaacccacuguccagaaauaguacccacgaaauguauugggugucuaacgcgagcggcaauauuguuucauccguaaacaugaucaguaggaugcuuaucaaccgguuuacuaugcgccauaagaaggcuacauacgagcccgacguggaucugggcagcgggaccagaaauauuggaauagaaucugagaucccuaaccuagacauuaucgguaaaaggauugagaagaucaaacaggaacacgagacguccuggcacuaugaucaggaccauccauacaagaccugggcauaucacggcucauacgaaacaaaacagacugggagcgccucgucuauggucaauggagugguucgacuccugaccaagcccugggauguguugccgacagucacucaaauggcuaugaccgacacaaccccuuucggccagcagcggguguuuaaggagaaaguagauacucguacgcaggaacccaaggaggguaccaaaaagcugaugaaaauaaccgccgaguggcucuggaaggaacuugggaaaaagaagacuccaagaauguguacccgcgaggaguucacaaggaaagugcggaguaacgcagcccugggagcuaucuuuacggacgagaauaaguggaaauccgcgagagaggccguugaagauagccgcuucugggaguuagucgacaaggaaaggaaccugcauuuggagggcaaaugcgaaaccuguguguauaauaugaugggcaagcgagagaagaaacucggggaguuuggaaaggcaaaagguucacgggcuauuugguacauguggcugggcgccagauuccuagaauuugaggcacuuggguuccugaacgaagaucacugguuuuccagggaaaauucucucagcggaguggaaggcgagggucugcacaaguugggguacauccugcgcgacgucaguaaaaaggagggaggcgccauguaugcugacgauacugccggcugggacacacguauuacccucgaagaucuuaagaacgaggaaaugguuacuaaucauauggagggggaacacaaaaagcuggcggaggcaaucuucaaauuaacauaccaaaacaaggugguacgggugcagagaccuacccccaggggaacagucauggacauuauaucccgccgagaucagcgggguagcggccaaguggggacuuauggacugaauaccuuuacgaacauggaggcccaguugaucagacagauggaaggcgaggguguuuucaaaaauauucagcaucucaccgugacagaagaggucgcugugcaaaacuggcuggccaggguagggcgcgagagacuaucucggauggcaaucucaggagacgauugcguugugaagccacuugacgauagguucgcuaacgcccugacugcucucaaugacaugggcaagauccguaaagauauucagcagugggaacccaguaagggcuggaacgacuggacccaggucccuuuuugcucccaccauuuccacgagcugauaaugaaagaugggcgaguguugguggucccaugucgcaaucaagacgaauuaaucgguagagcccggauuagccagggagcaggcuggucucugagggagacagcgugccucgggaagucguacgcccagauguggucacuuauguauuuucaccgcagagaccugcggcuagcugccaacgcaaucuguagcgcuguuccgucccauugggugcccacaaguaggaccacguggucuauucacgccaaacaugaauggaugacaaccgaggauaugcugacuguauggaaucgaguguggauccgugagaacccuuggauggaagacaagacaccagucgagagcugggaagagauacccuaccucggaaagagagaagaucaguggugcggcuccuugaucggucugaccucacgcgcaacuugggccaaaaauauucaagcggcuaucaaccaggugcggagucuuauugggaaugaggaguauaccgacuacaugccuucuaugaagagguucagacgcgaagaggaagaggccggaguucugugguga

SEQ ID NO: 14874 - RNA, 9876 nt, Artificial Sequence
  derived and/or modified CDS sequence (opt3) from DENV-2__EU482703__SS-prME
agcgccggaaugaucauuaugcugauacccaccgugauggcuuuccaccucacuacuagaaacggggagccucauaugaucgucgggauucaagaaaaggguaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagguacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaggauguaccauccuugcugugguuucagugaguccacuguugcucacauccucucagcagaaaacugacuggauaccucuggcgcuaaccauuaagggccugaaccccacggccaucuuccuuacaacccucagcagaacuaauaaaaagagguccuggccacugaacgaggcaaucauggcugucggcauggugucaauuuuggccagcagucuguuaaagaaugacauaccgaugaccgggccucucguagccggaggucugcuuacagugugcuauguccugacuggccgcucugcugauuuggaacucgagcgggcaaccgacguuaaaugggaggaucaggccgaaaucuccgggagcucgcccauucugucaaucacgauuucugaggacggaaguauguccaucaagaacgaagaggaggaacagacacuaaccauacugaucagaacuggccuucucgugauuagcggucuguuuccaaucucuauucccaucacagcggcugccugguacuugugggaggugaaaaagcagagggcaggggucuuaugggaugugccuagcccacccccuaugggaaaagccgaacuggaggacggcgcuuaucgaauaaagcaaaagggcauucucggguacucccagaucggagccgguguuuacaaagaaggcaccuuccacacuauguggcauguaacacgcggggcagugcugaugcacaagggaaaacggaucgagccgucaugggcggaugucaagaaagaccuuauuaguuauggcgguggguggaagcuggagggagaauggaaggagggcgaagaggugcagguuuuggcucuagaaccaggcaaaaaucccagagccgugcagaccaagccugggcuguuuaaaacgaacacuggaaccaucggugcagucagccucgauuucucuccaggcacauccgggucacccauaauugacaagaaaggaaaggugguaggccuguacgguaacggggucgugaccaggaguggagccuauguuagcgcuaucgcccaaacagagaaguccauugaggauaauccugaaaucgaggacgauauauuucguaaacgccggcuuacuauuauggacuuacacccgggcgcaggcaagaccaaaagauaccugcccgcuaucgugagggaagccaucaagcgagggcuccggacguugauucuggcgccaacacgcgucguggccgcagagauggaagaggcucucagaggacugccuaucagguaucagacucccgccauucgggcugagcauaccggucgagaaauaguugaccuuaugugucacgcaacauucaccaugagacuguugucuccagugcgcgucccuaacuacaaucuaaucauuauggaugaggcccauuucacugaccccgccucgaucgcugcgaggggcuauaucagcacccguguggaaaugggggaggcagccggaauuuuuaugacagcuacgccaccgggcucacgggauccuuucccccaguccaacgccccaauaaucgacgaggaaagagagauucccgaaaggaguuggaacucuggucacgaguggguaacugauuuuaaagggaagaccgugugguucguuccuagcaucaaggcaggaaacgacauugccgcuugccugcgcaaaaauggcaagaaagucauccaacucucccgaaagacauuugauucagaauacgugaaaaccagaacuaacgacugggauuucguggucacaaccgacauaucugagaugggcgcgaauuuuaaggccgagcggguaaucgauccaaggcgcuguaugaaacccgugauuuuaacggacggggaagaacguguuauccuggcaggaccuaugccggugacucauagcagugcugcccagagacgggguaggauuggccgcaacccaaagaaugaaaacgaccaguacaucuauaugggggagccccuugaaaaugaugaggacugcgcacacuggaaggaggccaaaaugcugcucgauaacauaaauacaccugaaggaauuauccccuccauguucgagccagaacgagagaaggucgacgcuauugauggcgaauacagauugcggggugaggccaggaaaaccuuuguggaccugaugcgcagaggggaucucccuguuuggcuggcguauaagguggcagccgagggcaucaacuacgcugacaggcggugguguuucgauggaaucaaaaauaaucagauccuugaagagaacgucgaaguggagauuuggaccaaggagggcgaacguaagaaacuaaagccccgcuggcuggacgcccgaaucuauagcgauccauuggcuuuaaaagaguuuaaggaguucgcagccgggagaaaaucucugacucucaaucugauuacagagaugggaaggcuuccuaccuucaugacacaaaagacucgggacgcucuggauaaccucgccguauugcacacggcagaagcggguggccgcgccuacaaucaugcucugucagagcuaccggagacccuggaaacacuccuucuguuaacuuugcuggccaccgugacagggggaaucuuucucuuccugauguccggcagagguauagggaagaugacccuuggcaugugcugcauuaucacugcaaguauccugcucugguaugcucagauucagccccacuggaucgccgcaagcauaauuuuggaguuuuuccugaucguuuuacuaauuccagaaccugagaaacagaggacgccccaagacaaccagcugaccuacgucgugaucgccauacucacaguggucgcugcgacuauggccaaugaaaugggauuucuugagaagaccaaaaaggaccugggcuuggggucgaucgcaacacagcagccagagucuaacauucuggauaucgaccuccggccugcuuccgccuggacccuguacgccguugcaacuacauucgugacgcccaugcuucgacauagcauugaaaauucaaguguaaacgugucucucaccgcuaucgccaaucaagcgacuguccugaugggauuggguaaaggcuggccgcuguccaagauggauauuggggugccauuacuagcuaucggauguuauagccagguuaacccuauaacacugaccgccgcacuccuucuguugguggcccacuacgcuauuaucggccccggucugcaggcaaaggccaccagagaggcgcagaaacgcgcugccgcagggaucaugaagaauccaacagucgacggcauuacuguaauagaucucgaccccaucccuuaugauccgaaauuugaaaagcaacugggacaggugaugcuuuuaauucugugcguuacacaggugcucaugaugaggaccacaugggccuugugugaggcucugacucuagccaccggccccaucucaacacugugggaagggaacccaggacgguucuggaauaccacuauugcagucaguauggcuaacaucuuucguggcagcuaccucgccggugcggggcuucuguucuccauaaugaaaaauacgacaaacaccagaaggggaacuggcaacaugggugagaccuugggcgagaaguggaaaucucgccugaaugcccucggaaagagcgaauuucaaaucuauaagcgguccggcauucaggagguggaccgaacacuggcaaaagaaggcaucaagagaggggagacugaucaccaugcugucucaaggggaucugccaaauuacgcugguucguggagcggaacaugguuaccccugaaggcaaggugguagaccuugguugcgggagaggaggcuggaguuacuauugugguggccugaaaaaugugcgugaggucaaggggcucacaaagggaggccccgggcacgaagaaccuauuccaaugucgacguacggauggaaccuaguuaggcugcagagcggcguggaugucuuuuucauacccccugaaaaaugcgacaccuugcugugugauauaggugaguccucuccaaaucccacuguggaggcagggcggacacuccgcguacuuaaccugguggaaaauugguugaacaauaacacccaguucugcauuaagguucugaauccguacaugccuucagugaucgagaaaauggaagcucuccaacgaaaguauggaggcgccuuagucagaaacccacugagcagaaauuccacucaugagauguacugggugaguaacgccucuggcaauaucgucagcucagugaacaugauuucccggaugcuuauaaaccgcuuuacaaugagacacaaaaaggcgaccuaugaacccgacguugaccuggggaguggaacgaggaauaucgguauugagagcgagaucccuaaccuagauauuaucggcaagcgaauagagaaaaucaagcaggagcaugaaaccucuuggcacuacgaccaggaucacccauauaaaacaugggcuuaccauggguccuaugagacuaagcagaccggaucagcaagcucgaugguaaauggcgugguccggcuccugacaaaacccugggacguguugccgacuguuacccaaauggccaugacagauaccacuccuuucggucagcagcguguguuuaaggaaaaggucgacacgagaacacaggagcccaaagaggggaccaagaaacugaugaagauuacugcugaauggcucuggaaagagcuuggaaagaaaaagaccccacgcauguguacaagggaagaguucacgaagaaagugcggucuaacgccgcacugggcgccaucuuuaccgaugagaauaaguggaaaagugcuagagaagcgguagaggacucccgcuucugggaauuaguggauaaggagaggaaccugcacuuggaaggcaaaugcgagacuuguguuuacaauaugauggggaagcgagagaagaaacucggagaauuugguaaggccaaaggcagccgggcaauuugguacauguggcugggggcuagauuccuagaguuugaagcccuuggauuccugaacgaggaccauugguuuucaagggaaaauucccucucuggcgucgagggugaggggcugcacaaguugggauauauccugcgcgaugugagcaaaaaggaaggcggcgcaauguacgccgacgacacagcugggugggauacccguauuacucucgaggaccuuaagaacgaagagauggugacaaaucacaugaaaggagaacauaagaaacuggccgaggcgauauucaaguuaaccuaucaaaacaaagucguucgggugcagagaccuacacccagggguacuguaauggauaucauuagucgccgagaccagcggggcuccgggcaagugggaaccuacggccugaauacguuuaccaacauggaggcacaguugaucagacagauggaaggugagggggucuucaagaauauccagcaccucacagugacugaagagguugccgugcaaaacuggcuggcuagggucggacgcgagagacuaagccggauggccauuucuggcgaugacugcgugguaaagccacuugaugacagguucgcaaacgcucugaccgcccucaaugauaugggcaaaauacguaaggacauccagcagugggaacccucaaaaggguggaacgauuggacacagguuccuuuuugcagucaucacuuccaugagcugauuaugaaggacggacgaguguuggucgugccaugucgcaaucaagaugaauuaaucgguagagcucggauuucccagggcgccggguggagccugagggagacugcaugccucggaaaaucuuaugcgcagauguggucgcuuauguacuuucaccgcagagaccugcggcuagccgcuaacgccaucuguucagcagugccgagccacuggguccccaccuccaggacgacauggaguauacaugcuaagcacgaauggaugaccacugaggacaugcugacaguuuggaaucgaguguggauccgugagaacccuuggauggaagauaagaccccaguagagucuugggaagagauucccuaucucggcaaaagagaagaccaguggugcgguagcuugaucgggcugacuucccgcgccaccugggcaaagaauauucaagccgcgaucaaccaggugcggucacuuauaggaaaugaggaguacacagauuacaugccuaguaugaaaagguucagacgcgaagaggaagaggcuggcguccugugguga

SEQ ID NO: 14875 - RNA, 9876 nt, Artificial Sequence
  derived and/or modified CDS sequence (opt3) from DENV-2__EU482705__SS-prME
agcgccggaaugaucauuaugcugauacccaccgugauggcuuuccaccucacuacuagaaacggggaaccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacuacagagugccccaauaccaacagagccuggaauagucuggaaguggaggauuacggauuuggcguguucacaacuaacaucuggcucaagcugaaagaaaagcaggacgcauuuugugacucuaaguuaaugagcgcggcuauuaaagauaauagggccguacaugcagacauggguuauuggaucgaguccgcccugaacgauaccuggaagauagagaaggcuucauucauugaagucaagaauugccacuggccuaaaagccauacgcuuuggucuaacgggguguuggaguccgaaaugaucaucccaaagaaccucgccggacccguuagucaacacaauuaccguccuggcuaccacacacagauugcagguccauggcaucugggcaagcuagagauggacuucgauuuuugugacgggaccacugugaucgucaccgaagauugcggaaaccggggccccagccugcgaacaacuaccgcuucugggaaacucauuacagaguggugcuguagauccugcacgcugccgccucuuagguaucgcggagaggacggcuguugguacgguauggaaauacggccauugaaggagaaagaagagaaucuggugaacucauuaguuaccgccgggcacggacagguggauaauuucagucucggcguacuggguauggcgcuuuuucuggaagagauguugagaacuagggucggcacaaagcaugccauccuccugguggcugugagcuucgucacccuaauuacugggaacaugucguuuaaagaccugggacgcguugugguaauggugggcgcaacaauggccgauaauaucgggaugggagucaccuaucucgcucugcuugccgcauucaaggugcgacccacguuugcggccggcuugcuguuacggcgucucacuuccaaggagcugaugaugaccacaauugguaucguucuucugucucaaagcaccauaccugaaacugugcuagagcucacagacgcucuggccuuggggaugaugguccugaaaaucgugagaaacauggaaaaguaccaguuagcaguuaccauuauggcuauccucugcgugcccaaugccgucauucugcagaacgcauggaaaguaucauguacaauccuugccgugguuaguguguccccacuguugcucacuucuagccagcaaaagaccgauuggauaccucuggcucuaacgauuaaaggacugaaucccacagcgaucuuccuuaccacucucuccaggaccaacaagaaacgcucauggccacugaaugaggccaucauggcagucggcauggugagcauuuuggcuaguucucuguuaaagaacgacauaccgaugacaggcccucucguagccgggggacugcuuacugugugcuauguccugaccggucgguccgccgacuuggaacucgagagagcuacggauguuaagugggaggaccaggcagaaaucagcggcucgucacccauucugucuaucacaauuagugaggauggguccaugagcaucaaaaaugaagaggaggaacagacccuaacuauacugaucaggacaggacuucucgugauuucuggccuguuuccaaucagcauucccaucaccgccgcggcuugguacuugugggaggugaagaaacagcgagccggugucuuaugggacgugccuuccccacccccuauggggaaggcagaacuggaggauggagccuaucgcauaaaacaaaagggcauucucggcuacucacagaucggggcuggaguuuacaaggaagguacuuuccacacaauguggcauguaacccggggcgcagugcugaugcacaaagggaagagaaucgagccgaguugggccgacgucaaaaaggaucuuauuagcuauggaggcgguuggaaacuggagggggaauggaaggagggagaagaggugcagguuuuggcgcuagaaccaggcaagaaccccagggcugugcagacgaaaccuggccuguuuaagacuaacaccgggacaaucggagccgucucucucgacuucuccccagguaccucaggcagucccauaauugauaaaaaggggaaagugguaggacuguacggcaauggugucgugacacguagcggggcauauguuuccgccaucgcucaaacugagaagucuauugaggacaacccugaaaucgaggaugacauauuucgcaagcggagacuuaccauuauggauuuacacccgggagccggcaaaacgaagagguaccugcccgcaaucgugcgagaagcuaucaaacggggccuccgcacauugauucuggccccaacuagagucguggcggccgagauggaagaggcacucagggggcugccuauccgguaucagacccccgcuauucgagccgagcauacaggaagagaaauaguugaccuuaugugucacgcuaccuucacuaugcgccuguugucgccagugagggucccuaauuacaaccuaaucauuauggacgaggcacauuucaccgaucccgccagcaucgccgcucgugguuauaucucaacacggguggaaaugggcgaggcggcagggauuuuuaugacggccacuccaccgggauccagagacccuuucccccagaguaaugcuccaauaaucgaugaggaaagggagauucccgaacgcucuuggaacagcggccacgaguggguaaccgacuuuaaggguaaaacagugugguucguuccuuccaucaaggccgggaaugauauugcagccugccugcgaaagaacggcaagaaggucauccaacucucaagaaaaaccuuugacucugaauacgugaagacucggacaaaugauugggacuucguggucaccacggauauaagcgagaugggcgcuaacuuuaaagcggagaggguaaucgacccacgccguuguaugaagcccgugauuuuaacugauggcgaagagagaguuauccuggccgggccuaugccggugacacauaguuccgcagcucagcggaggggacgcauuggucgaaaucccaaaaacgaaaaugaccaguacaucuauaugggcgagccccuugaaaacgacgaggauugcgcccacuggaaggaggcaaagaugcugcucgacaauauaaacaccccugaagggauuauccccagcauguucgagccagaaagagagaaagucgaugccauugacggagaauaccgguugaggggcgaggcucgcaagaccuuuguggaucugaugagaaggggugaccucccuguuuggcuggccuauaaaguggcggcagaggggaucaacuacgccgaucggcguugguguuucgacggcauaaagaauaaccagauccuugaagagaaugucgaaguggagauuuggacuaaagagggagaacgcaagaagcuaaaaccccgauggcuggaugcuagaaucuauucugacccauuggccuuaaaggaguuuaaagaguucgcugcaggcaggaagucacugacacucaaccugauuaccgagauggggcggcuuccuacauucaugacucagaaaacgcgcgaugcccuggacaaucucgcuguauugcacaccgccgaagcaggagguagagcguacaaccaugcccuguccgagcuaccggagacacuggaaacucuccuucuguuaaccuugcuggcuacagugaccggcgggaucuuucucuuccugaugaguggaaggggcauagguaagaugacucuugggaugugcugcauuaucacggccagcauccugcucugguaugcacagauucagccccacuggaucgcugccucgauaauuuuggaguuuuuccugaucguuuuacuaauuccagaaccugagaagcagcggaccccacaagauaaucagcugacauacgucgugaucgcaauacucacuguggucgccgcuaccauggcgaacgaaaugggcuuucuugagaaaacaaagaaagaccugggauugggcucuaucgccacccagcagccagaguccaauauucuggacaucgaucuccgaccugcaagcgcuuggacucuguacgccguugccacaacguucgugacccccaugcuuagacauucaauugaaaacaguucuguaaaugugucccucacugcaaucgcuaaccaagccacaguccugaugggguugggaaaggguuggccgcugagcaaaauggacauuggcgugccauuacuagcgaucggguguuauucacagguuaauccuauaacccugaccgcugcccuccuucuguugguggcacacuacgccauuaucggacccggccugcaggcuaaggcaacacgcgaggcccagaagagggcggcugccgguaucaugaaaaacccaacugucgaugggauuacgguaauagaccucgaucccaucccuuaugacccgaaguuugaaaaacaacugggccaggugaugcuuuuaauucugugcguuacccaggugcucaugaugcggacaacuugggcauugugugaggcccugacccuagcuacaggacccaucaguacccugugggaaggcaauccagggcguuucuggaacacuacgauugccgucagcauggcaaauaucuuuagaggauccuaccucgcuggcgccggucuucuguucucuauaaugaagaacacaaccaacacuaggcgcgggaccggaaauaucggcgagacauugggugagaaauggaaaagccggcugaacgcgcucggcaaauccgaauuucaaauuuauaagaagucagggauccaggagguggaucgaacucuggccaaagaaggaauuaagagaggcgagaccgaccaccaugcagucucuagggggagugcuaaauuacgcugguucguggagcggaauaugguuacaccugaaggaaaggugguagaucuuggcugcgguagagggggauggucguacuauuguggcggucugaaaaacgugcgugaggucaagggccucacgaaagggggacccggccacgaagaaccuaucccaaugagcaccuacggguggaaucuaguuaggcugcaguccggaguggacgucuuuuucauacccccugaaaaaugcgauacuuugcugugugacauuggcgagucuucaccaaaccccacaguggaggccggucggacccuccgcguacuuaaucugguggaaaacugguugaauaacaauacucaguucugcaucaagguucugaacccguacaugccuagcgugaucgagaaaauggaagcacuccaacgaaaguaugggggagcuuuagucagaaauccacuguccaggaacaguacacaugagauguacugggugucuaaugccagcggcaacauugucucauccgugaacaugauaagucggaugcuuaucaaucgcuuuaccaugagacacaaaaaggccacguaugaacccgauguugaccugggcagcgggaccaggaacauuggaaucgagucugagauuccuaaucuagacaucauagguaagcgaaucgagaaaauuaagcaggagcaugaaacauccuggcacuacgaucaggaccacccauauaaaacuugggcguaccauggcucauaugagaccaagcagacagggagcgcuucgucuaugguaaacggagugguccggcuccugacuaaacccugggauguguugccgaccguuacacaaauggcaaugaccgacacuacgccuuucggccagcagcguguguuuaaggaaaaggucgauacaagaacccaggagcccaaagaggguacuaagaaacugaugaagaucaccgccgaauggcucuggaaagagcuugggaagaaaaagacaccacgcauguguacgagggaagaguucacccggaaggugagaaguaaugcugcccugggagcaauuuuuacugacgagaacaaauggaaguccgcccgcgaagcuguagaggauagcagguucugggaauuaguggacaaagagcgaaaucugcacuuggaaggcaagugcgagacauguguuuacaacaugaugggcaaacgggagaagaagcucggggaauuuggaaaagcgaaggguucaagagccaucugguacauguggcugggcgcaagguuccuagaguuugaagcucuuggguuccugaaugaggaucauugguuuucccgcgaaaacucucucagcggagucgagggcgagggucugcacaaauugggguauauucugcgugacgugaguaagaaagaaggaggcgccauguacgcagaugacaccgccggcugggacacucggauaacacucgaggaucuuaagaaugaagagauggugaccaaccacauggaaggggagcauaagagacuggcugaggccaucuucaaauuaacauaucaaaauaaggucguuagggugcagcgcccuacuccccgaggaaccguaauggacauuaucucccggagagaucagagggguagcggccaaguggggacguacggacugaacaccuuuacaaauauggaagcgcaguugauccgccagauggagggcgaaggugucuucaaaaacauucagcaccucacugugaccgaggagguugcagugcaaaacuggcuggccagagucgggcgggaaaggcuaucucguauggcuauaucaggagacgauugcgugguaaagccacuugacgaucgauucgccaaugcacugacagcucucaacgacaugggcaaaauccgcaaggauauucagcagugggagcccaguaagggcuggaaugacuggacucagguuccuuuuugcucccaucacuuccaugaacugaucaugaaagaugggagaguguuggucgugccaugucggaaccaagacgaguuaauuggaagggcccgcaucagccagggugcuggcuggucucugagagaaaccgccugccucgggaagucguaugcacagauguggucacuuauguacuuucaccggagggaucugcgacuagcggccaaugcuauauguagcgccgugccgucccacuggguccccacgagucguacaaccuggucuauccaugcaaaacacgaguggaugacuacagaggacaugcugaccguuuggaacagaguguggauucgcgaaaauccuuggauggaggacaagacuccaguagaaagcugggaggaaauccccuaucucggaaaacgggaggaucaguggugcggcuccuugauuggucugaccucaagggcuacaugggccaagaacauccaagcagccauaaaucaggugagaagucuuauugggaacgaggaauacacggacuacaugccuucuaugaagcgcuuccggagggaggaagaggaagcgggaguccugugguga

SEQ ID NO: 14876 - RNA, 9876 nt, Artificial Sequence
  derived and/or modified CDS sequence (opt3) from DENV-2__EU482463__SS-prME
agcgccggcaugaucauuaugcugauaccaaccgugauggcuuuccaccucacuacuagaaauggggagccucauaugaucgucuccauucaggaaaaggggaaaucucuucuguuuaagacggaggacgguguuaauaugugcaccuugauggcgauggauuuaggcgaacugugugaggacacuaucacuuacaaaugcccacuacucaggcaaaacgaaccggaggauauugacuguuggugcaauucaaccaguacgugggugaccuaugggacuuguacaaccacgggagagcaccggcgcgaaaagcgaagcguagcccuggugccacaugucggcaugggucuugagacucguaccgaaacauggauguccucugagggggcguggaaacacgcucagagaaucgagacuuggauacugaggcauccuggauucaccaucauggccgcaauuuuggccuacacaaucggcaccacgcacuuucagcgggugcucauuuucauccugcugacugcuguugcaccaucgaugacaaugcgcugcauaggcauuucaaacagagauuuuguggaaggggucagcggagguaguuggguggacaucguacucgagcacggcuccuguguuaccacuauggccaagaauaagcccacauuagauuucgaacugauuaaaaccgaggcuaagcagccugccacgcuuaggaaauauugcaucgaagcgaaguugaccaacacaacuaccgagucucgguguccaacacaaggggagcccagccugaaagaagaacaagacaagcgcuuugugugcaagcauuccauggucgaucgaggauggggcaaugguugugggcuauucggaaaaggcggcaucgugacuugcgcaauguuuaccugcaagaaaaacauggaagggaagauugugcagccugagaaucucgaauacacaauagucguuaccccacacucaggagaggagcaugccguggguaacgacacuggcaaacacgggaaggaaaucaaaguaacgccgcagaguagcauuacagaggcugaacugaccggauauggcacugugaccauggaguguucucccagaacaggucuugauuucaaugaaaugguccuguugcaaauggagaacaaggccuggcucgugcacaggcagugguuucuggacuuaccucugccauggcuccccggggcagauaagcaggaguccaauuggauccagaaagaaacccuuguuacuuucaagaacccucaugcuaaaaagcaagacguggucgugcugggcucacaggagggagccaugcacacagcguugacgggcgccaccgaaauacagaugagcagugggaaucuacuguuuacuggacaucucaaaugccggcugcguauggacaaacuucaacugaaggguaugucuuacuccauguguacaggcaaauucaagguaguuaaagagauugcagagacccagcacgggacaaucgugauccgcguccaguaugaaggagauggcagcccaugcaagauucccuucgagaucauggacuuggagaagcgguacgugcucgguaggcugauuacugucaacccgauagugaccgagaaggauucgccuguuaacaucgaagcugagcccccauuuggggacucuuacauuaucaucggcguggagccuggacaguuaaagcugaauugguucaaaaagggcuccucaauugggcaaauguuugaaacgaccaugcggggagccaaacgaauggcuauacuaggugauacagccugggacuucggcagucucgggggaguauuuacuagcaucggcaaggcacugcaucaggucuucggugccauuuauggggcugcguuuuccggcgugucuuggaccaugaaaauccuuauuggaguuaucauaacauggaucggcaugaacagccgcucaacaaguuuguccgugagccugguccucguggggauuguaacccuguaccuuggagugaugguucaggcagauucuggcugugucgugucauggaagaauaaggagcugaaaugcgguagugggaucuucauuacggacaacgugcacacauggaccgaacaguauaaguuucaacccgagagcccauccaaauuggccucugcuauccagaaggcccaggaagagggaauauguggcauuagaucggucacuaggcucgagaaucugauguggaaacagaucacacccgaauuaaaccacauucuggcagagaaugaaguuaagcuaaccaucaugacuggugauauacggggcaucaugcaagccgggaaacgcagccucagaccucagccaaccgagcugaaguacuccuggaagacauggggaaaagcuaagaugcuuucaacggaaaguuauaaccagaccuucuugauugacggcccggagacugccgagugccccaauacaaacagggcauggaacucucuggaaguggaggauuacggguuuggaguguucaccacaaacaucuggcucaaacugaaggaaaaacaggacgcguuuugugacagcaaguuaauguccgcugccauuaaggauaaucgugcaguacaugccgacaugggcuauuggaucgagucagcucugaacgauacuuggaaaauagagaaggccagcuucauugaagucaaaaauugccacuggccuaagucucauacccuuugguccaacgguguguuggagagugaaaugaucauccccaaaaaucucgcagggcccguuagccaacacaauuaccggccuggauaccacacgcagauugcuggcccauggcaucuggguaagcuagagauggacuucgauuuuugugacggcacaaccgugaucgucacugaagauugcgggaaccgaggacccucucugagaaccacaacugccuccggcaagcucauuaccgaguggugcuguaggucaugcacacugccgccucuucgcuauagaggggaagacggauguugguacggcauggaaauaagaccauugaaagagaaggaagagaaucuggugaacaguuuaguuacggcgggucacggacagguggauaauuucagccucggaguacugggcauggcccuuuuucuggaagagauguugaggacccgcgucgguacuaaacaugcuauccuccugguggcagugucguucgucacacuaauuaccggcaacauguccuuuaaggaccuggggcgaguugugguaauggugggagccacuauggcugaugacaucggcaugggggucacauaucucgcccugcuugcagcguucaaagugcggcccaccuuugccgcuggauugcuguuacguaagcucacgucuaaggagcugaugaugacuaccauuggcaucguucuucugagccaaucaacaauaccugaaaccgugcuagagcucacugaugcccuggcauuggguaugaugguccugaaaaucgugagaaauauggaaaaguaccaguuagcuguuacaauuauggccauccucugcgugcccaacgcagucauucugcagaaugccuggaaaguaaguuguaccauccuugcugugguuuccgugucuccacuguugcucacaagcucccagcaaaagacugacuggauaccucuggcgcuaaccauuaaagggcugaaccccacggccaucuuccuuacaacccucucaaggacuaauaagaaacgcagcuggccacugaacgaggcaaucauggcugucggaauggugaguauuuuggccucuucccuguuaaagaaugacauaccgaugaccggcccucucguagccggcgggcugcuuacagugugcuauguccugacuggacggagcgcugauuuggaacucgagagagcaaccgacguuaagugggaggaucaggccgaaaucucggguucaucucccauucugaguaucacgauuuccgaggacggcagcaugucuaucaaaaacgaagaggaggaacagacacuaaccauacugaucaggacugggcuucucgugauuagcggacuguuuccaaucuccauucccaucacagcggcugccugguacuugugggaggugaagaaacagcgagcaggcgucuuaugggaugugccuucaccacccccuauggguaaggccgaacuggaggacggggcuuaucgcauaaaacaaaaggggauucucggcuacagucagaucggcgcagggguuuacaaggaaggaaccuuccacacuauguggcauguaacacggggugccgugcugaugcacaaaggcaagagaaucgagccgagcugggcggaugucaaaaaggaccuuauuucuuaugggggaggcuggaaacuggagggugaauggaaggagggggaagaggugcagguuuuggcucuagaaccaggaaagaaucccagggccgugcagaccaaaccuggccuguuuaagacgaacacuggcaccaucggggcagucucccucgauuucucaccaggaacaagugguagccccauaauugacaaaaagggcaaagugguagggcuguacggaaacggcgucgugacccguuccggugccuauguuucugcuaucgcccaaacagagaagucgauugaggauaauccugaaaucgaggacgauauauuucgcaagcggagacuuacuauuauggacuuacacccgggggcaggaaaaaccaagagguaccugcccgcuaucgugcgagaagccaucaaacggggccuccgcacguugauucuggcgccaacaagagucguggccgcagagauggaagaggcucucaggggccugccuauccgguaucagacucccgccauucgagcugagcauaccgggagagaaauaguugaccuuaugugucacgcaacauucaccaugcgccuguugagcccagugagggucccuaacuacaaucuaaucauuauggaugaggcccauuucacugaccccgccucaaucgcugcgcguggauauaucuccacccggguggaaaugggugaggcagccggcauuuuuaugacagcuacgccaccggggaguagagauccuuucccccagucuaacgccccaauaaucgacgaggaaagggagauucccgaacgcagcuggaacuccggacacgaguggguaacugauuuuaagggcaaaaccgugugguucguuccuucaaucaaggcagguaacgacauugccgcuugccugcgaaagaaugggaaaaaggucauccaacucucuagaaaaacauuugauagcgaauacgugaagacccggacuaacgacugggauuucguggucacaaccgacauaagugagaugggagcgaauuuuaaagccgagaggguaaucgauccacgccguuguaugaagcccgugauuuuaacggacggcgaagagagaguuauccuggcaggcccuaugccggugacucauuccagcgcugcccagcggagggggcgcauuggacgaaaccccaaaaaugaaaacgaccaguacaucuauaugggugagccccuugaaaaugaugaggacugcgcacacuggaaggaggccaagaugcugcucgauaacauaaauacaccugaaggcauuauccccucuauguucgagccagaaagagagaaagucgacgcuauugauggggaauaccgguugaggggagaggcccgcaagaccuuuguggaccugaugagaaggggcgaucucccuguuuggcuggcguauaaaguggcagccgaggguaucaacuacgcugaccggcguugguguuucgaugggauaaagaacaaucagauccuugaagagaacgucgaaguggagauuuggaccaaagagggcgaacgcaagaagcuaaaaccccgauggcuggacgccagaaucuauucagauccauuggcuuuaaaggaguuuaaagaguucgcagccggaaggaagucccugacucucaaucugauuacagagaugggccggcuuccuaccuucaugacacagaaaacucgcgacgcucuggauaaccucgccguauugcacacggcagaagcaggagggagggcauacaaucaugcucugagugagcuaccggagacccuggaaacacuccuucuguuaacuuugcuggccaccgugacagguggcaucuuucucuuccugaugagcgggaggggaauaggcaagaugacccuugguaugugcugcauuaucacugcaucgauccugcucugguaugcucagauucagccccacuggaucgccgcaucuauaauuuuggaguuuuuccugaucguuuuacuaauuccagaaccugagaagcagcggacgccccaagacaaccagcugaccuacgucgugaucgccauacucacaguggucgcugcgacuauggccaaugaaaugggguuucuugagaaaaccaagaaagaccugggcuugggauccaucgcaacacagcagccagagagcaacauucuggauaucgaccuccgaccugcuucagccuggacccuguacgccguugcaacuacauucgugacgcccaugcuuagacauaguauugaaaauucuuccguaaacgugagccucaccgcuaucgccaaucaagcgacuguccugaugggcuuggggaagggauggccgcugucaaaaauggauauuggugugccauuacuagcuaucggcuguuauagucagguuaacccuauaacacugaccgccgcacuccuucuguugguggcccacuacgcuauuaucgggcccggacugcaggcaaaggccacccgcgaggcgcagaagagggcugccgcaggcaucaugaaaaauccaacagucgacgguauuacuguaauagaucucgaccccaucccuuaugauccgaaguuugaaaaacaacugggacaggugaugcuuuuaauucugugcguuacacaggugcucaugaugcggaccacaugggccuugugugaggcucugacucuagccaccggccccaucagcacacugugggaaggaaacccaggccguuucuggaauaccacuauugcagucuccauggcuaacaucuuuagagggucuuaccucgccggagcgggccuucuguucagcauaaugaagaauacgacaaacaccaggcgcgguacugggaacaucggagagaccuugggcgagaaauggaagucccggcugaaugcccucgguaaaucagaauuucaaauuuauaagaagucuggcauccaggagguggaccgaacacuggcaaaagaagggauuaagagaggagagacugaucaccaugcugucaguaggggcucggccaaauuacgcugguucguggagcggaacaugguuaccccugaagggaaggugguagaccuuggaugcggcagagguggguggagcuacuauuguggaggccugaaaaaugugcgugaggucaagggucucacaaagggcgggcccggacacgaggaaccuaucccaauguccacguacggcuggaaccuaguuaggcugcagucugggguggaugucuuuuucauacccccugaaaaaugcgacaccuugcugugugauauuggagagucaagcccaaaucccacuguggaggcaggccggacacuccgcguacuuaaccugguggaaaauugguugaacaauaacacccaguucugcaucaagguucugaauccguacaugccuuccgugaucgagaaaauggaagcucuccaacgaaaguaugguggggccuuagucagaaacccacugaguagaaauucuacucaugagauguacugggugagcaacgccucaggaaauauugucuccagugugaacaugauaagccggaugcuuaucaaccgcuuuacaaugagacacaaaaaggcgaccuaugaacccgacguugaccugggcucuggcacgaggaauauugggaucgaguccgagaagccuaaccuagauauuaucggaaaacgaauagaaaagaucaaacaggagcaugaaaccucauggcacuacgaccaggaucacccauauaagacaugggcuuaccaugguagcuaugagacuaaacagaccggcucggcaucuaguaugguaaauggggugguccggcuccugacaaagcccugggacguguugccgacuguuacccaaauggccaugacagauaccacuccuuucggacagcagcguguguuuaaggaaaaagucgacacgagaacacaggagcccaaggagggcaccaaaaagcugaugaaaauuacugcugaauggcucuggaaggagcuugguaaaaagaagaccccacgcauguguacaagggaagaguucacgcggaaagugagauccaacgccgcacugggggccaucuuuaccgaugagaauaaguggaaaagcgcucgcgaagcgguagaggacucaagguucugggaauuaguggauaaggagcgaaaccugcacuuggaaggaaaaugcgagacuuguguuuacaauaugaugggcaagcgggagaagaaacucggcgaauuugggaaggccaaaggauccagagcaauuugguacauguggcugggugcuagguuccuagaguuugaagcccuuggcuuccugaacgaggaccauugguuuucucgcgaaaauagccucaguggggucgagggagagggccugcacaaguuggguuauauccugcgugauguguccaaaaaggaagggggagcaauguacgccgacgacacagcuggcugggauacccggauuacucucgaggaccuuaagaacgaagagauggugacaaaucacauggaaggcgagcauaaaaagcuggccgaggcgauauucaaauuaaccuaucaaaacaaggucguuagagugcagaggccuacaccccgcgggacuguaauggauaucauuagccgacgggaccagagaggaucuggucaagugggcaccuacgggcugaauacguuuaccaacauggaagcacaguugaucaggcagauggagggagaaggcgucuucaaaaauauccagcaccucacagugacugaggagguugccgugcauaacuggcuggcucgcgucgguagagaacggcuaucaaggauggccauuaguggggaugacugcgugguaaagccacuugaugaccguuucgcaaacgcucugaccgcccucaaugauaugggaaagauacgaaaagacauccaacagugggagcccuccaagggcuggaacgauuggacacagguuccuuuuugcagccaccauuuccacgaacugauuaugaaagacggccgcguguuggucgugccauguagaaaucaggaugaguuaaucgggcgggcuaggauuucucaaggagccgguuggucgcugcgcgaaacugcaugccucggcaagucauaugcgcagauguggagccuuauguacuuucacagacgggaccugaggcuagccgcuaacgccaucuguuccgcagugccgagucauuggguccccaccucucgaacgacauggagcauacacgcuaaacaugaguggaugaccacugaggacaugcugacaguuuggaaucguguguggaucagagaaaacccuuggauggaggauaagaccccaguagaauccugggaggaaauucccuaucucgggaagcgcgaggaccaguggugcggaucauugaucggccugacaagucgggccaccugggccaaaaauauucaggccgcgaucaaccaagugaggucucuuauagguaaugaggaauacacagauuacaugccuagcaugaagagauuccgccgggaggaagaggaagcugggguccugugguga

SEQ ID NO: 14877 - RNA, 9876 nt, Artificial Sequence
  derived and/or modified CDS sequence (opt3) from DENV-2__EU482464__SS-prME
agcgccggcaugauaauuaugcugauacccaccgugauggcuuuccaccucacuacuagaaacggggagccucauaugaucgucgguauucaagaaaaaggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacuacagagugccccaauaccaacagagccuggaauagucuggaaguggaggauuacggauuuggcguguucacaacuaacaucuggcucaagcugaaagaaaagcaggacgcauuuugugacucuaaguuaaugagcgcggcuauuaaagauaauagggccguacaugcagacauggguuauuggaucgaguccgcccugaacgauaccuggaagauagagaaggcuucauucauugaagucaagaauugccacuggccuaaaagccauacgcuuuggucuaacgggguguuggaguccgaaaugaucaucccaaagaaccucgccggacccguuagucaacacaauuaccguccuggcuaccacacacagauugcagguccauggcaucugggcaagcuagagauggacuucgauuuuugugacgggaccacugugaucgucaccgaagauugcggaaaccggggccccagccugcgaacaacuaccgcuucugggaaacucauuacagaguggugcuguagauccugcacgcugccgccucuuagguaucgcggagaggacggcuguugguacgguauggaaauacggccauugaaggagaaagaagagaaucuggugaacucauuaguuaccgccgggcacggacagguggauaauuucagucucggcguacuggguauggcgcuuuuucuggaagagauguugagaacuagggucggcacaaagcaugccauccuccugguggcugugagcuucgucacccuaauuacugggaacaugucguuuaaagaccugggacgcguugugguaauggugggcacaaccauggcagaugacaucgggaugggagucacguaucucgcccugcuugcugccuucaaggugcgacccacuuuugcagcgggcuugcuguuacggaagcucaccuccaaagagcugaugaugacaaccauugguaucguucuucugucucaaagcacuauaccugaaacagugcuagagcucaccgaugcccuggcuuuggggaugaugguccugaagaucgugcguaauauggaaaaauaccaguuagccguuacaauuauggcaauccucugcgugcccaacgcugucauucugcagaaugccuggaagguaucauguacuauccuugcagugguuaguguguccccacuguugcucaccucuagccagcagaaaacggacuggauaccucuggcccuaacaauuaagggacugaaccccaccgcuaucuuccuuacuacccucuccagaacaaauaaaaagaggucauggccacugaacgaggcgaucauggccgucggcauggugagcauuuuggcaaguucucuguuaaagaaugacauaccgaugacuggcccucucguagcugggggacugcuuaccgugugcuauguccugacgggucgcuccgccgauuuggaacucgagcgggccacagacguuaaaugggaggaucaggcugaaaucagcggcucgucacccauucugucuaucaccauuagugaggacggguccaugagcaucaagaacgaagaggaggaacagacucuaacaauacugaucagaaccggacuucucgugauuucuggccuguuuccaaucagcauucccaucacugcagccgcgugguacuugugggaggugaaaaagcagagggcuggugucuuaugggaugugccuuccccacccccuauggggaaagccgaacuggaggacggagcauaucgaauaaagcaaaagggcauucucggcuacucacagaucggggccggaguuuacaaagaagguacauuccacaccauguggcauguaacgcgcggcgcugugcugaugcacaaggggaaacggaucgagccgaguugggcagaugucaagaaagaccuuauuagcuauggaggcgguuggaagcuggagggggaauggaaggagggagaagaggugcagguuuuggcccuagaaccaggcaaaaaucccagagcggugcagacuaagccuggccuguuuaaaaccaacacagggaccaucggagcugucucucucgauuucuccccagguacaucaggcagucccauaauugacaagaaagggaaggugguaggacuguacggcaacggugucgugacuaggagcggggccuauguuuccgcaaucgcccaaaccgagaagucuauugaggauaauccugaaaucgaggacgauauauuucguaaacgccggcuuacgauuauggacuuacacccgggagcuggcaagacaaaaagauaccugcccgccaucgugagggaagcaaucaagcgaggccuccggacuuugauucuggcuccaacccgcgucguggccgcggagauggaagaggcccucagagggcugccuaucagguaucagacacccgcaauucgggcugagcauaccggacgagaaauaguugaccuuaugugucacgccacuuucaccaugagacuguugucgccagugcgcgucccuaacuacaaucuaaucauuauggaugaggcucauuucacagaccccgcaagcaucgccgccagggguuauaucucaacgcguguggaaaugggcgaggcugcggggauuuuuaugacugcaaccccaccgggaucccgggauccuuucccccagaguaacgccccaauaaucgacgaggaaagagagauucccgaaaggucuuggaauagcggccacgaguggguaacagauuuuaaagguaagaccgugugguucguuccuuccaucaaggcugggaacgacauugccgcaugccugcgcaaaaauggaaagaaagucauccaacucucacgaaagacuuuugauucugaauacgugaaaacaagaaccaacgacugggauuucguggucacgacugacauaagcgagaugggcgccaauuuuaaggcugagcggguaaucgauccaaggcgcuguaugaaacccgugauuuuaacagacggcgaagaacguguuauccuggcggggccuaugccggugacccauaguuccgccgcacagagacggggaaggauuggucgcaacccaaagaaugaaaacgaccaguacaucuauaugggcgagccccuugaaaaugaugaggacugcgcucacuggaaggaggccaaaaugcugcucgauaacauaaauaccccugaagggauuauccccagcauguucgagccagaacgagagaaggucgacgcaauugauggagaauacagauugcggggcgaggccaggaaaacuuuuguggaccugaugcgcagaggugaucucccuguuuggcuggcuuauaagguggccgcggaggggaucaacuacgcagacaggcggugguguuucgauggcaucaaaaacaaucagauccuugaagagaacgucgaaguggagauuuggacaaaggagggagaacguaagaaacuaaagccccgcuggcuggacgcccgaaucuauucugauccauuggcuuuaaaagaguuuaaggaguucgccgcuggcagaaaaucacugacccucaaucugauuacagagauggggaggcuuccuacuuucaugacgcaaaagacccgggacgcacuggauaaccucgccguauugcacacagcugaagccggaggucgcgcauacaaucaugcgcuguccgagcuaccggagacucuggaaacccuccuucuguuaacauugcuggccaccgugacuggcgggaucuuucucuuccugaugaguggaagaggcauagguaagaugacgcuugggaugugcugcauuaucaccgcuagcauccugcucugguaugcccagauucagccccacuggaucgcagcuucgauaauuuuggaguuuuuccugaucguuuuacuaauuccagaaccugagaaacagaggacaccccaagacaaccagcugacuuacgucgugaucgccauacucaccguggucgcagccacaauggcuaaugaaaugggcuuucuugagaagaccaaaaaggaccugggauugggcucuaucgcgacucagcagccagaguccaacauucuggauaucgaccuccggccugccagcgcauggacacuguacgcuguugccacgaccuucgugacucccaugcuucgacauucaauugaaaauaguucuguaaacgugucccucacagccaucgcaaaucaagcuaccguccugaugggguugggaaaagguuggccgcugagcaagauggauauuggcgugccauuacuagccaucggguguuauucacagguuaacccuauaacccugacagcggcucuccuucuguugguggcccacuacgcaauuaucggacccggccugcaggccaaggcuacuagagaggcacagaaacgcgccgcggcugguaucaugaagaauccaacggucgacgggauuaccguaauagaucucgaccccaucccuuaugauccgaaauuugaaaagcaacugggccaggugaugcuuuuaauucugugcguuacacaggugcucaugaugaggacuaccugggccuugugugaggcacugacacuagccaccggacccaucaguacucugugggaaggcaacccagggcgguucuggaauacgacaauugcugucagcauggccaacaucuuucguggauccuaccucgcaggcgcuggucuucuguucucuauaaugaaaaauaccacuaacaccagaagggggacaggaaacaucggcgagacuuugggugagaaguggaaaagccgccugaaugcccucggcaaguccgaauuucaaauuuauaagaaaucagggauccaggagguggaccggacccuggcgaaggaaggaauuaaacgaggcgagacagaucaccaugccgucucuagagggagugcaaaguuaaggugguucguggagcgcaacaugguuacgccugaaggaaaagugguagaccuuggcugcgguagagggggauggucguacuauuguggcggucugaagaaugugagagaggucaagggccucaccaaagggggacccggccacgaggaaccuaucccaaugagcacuuacggguggaaccuaguucgucugcaguccggaguggaugucuuuuucauacccccugaaaagugcgacacauugcugugugauauuggcgagucuucaccaaaucccaccguggaggcugguaggacucuccggguacuuaaccugguggaaaauugguugaacaauaacacacaguucugcaucaaaguucugaauccguacaugccuagcgugaucgagaagauggaagcccuccaacgcaaauaugggggagcauuaguccgaaacccacuguccagaaauaguacccaugagauguacugggugucuaacgcuagcggcaauauugucucauccgugaacaugauaaguaggaugcuuaucaaccgguuuacgaugcgccacaagaaggccaccuaugaacccgacguugaccugggcagcgggacaagaaauauuggaaucgagucugagauuccuaaccuagauaucauagguaaaaggaucgaaaagauuaaacaggagcaugaaacuuccuggcacuacgaccaggaucacccauauaagaccugggccuaccauggcucauaugagacaaaacagacugggagcgcgucgucuaugguaaauggagugguccgacuccugaccaagcccugggacguguugccgacaguuacccaaauggcuaugacugauacgacaccuuucggccagcagcggguguuuaaggaaaaagucgacacccguacucaggagcccaaggaggguaccaaaaagcugaugaaaaucacagcagaauggcucuggaaggagcuugggaaaaagaagacgccaagaauguguacccgcgaagaguucacuaggaaagugcggaguaacgccgcucugggagccauuuuuacagaugagaauaaguggaaauccgcaagagaagccguagaggacagccgcuucugggaauuaguggauaaggagaggaaccugcacuuggaaggcaaaugcgagaccuguguuuacaauaugaugggcaagcgagagaagaaacucggggaauuuggaaaggcuaaagguucacgggcgaucugguacauguggcugggcgccagauuccuagaguuugaagcacuuggguuccugaacgaggaccauugguuuuccagggaaaauucucucagcggagucgagggcgagggucugcacaaguugggguauauucugcgcgaugugaguaaaaaggaaggaggcgcuauguacgccgacgacacugcaggcugggauacacguauaacccucgaggaccuuaagaacgaagagauggugacaaaucacauggaaggggagcauaaaaagcuggccgaggcuaucuucaaauuaacuuaucaaaacaaggucguucgggugcagagaccuacccccaggggaacgguaauggauauuaucucccgccgagaccagcgggguagcggccaaguggggaccuacggacugaauacauuuacuaacauggaagcccaguugaucagacagauggagggcgaaggugucuucaaaaauauucagcaccucaccgugacagaggagguugcggugcaaaacuggcuggcaagggucgggcgcgaaagacuaucucggauggccauaucaggagaugacugcgugguaaagccacuugaugacagguucgcuaacgcccuggcagcucucaaugauaugggcaagauccguaaagacauucagcagugggagcccaguaagggcuggaacgauuggacucagguuccuuuuugcucccaucacuuccaugaacugaucaugaaagacgggcgaguguuggucgugccaugucgcaaucaagaugaguuaauuggacgggcccggaucagccagggugcuggcuggucucugagggaaaccgccugccucgggaagucguaugcacagauguggucacuuauguacuuucaccgcagagaccugcggcuagcggccaacgcuauauguagcgccgugccgucccacuggguccccacgaguaggacaaccuggucuauccaugcaaaacacgaguggaugacuacagaggacaugcugaccguuuggaaucgaguguggauucgugaaaacccuuggauggaggauaagacuccaguagaaagcugggaggaaauccccuaucucggaaagagagaggaccaguggugcggcuccuugauuggucugaccucacgcgcuacaugggccaaaaauauccaagcagccauaaaccaggugcggagucuuauugggaaugaggaauacacggauuacaugccuucuaugaagagguucagacgcgaggaagaggaagcgggaguccugugguga

SEQ ID NO: 14878 - RNA, 9876 nt, Artificial Sequence
  derived and/or modified CDS sequence (opt3) from DENV-2__EU482465__SS-prME
agcgcaggcaugauaauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacaccaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuuaucugcaagcauagcaugguggaucgaggcugggguaauggguguggacuauucggcaaaggcgggauugucacuugcgcaauguuuaccugcaagaaaaacauggaaggaaagauagugcagccugagaaucucgaauacacaaucguggucaccccacacuccggugaggagcaugccguuggcaacgacacugggaaacacggaaaggaaauuaaagugacgccgcagucaaguaucacagaggcugaacugaccggcuaugguacuguaaccauggaguguagccccagaacagggcuugauuucaaugaaauggugcuguugcaaauggagaacaaggccuggcucguccacaggcagugguuucuggacuuaccucugccauggcuccccggcgcagauaagcaggagucuaauuggauacagaaagaaacccuugugacuuucaagaacccucaugcuaaaaagcaagacguugugguccugggaucccaggagggcgccaugcacacagcguugacgggggccaccgaaauucagaugucaagcggaaaucuacuguuuacuggucaucucaaaugccggcugcguauggacaaacuucaacugaagggcaugaguuacucuauguguacagggaaauucaaggugguaaaagagaucgcagagacccagcacggaacaaucguuauucgcgugcaguaugaaggcgaugguuccccaugcaagauccccuucgagauuauggacuuggagaagagauacguccucgggaggcugauaacugugaacccgaucgucaccgagaaggauagcccugugaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacaaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggcccaggaagagggcauuugugguaucagaucugugacuaggcucgagaaucugauguggaaacagauuacacccgaauuaaaccacauccuggcagagaaugaagucaagcuaaccauaaugacuggcgauaucaaagggauuaugcaagccggaaagcggucgcuccgcccucagccaaccgagcugaaguacagcuggaaaacauggggcaaggcuaaaaugcuuuccacggaaucauauaaccagaccuucuugaucgacgggccggagacugccgagugccccaauacaaacagagcauggaauagucuggaaguugaggauuacggauuuggcguguucaccacaaacauuuggcucaagcugaaagaaaagcaggacgcguuuugugacucuaaguuaaugagcgcugccaucaaagauaauagggcagugcaugccgacauggguuauuggauagaguccgcucugaacgauacuuggaagauugagaaagccucauucaucgaaguaaagaauugccacuggccuaaaagccauacccuuuggucuaacggggucuuggaguccgaaaugaucauuccaaagaaccucgcaggacccgugagucaacacaauuaccguccuggcuaccacacgcagaucgcugguccauggcaucugggcaagcuagagauggacuucgauuuuugugacgggacaaccguuauugugacugaagauugcggaaaccggggccccagccugcgaaccacaacugccucugggaaacucauaaccgaguggugcuguagauccugcacacugccgccucuuagguaucgcggagaggacggcuguugguacgguauggaaauccggccauugaaggagaaagaagagaaucuggucaacucauuagugacggcggggcacggacagguugauaauuucagucucggcgugcuggguauggcccuuuuucuggaagagauguugagaaccaggguaggcacuaagcaugcuauucuccuggucgcagugagcuucgugacacuaaucaccgggaacaugucguuuaaagaccugggacgcgucguugugaugguaggcgccacuauggcugaugacauugggaugggagugacauaucucgcccugcuugcagcguucaagguccgacccaccuuugccgcuggcuugcuguuacggaagcucacguccaaagagcugaugaugacuaccaucgguauagugcuucugucucaaagcacaaucccugaaaccguucuagagcucacugaugcccuggcauuggggaugauggugcugaagauuguccguaauauggaaaaauaccaguuagcugugacaaucauggccauucucugcguucccaacgcagugauccugcagaaugccuggaaggucucauguaccauacuugcuguagugaguguuuccccacuguugcucacaucuagccagcagaagacugacuggauuccucuggcgcuaaccaucaagggacugaaccccacggccaucuuccuuacaacccucuccagaacuaauaaaaagaggucauggccacugaacgaggcaauuauggcugugggcauggucagcauauuggccaguucucuguuaaagaaugacaucccgaugaccggcccucucguggccgggggacugcuuacaguaugcuaugugcugacuggucgcuccgcugauuuggaacucgagcgggcaaccgacgucaaaugggaggaucaggccgaaauuagcggcucgucacccauccugucuauuacgaucagugaggacggguccaugagcauaaagaacgaagaggaggaacagacacuaaccauccugauuagaacuggacuucucguuaucucuggccuguuuccaauuagcauccccauaacagcggcugccugguacuugugggaggugaaaaagcagagggccgguguguuaugggaugucccuuccccacccccuauggggaaagccgaacuggaggacggagcuuaucgaauuaagcaaaagggcauccucggcuacucacagaucggggcaggaguguacaaagaagguaccuuccacacuauguggcauguuacacgcggcgccguacugaugcacaaggggaaacggauugagccgaguugggcggaugugaagaaagaccuuaucagcuauggaggcgguuggaagcuggagggggaauggaaggagggagaagagguccagguguuggcucuagaaccaggcaaaaaucccagagccguucagaccaagccuggccuguuuaaaacgaacacugggaccauaggagcagugucucucgauuucuccccagguacaucaggcagucccauuaucgacaagaaagggaaggucgugggacuguacggcaacgguguagucaccaggagcggggccuauguguccgcuauugcccaaacagagaagucuacugaggauaauccugaaaucgaggacgauauauuucguaaacgccggcuuaccauuauggacuuacacccgggagcaggcaagacgaaaagauaccugcccgcuaucguuagggaagccaucaagcgaggccuccggacauugauucuggcgccaacucgcguggucgccgcagagauggaagaggcucucagagggcugccuaucagguaucagacccccgccauucgggcugagcauacaggacgagaaauaguggaccuuaugugucacgcaaccuucacuaugagacuguugucgccaguucgcgugccuaacuacaaucuaaucauuauggaugaggcccauuucaccgaccccgccagcaucgcugcgagggguuauaucucaacacgugucgaaaugggcgaggcagccgggauuuuuaugacggcuacuccaccgggaucccgggauccuuucccccagaguaacgccccaauaaucgacgaggaaagagagauucccgaaaggucuuggaauagcggccacgagugggugaccgauuuuaaagguaagacaguaugguucgugccuuccaucaaggcagggaacgacauugccgcuugccugcgcaaaaauggaaagaaaguuauccaacucucacgaaagaccuuugauucugaauacgucaaaacuagaacaaacgacugggauuucguggugaccacggacauaagcgagaugggcgcgaauuuuaaggccgagcgggucaucgauccaaggcgcuguaugaaacccguaauuuuaacugacggcgaagaacgugugauccuggcagggccuaugccgguuacacauaguuccgcugcccagagacggggaaggauuggucgcaacccaaagaaugaaaacgaccaguacaucuauaugggcgagccccuugaaaaugaugaggacugcgcacacuggaaggaggccaaaaugcugcucgauaacauaaauaccccugaagggauuauccccagcauguucgagccagaacgagagaagguggacgcuauugauggagaauacagauugcggggcgaggccaggaaaaccuuugucgaccugaugcgcagaggugaucucccuguguggcuggcguauaagguugcagccgaggggaucaacuacgcugacaggcggugguguuucgauggcaucaaaaacaaucagauccuugaagagaacguggaagucgagauuuggacuaaggagggagaacguaagaaacuaaagccccgcuggcuggacgcccgaaucuauucugauccauuggcuuuaaaagaguuuaaggaguucgcagccggcagaaaaucacugacacucaaucugauuaccgagauggggaggcuuccuacauucaugacucaaaagacgcgggacgcucuggauaaccucgccguguugcacaccgcagaagcgggaggucgcgccuacaaucaugcucuguccgagcuaccggagacacuggaaacucuccuucuguuaaccuugcuggccacaguaaccggcgggaucuuucucuuccugaugaguggaagaggcauagguaagaugacucuugggaugugcugcauuacgaccgcaagcauccugcucugguaugcucagauccagccccacuggauugccgcaucgaucauauuggaguuuuuccugauuguguuacuaaucccagaaccugagaaacagaggacaccccaagacaaccagcugacuuacguugucauugccauccucaccgugguggcugcgacaauggccaaugaaaugggcuuucuugagaagaccaaaaaggaccugggauugggcucuauagcaacucagcagccagaguccaacauccuggauauugaccuccggccugcuagcgccuggacacuguacgccgucgcaacgaccuucguuacucccaugcuucgacauucaaucgaaaauaguucugugaacguaucccucacagcuauugccaaucaagcgaccgugcugaugggguugggaaaagguuggccgcugagcaagauggauaucggcgucccauuacuagcuauuggguguuauucacaggugaacccuaucacccugacagccgcacuccuucuguugguugcccacuacgcuauaauuggacccggccugcaggcaaaggccacuagagaggcgcagaaacgcgcugccgcagguaucaugaagaauccaacgguggacgggaucaccgucauugaucucgaccccauaccuuaugauccgaaauuugaaaagcaacugggccagguaaugcuuuuaauccugugcgugacacagguucucaugaugaggacuaccugggccuugugugaggcucugacacuagccaccggacccauuaguacucugugggaaggcaacccagggcgguucuggaauacgacaaucgcagugagcauggcuaacauuuuucguggauccuaccucgccggcgcgggucuucuguucucuaucaugaaaaauaccacuaacaccagaagggggacaggaaacaugggcgagacuuugggugagaaguggaaaagccgccugaaugcccucggcaaguccgaauuucaaauauauaagcggucagggauccaggaggucgaccgaacccuggcaaaagaaggaauuaagagaggcgagacagaucaccaugcugugucuagggggagugccaaauuacgcugguucgucgagcggaacauggugacgccugaaggaaagguuguggaccuuggcugcgguagagggggauggucguacuauuguggcggucugaaaaauguacgugaggugaagggccucaccaaagggggacccggccacgaagaaccuaucccaaugagcacuuacggguggaaccuagucaggcugcaguccggaguugauguguuuuucauucccccugaaaaaugcgacacauugcugugugauaucggcgagucuucaccaaaucccaccgucgaggcaggucggacucuccgcgugcuuaaccugguagaaaauugguugaacaauaacacacaguucugcauaaaggugcugaauccguacaugccuagcguuauugagaaaauggaagcucuccaacgaaaguaugggggagccuuagugagaaacccacuguccaggaauaguacccaugagauguacugggucucuaacgccagcggcaauaucgugucauccgucaacaugaucagucggaugcuuauuaaccgcuuuacgaugagacacaaaaaggcgaccuaugaacccgacguggaccugggcagcgggacaaggaauauaggaaucgagucugagauuccuaaccuagauaucauugguaagcgaaucgagaaaauaaagcaggagcaugaaacuuccuggcacuacgaccaggaucacccauauaaaaccugggcuuaccauggcucauaugagacaaagcagacugggagcgcaucgucuaugguuaauggaguagugcggcuccugaccaaacccugggacgucuugccgacagugacccaaauggccaugacugauacgacaccuuucggccagcagcguguuuuuaaggaaaagguggacaccagaacucaggagcccaaagaggguaccaagaaacugaugaagaucacagcugaauggcucuggaaagagcuugggaagaaaaagacgccacgcauguguaccagggaagaguucacucggaaggucagaaguaacgccgcacugggagccauuuuuacagaugagaauaaauggaaguccgcucgcgaagcgguggaggacagcagguucugggaauuaguagauaaagagcgaaaccugcacuuggaaggcaagugcgagaccuguguguacaauaugaugggcaaacgggagaagaagcucggggaauuuggaaaagccaaggguucaagagcaaucugguacauguggcugggcgcuagguuccuagaguuugaagcccuuggguuccugaacgaggaccauugguuuucccgcgaaaauucucucagcggaguugagggcgagggucugcacaaauugggguauauucugcgugaugucaguaagaaagaaggaggcgcaauguacgccgacgacacugcuggcugggauacacggaucacccucgaggaccuuaagaacgaagagauggugacaaaucacauggaaggggagcauaagaaacuggccgaggcgauuuucaaguuaacuuaucaaaacaaaguggucagaguucagaggccuacaccccgcggaacggugauggauauaaucucccgacgggaccagagagguagcggccaaguagggaccuacggacugaauacauuuacuaacauggaagcacaguugauuaggcagauggagggcgaagguguguucaagaauauccagcaccucaccgucacagaggagguggccguucaaaacuggcuggcucgcguggggagagaacggcuaucuaggauggccaucucaggagaugacugcgucgugaaaccacuugaugaccguuucgcaaacgcucugacugcccucaaugauaugggcaagauucgaaaggacauacagcagugggagcccaguaaaggcuggaacgauuggacccagguaccuuuuugcucccaucacuuccaugaacugaucaugaaggacgggcgcguuuugguggucccauguagaaaucaagaugaguuaauuggacgggcuaggaucagccagggugccggcuggucucugcgcgaaacggcaugccucgggaaaucguaugcgcagauguggucacuuauguacuuucacagacgggaccugaggcuagccgcuaacgccauuuguagcgcagugccgucccacugggugcccacaagucgaaccacuuggucuauccaugcuaagcacgaguggaugacaaccgaggacaugcugacugucuggaaucguguuuggauaagagaaaacccuuggauggaggauaaaaccccaguggaaagcugggaggaaauccccuaucucggaaagcgcgaggaccaguggugcggcuccuugauuggucugacaucacgggccacgugggcaaagaauauccaagccgcgauuaaccagguaaggagucuuaucgggaaugaggaauacaccgauuacaugccuucuaugaaaagauuccgccgggaggaagaggaagcuggagugcugugguga

SEQ ID NO: 14879 - RNA, 9876 nt, Artificial Sequence
  derived and/or modified CDS sequence (opt3) from DENV-2__EU482466__SS-prME
agcgcaggaaugaucauuaugcugauacccaccgugauggcuuuccaccucacuacucggaacggggagccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucauccccaagaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucagagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccaacagaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaagugggaggaucaggccgaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagcggcugccugguacuugugggaggugaagaaacaaagggccggugucuuaugggaugugccuuccccacugcccauggggaaggccgaacucgaggacggagcuuaucgaauaaaacagaagggcauucugggcuacucacagaucggggcaggaguuuacaaggaagguaccuuccacacuauguggcauguaacacgcggcgccgugcuuaugcacaaagggaagcggaucgagccuaguugggcggaugucaaaaaggaccugauuagcuauggaggcgguuggaaauuggagggggaauggaaggagggagaagaggugcagguucuagcucuggaaccgggcaagaauccaagagccgugcaaaccaaacccggccucuuuaagacgaacacugggaccaucggagcagucucucuggauuucuccccugguacaucaggcaguccaauaauugacaaaaaggggaaagugguaggacuuuacggcaacggugucgugaccaggagcggggccuauguuuccgcuaucgcccagacagagaagucuauugaggauaaucccgaaaucgaggacgauauauuucguaagcgccgguuaacuauuauggaccugcacccuggagcaggcaaaaccaagagauaccucccggcuaucgugagggaagccaucaaacgaggcuugcggacgcugauucucgcgcccacacgcgucguggccgcagagauggaagaggcucugagagggcuuccaaucagguaucagacuccugccauucgggcugagcauaccggacgagaaauaguugaccugaugugucacgcaacauucaccaugagauugcuaucgcccgugcgcgucccaaacuacaaucugaucauuauggaugaggcccauuucacugacccugccagcaucgcugcgagggguuauaucucaacccguguggaaaugggcgaggcagccgggauuuuuaugacagcuacgcccccaggaucccgggauccguucccucaaaguaacgcccccauaaucgacgaggaaagagagauuccagaaaggucuuggaauagcggccacgaguggguaacugauuuuaaggguaaaaccgugugguucguucccuccaucaaggcagggaacgacauugccgcuugccuccgcaagaauggcaagaaggucauccaguuaucacgaaaaacauuugauucugaauacgugaagaccagaacuaacgacugggauuucguggucacaaccgacauaagcgagaugggcgcgaauuuuaaagccgagcggguaaucgauccuaggcgcuguaugaagccagugauucugacggacggcgaagaacguguuauccuugcagggcccaugccugugacucauaguuccgcugcccagagacggggaaggauuggucgcaacccgaaaaaugaaaacgaccaguacaucuauaugggcgagccacuggaaaaugaugaggacugcgcacacuggaaggaggccaagaugcucuuggauaacauaaauacacccgaagggauuaucccuagcauguucgagcccgaacgagagaaagucgacgcuauugauggagaauacagacugcggggcgaggccaggaagaccuuuguggaccucaugcgcagaggugaucugccaguuuggcuugcguauaaaguggcagccgaggggaucaacuacgcugacaggcggugguguuucgauggcauaaagaacaaucaaauccuagaagagaacgucgaaguggagauuuggaccaaagagggagaacguaagaagcugaaaccucgcugguuggacgcccgaaucuauucugaucccuuagcucugaaggaguuuaaagaguucgcagccggcagaaagucacucacucugaaucuuauuacagagauggggaggcugccaaccuucaugacacagaaaacucgggacgcucucgauaacuuggccguacugcacacggcagaagcgggaggucgcgccuacaaucaugcucuauccgagcugccugagacccucgaaacacuucuguuauugacucugcucgccaccgugacaggcgggaucuuucuguuccuuaugaguggaagaggcauagguaagaugacccuggggaugugcugcauuaucacugcaagcauccucuugugguaugcucagauucagccgcacuggaucgccgcaucgauaauucuggaguuuuucuuaaucguucuacugauucccgaaccagagaagcaaaggacgccucaggacaaccagcucaccuacgucgugaucgccauacuuacaguggucgcugcgacuauggccaaugaaaugggcuuucuggagaaaaccaagaaagacuugggacugggcucuaucgcaacacagcaacccgaguccaacauucucgauaucgaccugcggccagcuagcgccuggacccuuuacgccguugcaacuacauucgugacgccuaugcuccgacauucaauugaaaauaguucuguaaacgugucccugaccgcuaucgccaaucaggcgacugucuugauggggcugggaaaggguuggcccuuaagcaaaauggauauuggcgugccgcuacuggcuaucggguguuauucacagguuaacccaauaacacucaccgccgcacuucuguugcugguggcccacuacgcuauuaucggaccuggccuccaggcaaaggccaccagagaggcgcaaaagcgcgcugccgcagguaucaugaaaaaucccacagucgacgggauuacuguaauagaucuggacccaauccccuaugauccuaaguuugaaaaacagcuuggccaggugauguuacugauucucugcguuacgcaaguguugaugaugaggaccacaugggcccugugugaggcucuaacucuggccaccggaccgaucaguacacucugggaaggcaaccccgggcgguucuggaauaccacuauugcagucagcauggcuaacaucuuucguggauccuaccuugccggcgcgggucuguuguucucuauaaugaagaauacgacaaacaccagaagggggacuggaaacaugggcgagacccugggugagaaauggaaaagccgccucaaugcccugggcaaauccgaauuucagaucuauaagaagucagggauucaggagguggaccggacauuagcaaaagaaggaaucaagcgaggcgagacugaucaccaugcugucucuagagggagugccaaacuuaggugguucguggagcgcaacaugguuaccccagaaggaaaggugguagaccugggcugcgguagagggggauggucguacuauuguggcggucucaaaaaugugagagaggucaagggccuaacaaaagggggaccuggccacgaagaaccaauuccuaugagcacguacggguggaaccugguucguuugcaguccggaguggaugucuuuuucaucccacccgaaaaaugcgacacccugcucugugauauaggcgagucuucaccuaauccaacuguggaggcagguaggacacuucggguacugaacuugguggaaaauuggcugaacaauaacacccaauucugcauuaagguucucaaucccuacaugccgagcgugaucgagaaaauggaggcuuuacagcgcaaguaugggggagcccugguccgaaacccucuuuccagaaauaguacucaugagauguacugggugucuaacgccagcggcaauaucgucucauccgugaacaugauuaguaggaugcugauaaaccgguuuacaaugcgccacaaaaaggcgaccuaugaaccagacguugaccuaggcagcgggacgagaaauaucggaauugagucugagacccccaaccucgauaucauugguaagaggaucgagaaaauaaagcaggagcaugaaacauccuggcacuacgaccaggaucacccuuauaaaacuugggcuuaccauggcucauaugagaccaagcaaacagggagcgcaucgucuaugguaaauggagugguccgacuguugacuaaaccaugggacgugcugcccaccguuacacagauggccaugaccgauacuacgccguucggccagcagcggguguuuaaggaaaaggucgacacacguacccaagagccuaaagaggguacuaagaaacucaugaagaucaccgcugaauggcuuuggaaagagcuggggaagaaaaagacacccagaauguguacgcgcgaagaguucaccaggaaggugcggaguaacgccgcauuaggagccauuuuuacugaugagaauaaauggaaguccgcuagagaagcgguagaggacagccgcuucugggaacugguggauaaagagaggaacuugcaccucgaaggcaagugcgagacauguguuuacaauaugaugggcaaacgagagaagaagcugggggaauuuggaaaagccaaggguucacgggcaaucugguacauguggcuaggcgcuagauuccuugaguuugaagcccugggguuccucaacgaggaccauugguuuuccagggaaaauucucugagcggagucgagggcgaggguuugcacaaacugggguauauucuccgcgaugugaguaagaaagaaggaggcgcaauguacgccgacgacaccgcuggcugggauacucguaucacacuugaggaccugaagaacgaagagauggugaccaaucacauggaaggggagcauaagaaauuagccgaggcgauuuucaagcugacauaucagaacaaagucguucgggugcagagaccaacuccuaggggaaccguaauggauauaaucucccgccgagaccaacgggguagcggccagguggggacguacggauugaauaccuuuacaaacauggaagcacagcucauuagacagauggagggcgaaggugucuucaagaauauccaacaccugacugugaccgaggagguugccgugcagaacuggcuagcuagggucgggcgcgaaagacuuucucggauggccaucucaggagaugacugcgugguaaaaccccuggaugacagguucgcaaacgcucucacagcccugaaugauaugggcaagauucguaaggacauacagcagugggagccaaguaaaggcuggaacgauuggacucaaguucccuuuugcucccaucacuuccaugaauugaucaugaaggacgggcgaguguuagucgugccuugucgcaaucaggaugagcugauugguagagcucggaucagccagggagccggcuggucucucagggaaaccgcaugccuugggaaaucguaugcgcagauguggucacugauguacuuucaccgcagagaccuacggcuggccgcuaacgccauuuguagcgcagugccaucccacugggucccgacgaguaggacaaccuggucuauccaugcuaagcacgaguggaugacuacagaggacaugcucaccguuuggaaucgaguguggauacgugaaaaccccuggauggaggauaaaacuccuguagaaagcugggaggaaaucccauauuugggaaagagagaggaccaauggugcggcucccugauuggucuuaccucacgcgccacaugggcaaagaauauccaggccgcgauuaaccaggugcggagucugaucgggaaugaggaauacacggauuacaugcccucuaugaaaagguucagacgcgaggaagaggaagcuggaguccucugguga

SEQ ID NO: 14880 - RNA, 9876 nt, Artificial Sequence
  derived and/or modified CDS sequence (opt3) from DENV-2__EU482467__SS-prME
agcgcaggcaugaucauuaugcugauacccaccgugauggcuuuccaccucacuacucggaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaaaacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggccggugucuuaugggaugugccuuccccacccccuauggggaaagccgaacuggaggacggagcuuaucgaauaaagcaaaagggcauucucggcuacucacagaucggggcaggaguuuacaaagaagguaccuuccacacuauguggcauguaacacgcggcgccgugcugaugcacaaggggaaacggaucgagccgaguugggcggaugucaagaaagaccuuauuagcuauggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccaggagcggggccuauguuuccgcuaucgcccaaacagagaagucuauugaggauaauccugaaaucgaggacgauauauuucguaaacgccggcuuacuauuauggacuuacacccgggagcaggcaagaccaaaagauaccugcccgcuaucgugagggaagccaucaagcgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaagguaagaccgugugguucguuccuuccaucaaggcagggaacgacauugccgcuugccugcgcaaaaauggaaagaaagucauccaacucucacgaaagacauuugauucugaauacauaaaaaccagaacuaacgacugggauuucguggugacaaccgacaucagcgagaugggcgcgaauuuuaaggccgagcgggucauugauccaaggcgcuguaugaaacccguaaucuuaacggacggcgaagaacgugugauucuggcagggccuaugccgguuacucauaguuccgcugcccagagacggggaaggaucggucgcaacccaaagaaugaaaacgaccaguacauauauaugggcgagccccuugaaaaugaugaggacugcgcacacuggaaggaggccaaaaugcugcucgauaacauuaauacaccugaagggaucauucccagcauguucgagccagaacgagagaagguggacgcuaucgauggagaauacagauugcggggcgaggccaggaaaaccuuugucgaccugaugcgcagaggugaucucccuguguggcuggcguauaagguugcagccgaggggauaaacuacgcugacaggcggugguguuucgauggcaucaaaaacaaucagauucuugaagagaacguggaagucgagaucuggaccaaggagggagaacguaagaaacuaaagccccgcuggcuggacgcccgaauuuauucugauccauuggcuuuaaaagaguuuaaggaguucgcagccggcagaaaaucacugacucucaaucugaucacagagauggggaggcuuccuaccuucaugacacaaaagacucgggacgcucuggauaaccucgccguguugcacacggcagaagcgggaggucgcgccuacaaucaugcucuguccgagcuaccggagacccuggaaacacuccuucuguuaacuuugcuggccaccguaacaggcgggauauuucucuuccugaugaguggaagaggcauugguaagaugacccuugggaugugcugcaucaucacugcaagcauucugcucugguaugcucagauccagccccacuggauagccgcaucgauuaucuuggaguuuuuccugauuguguuacuaaucccagaaccugagaaacagaggacgccccaagacaaccagcugaccuacguugucauagccauccucacagugguggcugcgacuauggccaaugaaaugggcuuucuugagaagaccaaaaaggaccugggauugggcucuauugcaacacagcagccagaguccaacauccuggauauugaccuccggccugcuagcgccuggacccuguacgccgucgcaacuacauucguuacgcccaugcuucgacauucaaucgaaaauaguucugugaacguaucccucaccgcuauugccaaucaagcgacugugcugaugggguugggaaaagguuggccgcugagcaagauggauaucggcgucccauuacuagcuauaggguguuauucacaggugaacccuauuacacugaccgccgcacuccuucuguugguugcccacuacgcuaucaucggacccggccugcaggcaaaggccaccagagaggcgcagaaacgcgcugccgcagguauuaugaagaauccaacaguggacgggauaacugucaucgaucucgaccccauuccuuaugauccgaaauuugaaaagcaacugggccagguaaugcuuuuaauccugugcgugacgcagguucucaugaugaggaccacaugggccuugugugaggcucugacucuagccaccggacccauuaguacacugugggaaggcaacccagggcgguucuggaauaccacuaucgcagugagcauggcuaacauauuucguggauccuaccucgccggcgcgggucuucuguucucuaucaugaaaaauacgacaaacaccagaagggggacuggaaacaugggcgagaccuugggugagaaguggaaaagccgccugaaugcccucggcaaguccgaauuucaaauuuauaagaaaucagggauccaggaggucgaccggacacuggcaaaggaaggaauuaaacgaggcgagacugaucaccaugcugugucuagagggagugccaaguuaaggugguucgucgagcgcaacauggugaccccugaaggaaaaguuguggaccuuggcugcgguagagggggauggucguacuauuguggcggucugaagaauguaagagaggugaagggccucacaaaagggggacccggccacgaggaaccuaucccaaugagcacguacggguggaaccuaguccgucugcaguccggaguugauguguuuuucauacccccugaaaagugcgacaccuugcugugugauauuggcgagucuucaccaaaucccacugucgaggcagguaggacacuccgggugcuuaaccugguagaaaauugguugaacaauaacacccaguucugcaucaaagugcugaauccguacaugccuagcguuaucgagaagauggaagcucuccaacgcaaauaugggggagccuuagugcgaaacccacuguccagaaauaguacucaugagauguacugggucucuaacgccagcggcaauauugugucauccgucaacaugauaaguaggaugcuuaucaaccgguuuacaaugcgccacaagaaggcgaccuaugaacccgacguggaccugggcagcgggacgagaaauauuggaaucgagucugagauuccuaaccuagauaucauagguaaaaggaucgaaaagauuaaacaggagcaugaaaccuccuggcacuacgaccaggaucacccauauaagacaugggcuuaccauggcucauaugagacuaaacagaccgggagcgcaucgucuaugguuaauggaguagugcgacuccugacaaagcccugggacgucuugccgacugugacccaaauggccaugacagauaccacuccuuucggccagcagcggguuuuuaaggaaaaaguggacacgcguacacaggagcccaaggaggguaccaaaaagcugaugaaaaucacugcugaauggcucuggaaggagcuugggaaaaagaagaccccaagaauguguacacgcgaagaguucacgaggaaaguccggaguaacgccgcacugggagccauuuuuaccgaugagaauaaguggaaauccgcuagagaagcgguggaggacagccgcuucugggaauuaguagauaaggagaggaaccugcacuuggaaggcaaaugcgagacuuguguguacaauaugaugggcaagcgagagaagaaacucggggaauuuggaaaggccaaagguucacgggcaaucugguacauguggcugggcgcuagauuccuagaguuugaagcccuuggguuccugaacgaggaccauugguuuuccagggaaaauucucucagcggaguugagggcgagggucugcacaaguugggguauauucugcgcgaugucaguaaaaaggaaggaggcgcaauguacgccgacgacacagcuggcugggauacccguauaacucucgaggaccuuaagaacgaagagauggugacaaaucacauggaaggggagcaucggaaacuggccgaggcgaucuucaaguuaaccuaucaaaacaaaguggucagaguucagaggccuacaccccgcggaacugugauggauauuaucucccgacgggaccagagagguagcggccaaguagggaccuacggacugaauacguuuaccaacauggaagcacaguugaucaggcagauggagggcgaagguguguucaagaauauucaccaucucacagucacugaggagguggccguucagaacuggcuggcucgcguggggagagaacggcuaucuaggauggccauaucaggagaugacugcgucgugaaaccacuugaugaccguuucgcaaacgcucugaccgcccucaaugauaugggcaagauccgaaaggacauucaacagugggagcccaguaaaggcuggaacgauuggacacagguaccuuuuugcucccaccauuuccacgaacugaucaugaaggacgggcgcguuuugguggucccauguagaaaucaggaugaguuaauuggacgggcuaggaucagccaaggugccggcuggucucugcgcgaaacugcaugccucgggaaaucguaugcgcagauguggucacuuauguacuuucacagacgggaccugaggcuagccgcuaacgccauauguagcgcagugccgucccauugggugcccaccagucgaacgacauggucuauccacgcuaagcaugaguggaugaccacugaggacaugcugacagucuggaaucguguuuggauuagagaaaacccuuggauggaggauaaaaccccaguggaaagcugggaggaaauccccuaucucggaaagcgcgaggaccaguggugcggcuccuugauuggucugacuucacgggccaccugggcaaagaauauccaggccgcgauaaaccaaguaaggagucuuauugggaaugaggaauacacagauuacaugccuucuaugaaaagauuccgccgggaggaagaggaagcuggagugcugugguga

SEQ ID NO: 14881 - RNA, 9876 nt, Artificial Sequence
  derived and/or modified CDS sequence (opt3) from DENV-2__EU482468__SS-prME
agcgcaggaaugaucauuaugcugauaccaaccgugauggcuuuccaccucacuacuagaaacggggaaccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauaaugaggcauccuggcuucaccaucauggccgcaauucuggccuacacaaucggcaccacgcacuuucagcggguguugauuuucauccuccugacugcuguugcaccaucuaugacaaugcgcugcauagggauuucgaacagagauuuuguggaaggagucucagguggcagcuggguggacaucguacuggagcacgggaguuguguuaccacuauggccaagaauaagcccacacucgauuucgaauuaauuaaaaccgaggcuaagcagccugccacgcugaggaaauauugcaucgaagcgaaacuuaccaacacaacuaccgagucccgguguccaacacaaggagagcccucuuugaaagaagaacaggacaagcgcuuugugugcaagcauagcauggucgaucgaggcugggguaauggguguggacuguucggcaaaggcgggaucgugacuugcgcaauguuuaccugcaagaaaaacauggaaggaaagauugugcagccugagaaucuagaauacacaauagucguuaccccacacuccggugaggagcaugccgugggcaacgacacugggaaacacggaaaggaaaucaaaguaacgccgcagucaaguauuacagaggcugaacucaccggcuaugguacugugaccauggaguguagccccagaacagggcuggauuucaaugaaaugguccuucugcaaauggagaacaaggccugguuggugcacaggcagugguuucucgaccugccuuuaccauggcugcccggcgcagauaagcaggagucuaauuggauccagaaagaaacccucguuacuuucaagaacccucaugcuaaaaagcaagacguggucgugcuuggaucccaggagggcgccaugcacacagcgcugacgggggccaccgaaauacagaugucaagcggaaauuugcuauuuacuggucaucugaaaugccggcuccguauggacaagcugcaacuuaagggcaugaguuacucuauguguacagggaaauucaagguaguuaaagagauugcagagacccagcacggaacaaucgugauccgcguccaguaugaaggcgaugguuccccaugcaagauucccuucgagaucauggaccuggagaagagauacguguuggggaggcucauuacugucaacccgauagugaccgagaaggauagcccuguuaacaucgaagcugagcccccauuuggcgacucguacauuaucaucggaguggagccuggccagcugaaguuaaauugguucaaaaaggggucuuccauuggacaaauguuugaaacgaccaugcggggugccaaacgaauggcuauacugggcgauacagccugggacuucgggucacuaggaggcguauuuacaaguaucgguaaggcacuccaucaggucuucggggccauuuauggcgcugcguuuagcggaguguccuggaccaugaaaauccugauuggcguuaucauaacauggaucgggaugaacucucgcagcacuucacuuaguguguccuugguccuggugggaauuguaacccucuaccugggcgugaugguucaggcagauagcgguugugucgugucuuggaagaauaaggagcuuaaaugcgggucaggaaucuucauuacggacaacgugcacacauggaccgaacaguauaaguuucaacccgagaguccaagcaaacuggccuccgcuauccagaaggcccaggaagagggcauaugugguauuagaucugucacuagguuggagaaucucauguggaaacagaucacacccgaacugaaccacauuuuagcagagaaugaaguuaagcugaccaucaugacuggcgauauacgggggaucaugcaagccggaaaacgcucgcuaagaccucagccaaccgagcucaaguacagcuggaagacauggggcaaagcuaagaugcuguccacggaaucauauaaccagaccuuccuuauugacgggccggagacugccgagugccccaauacaaacagggcauggaauaguuuggaaguggaggauuacggauuuggcguguucaccacaaacaucuggcugaaacucaaggaaaaacaggacgcguuuugugacucuaagcugaugagcgcugccauuaaggauaaucgugcaguacaugccgacauggguuauuggauggaguccgcuuuaaacgauacuuggaaaaucgagaaggccucauucauagaagucaaaaauugccacuggccuaagagccauacccuguggucuaacggggugcuugaguccgaaaugauuauccccaagaacuuggcaggacccguuagucaacacaauuaccggccuggcuaccacacgcagaucgcugguccauggcaucucggcaagcuggagauggacuucgauuuuugugacgggacaaccgugauugucacugaagauugcggaaaccgaggccccagccuaagaaccacaacugccucugggaagcugaucaccgaguggugcuguagguccugcacacucccgccucugcgcuaucggggagaggacggcuguugguacgguauggaaauuagaccacuuaaagagaaggaagagaauuuggugaacucacugguuacggcggggcacggacagguggauaauuucaguuuaggcguacucgguauggcccuguuucuugaagagaugcugaggacccgcgucggcacuaaacaugcuauauugcucguggcagugagcuucgucacacugaucaccgggaacaugucguuuaaggaccuaggacgaguugugguaauggugggcgccacuauggcugaugacauugggaugggagucacauaucuggcccuccuggcagcguucaaagugcggcccaccuuugccgcuggccuuuugcugcguaaguuaacguccaaggagcucaugaugacuaccaucgguauuguucugcuuucucaaagcacaaucccugaaaccgugcuggagcuaacugaugcccucgcacuggggaugauggucuugaaaauagugagaaauauggaaaaguaccagcuggcuguuacaaucauggccauuuuaugcgugcccaacgcagucauccuccagaaugccuggaaaguaucauguaccauucuggcugugguuaguguguccccacuucuguugacaucuagccagcaaaagacugacuggaucccucucgcgcugaccauaaaaggacuaaaccccacggccauuuuccugacaacccuuuccaggacuaauaagaaacgcucauggccacucaacgaggcaaucauggcugucggcauggugagcauccuggccaguucuuugcugaagaaugacauuccgaugaccggcccuuuaguagccgggggacuccugacagugugcuauguccuuacuggucgguccgcugaucuggaauuggagagagcaaccgacguuaagugggaggaucaggccgaaauaagcggcucgucacccauccucucuauuacgaucagugaggacggguccaugagcauuaaaaacgaagaggaggaacagacacugaccauccuaauaaggacuggacugcuugugaucucuggccucuuuccaauuagcauccccauuacagcggcugccugguaccugugggaggugaagaaacagcgagccggugucuugugggaugugccuuccccacccccuauggggaaggccgaauuagaggacggagcuuaucgcaucaaacaaaagggcauacugggcuacucacagauuggggcaggaguuuacaaggaagguaccuuccacacuauguggcauguaacacggggcgccgugcucaugcacaaagggaagagaaucgagccgaguugggcggaugucaaaaaggaccugaucagcuauggaggcgguuggaaacuugagggggaauggaaggagggagaagaggugcagguucuggcuuuggaaccaggcaagaaucccagggccgugcagaccaaaccuggccuauuuaagacgaacacugggaccauuggagcagucucucuggauuucuccccagguacaucaggcagucccaucauagacaaaaaggggaaagugguaggacucuacggcaacggugucgugacccguagcggggccuauguuuccgcuauugcccaaacagagaagucuaucgaggauaauccugaaauugaggacgauaucuuucgcaagcggagacugacuauaauggaccuucacccgggagcaggcaaaaccaagagguacuuacccgcuauugugcgagaagccaucaaacggggccugcgcacgcucaucuuggcgccaacaagagucguggccgcagagauggaagaggcucugagggggcucccuauucgguaucagacucccgccauccgagcugagcauaccggaagagaaauuguugaccugaugugucacgcaacauucaccaugcgccuucugucgccagugagggucccuaacuacaauuugauaaucauggaugaggcccauuucacugaccccgccagcauugcugcgcgugguuauaucucaacccggguggaaaugggcgaggcagccgggaucuuuaugacagcuacgccaccgggauccagagauccuuucccccagaguaacgccccaauuauagacgaggaaagggagauccccgaacgcucuuggaauagcggccacgaguggguaacugauuuuaaggguaaaaccgugugguucguuccuuccauuaaggcagggaacgacaucgccgcuugccuacgaaagaauggcaagaaggucauucaacugucaagaaaaacauuugauucugaauacgugaagacccggacuaacgacugggauuucguggucacaaccgacaucagcgagaugggcgcgaauuuuaaagccgagaggguaauagauccacgccguuguaugaagcccgugauccucacggacggcgaagagagaguuauuuuagcagggccuaugccggugacucauaguuccgcugcccagcggaggggacgcaucggucgaaaccccaagaaugaaaacgaccaguacauuuauaugggcgagccccuggaaaaugaugaggacugcgcacacuggaaggaggccaagaugcuucuggauaacaucaauacaccugaagggauaauucccagcauguucgagccagaaagagagaaagucgacgcuaucgauggagaauaccggcucaggggcgaggcccgcaagaccuuuguggacuugaugagaaggggugaucugccuguuuggcucgcguauaaaguggcagccgaggggauuaacuacgcugaccggcguugguguuucgauggcaucaagaacaaucagauacuggaagagaacgucgaaguggagaucuggaccaaagagggagaacgcaagaaacuuaaaccccgauggcuagacgccagaauuuauucugauccacuggcuuugaaggaguuuaaagaguucgcagccggcaggaagucauuaacucugaaucucaucacagagauggggcggcugccuaccuucaugacacagaaaacucgcgacgcucuugauaaccuggccguacuccacacggcagaagcgggagguagagccuacaaucaugcuuuguccgagcugccggagacccuagaaacacugcuccuucugacuuuauuggccaccgugacaggcgggauuuuucuguuccucaugaguggaaggggcaucgguaagaugacccuggggaugugcugcauaauuacugcaagcacgcuucugugguaugcucagauccagccccacuggaucgccgcaucgauuauccucgaguuuuucuugauaguucuguuaauuccagaaccugagaagcagcggaccccacaagacaaccagcuaacauacgucgugaucgccauucugacuguggucgcugcgaccauggccaaugaaaugggcuuucucgagaaaacaaagaaagaccuuggacugggcucuaucgcaacccagcagccagaguccaacauauuggauaucgaccugcgaccugcuagcgccuggacucucuacgccguugcaacaacguucgugacccccaugcugagacauucaauugaaaauaguucuguaaacgugucccuuacugcuaucgccaaucaagcgacaguccucauggggcugggaaaggguuggccguugagcaaaauggauauuggcgugccacuguuagcuaucggguguuauucacagguuaacccuauuacccuaaccgccgcacugcuccuucugguggcccacuacgcuaucauaggacccggcuugcaggcaaaggccacacgcgaggcgcagaagagggcugccgcagguauuaugaaaaauccaacugucgacgggaucacgguaaucgaucuggaccccauuccuuaugauccgaaguuugaaaaacaacucggccaggugaugcugcuuauauuaugcguuacccaggugcugaugaugcggacaacuugggcccucugugaggcuuugacccuggccacaggacccaucaguacccuaugggaaggcaacccagggcguuucuggaauacuacgauugcagucagcauggcuaacaucuuuagaggauccuaccuggccggcgcgggucuccuuuucucuauuaugaagaauacaaccaacacuaggcgcgggaccggaaacaucggcgagacacugggugagaaauggaaaagccgguugaaugcccugggcaaauccgaauuucaaauauauaagaagucagggauccaggagguggaccgaacucucgcaaaagaaggaauuaagagaggcgagaccgaucaccaugcugucucuagggggagugccaaacugcgcugguucguggagcggaacaugguuacaccugaaggaaaggugguagacuuaggcugcgguagagggggauggucguacuauuguggcggucuuaaaaaugugcgugaggucaagggccugacgaaagggggacccggccacgaagaaccuaucccaaugagcaccuacggguggaaccucguuaggcuacaguccggaguggaugucuuuuucauucccccugaaaaaugcgacacucuguugugugauaucggcgagucuucaccaaaucccacaguggaggcaggucggacccugcgcguacucaaccuuguggaaaauuggcugaacaauaacacucaguucugcauaaagguuuugaauccguacaugccuagcgugauugagaaaauggaagcucugcaacgaaaguaugggggagcccucgucagaaacccauuauccaggaauaguacacaugagauguacugggugucuaacgccagcggcaauaucgucucauccgugaacaugaucagucggaugcugauuaaccgcuuuaccaugagacacaaaaaggcgacguaugaacccgacguugaccuuggcagcgggaccaggaauauaggaaucgagucugagauuccuaaccuggauaucauugguaagcgaaucgagaaaauaaagcaggagcaugaaacauccuggcacuacgaccaggaucacccauauaaaacuugggcuuaccauggcucauaugagaccaagcagacagggagcgcaucgucuaugguaaauggagugguccggcuacucacuaaacccugggacgugcugccgaccguuacacaaauggccaugaccgauacuacgccuuucggccagcagcguguguuuaaggaaaaggucgacacaagaacccaggagcccaaagaggguacuaagaaauugaugaagaucaccgcugaauggcuguggaaagagcucgggaagaaaaagacaccacgcauguguacgagggaagaguucacccggaaggugagaaguaacgccgcacuuggagccauuuuuacugaugagaauaaauggaaguccgcucgcgaagcgguagaggacagcagguucugggaacugguggauaaagagcgaaacuuacaccuggaaggcaagugcgagacauguguuuacaauaugaugggcaaacgggagaagaaguugggggaauuuggaaaagccaaggguucaagagcaaucugguacauguggcucggcgcuagguuccuggaguuugaagcccuaggguuccuuaacgaggaccauugguuuucccgcgaaaauucucugagcggagucgagggcgagggucuccacaaacugggguauauuuugcgugaugugaguaagaaagaaggaggcgcaauguacgccgacgacaccgcuggcugggauacucggaucacacuggaggaccucaagaacgaagagauggugaccaaucacauggaaggggagcauaagaaacuugccgaggcgauuuucaagcugacauaucaaaacaaagucguuagagugcagaggccuacuccccgcggaaccguaauggauauaaucucccgacgggaccagagagguagcggccaaguggggacguacggauuaaauaccuuuacaaacauggaagcacagcugauuaggcagauggagggcgaaggugucuucaagaauauccagcacuugacugugaccgaggagguugccgugcauaacuggcucgcucgcgucgggagagaacggcugucuaggauggccaucucaggagaugacugcgugguaaaaccacuagaugaccguuucgcaaacgcucuuacagcccugaaugauaugggcaagauucgaaaggacauacaacagugggagcccaguaaaggcuggaacgauuggacucagguuccuuuuugcucccaccauuuccacgaacucaucaugaaggacgggcgcgugcuggucgugccauguagaaaucaggaugaguugauuggacgggcuaggaucagccaaggugccggcuggucuuuacgcgaaaccgcaugccuggggaaaucguaugcgcagauguggucacucauguacuuucacagacgggaccuuaggcuggccgcuaacgccauuuguagcgcagugccgucccauuggguccccacgagucgaacaaccuggucuauccacgcuaagcaugaguggaugacuacagaggacaugcuaaccguuuggaaucguguguggauaagagaaaacccuuggauggaggauaaaacuccaguagaaagcugggaggaaauccccuaucugggaaagcgcgaggaccaguggugcggcucccucauugguuugaccucacgggccacaugggcaaagaauauccaggccgcgauuaaccaagugaggagucugaucgggaaugaggaauacacggauuacaugccuucuaugaaaagauuccgccgggaggaagaggaagcuggaguccuuugguga

SEQ ID NO: 14882 - RNA, 9876 nt, Artificial Sequence
  derived and/or modified CDS sequence (opt3) from DENV-2__EU482469__SS-prME
agcgcaggaaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccauuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggcccacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcaugggaguuguguuaccacuauggccaagaauaagcccacauuagauuucgaacugauuaaaaccgaggcuaagcagccugccacgcuuaggaaauacugcaucgaagcgaaguugaccaacacaacuaccgagucccgguguccaacacaaggagagcccucucugaaagaagaacaggacaagcgcuuugugugcaagcacagcauggucgaucgaggcugggguaauggguguggacuauucggcaaaggcgggaucgugacuugcgcaauguuuaccugcaagaaaaacauggaaggaaagauugugcagccugagaaucucgaauauacaauagucguuaccccacauuccggugaggagcacgccgugggcaacgacacugggaaacacggaauggaaaucaagguaacgccgcagucaaguauuacagaggcugaacugaccggcuacgguacugugaccauggaguguagccccagaacagggcuugauuucaaugaaaugguccuguugcaaauggagaacaaagccuggcucgugcauaggcagugguuucuggacuuaccucugccauggcuccccggcgcagauaagcaggagucuaauuggauccagaaggaaacccuuguuacuuucaaaaacccucacgcuaagaaacaagacguggucgugcugggaucccaggagggcgccaugcauacagcguugacgggggccaccgaaauacagaugucaagcggaaaucuacuguuuacuggucaccucaagugccggcugcguauggacaaacuucaacugaagggcaugaguuauucuauguguacagggaaguucaaaguaguuaaggagauugcagagacccagcauggaacaaucgugauccgcguccaguacgaaggcgaugguuccccaugcaaaauucccuucgagaucauggacuuggaaaagagauaugugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaccaggucuucggggccauuuacggcgcugcguuuagcggaguguccuggaccaugaagauccuuauuggcguuaucauaacauggaucgggaugaacucucgcagcacuucauugagugugucccugguccucgugggaauuguaacccuguaucuuggcgugaugguucaggcagauagcgguugugucgugucuuggaaaaauaaggagcugaagugcgggucaggaaucuucauuacggacaacgugcacacauggaccgaacaguacaaauuucaacccgagaguccaagcaaguuggccuccgcuauccagaaagcccaggaagagggcauaugugguauuagaucugucacuaggcucgagaaucugauguggaagcagaucacacccgaauuaaaccauauucuggcagagaaugaaguuaaacuaaccaucaugacuggcgauauacgggggaucaugcaagccggaaagcgcucgcucagaccucagccaaccgagcugaaauauagcuggaagacauggggcaaggcuaaaaugcuuuccacggaaucauacaaccagaccuucuugauugacgggccggagacugccgagugccccaauacaaacagggcauggaauagucuggaaguggaggauuauggauuuggcguguucaccacaaacaucuggcucaagcugaaagaaaagcaggacgcguuuugugacucuaaauuaaugagcgcugccauuaaggauaaucgugcaguacacgccgacauggguuacuggaucgaguccgcucugaacgauacuuggaagauagagaaagccucauucauugaagucaagaauugccauuggccuaaaagccacacccuuuggucuaacgggguguuggaguccgaaaugaucaucccaaagaaccucgcaggacccguuagucaacacaauuaucggccuggcuaccauacgcagauugcugguccauggcaccugggcaaacuagagauggacuucgauuuuugugacgggacaaccgugaucgucacugaagauugcggaaaccgaggccccagccugagaaccacaacugccucugggaagcucauuaccgaguggugcuguagguccugcacacugccgccucuucgcuaccggggagaggacggcuguugguaugguauggaaauaagaccauugaaggagaaagaagagaaucuggugaacucauuaguuacggcggggcauggacagguggauaauuucagucucggcguacuggguauggcccuuuuucuggaagagauguugaggacccgcgucggcacuaagcacgcuauccuccugguggcagugagcuucgucacacuaauuaccgggaacaugucguuuaaagaccugggacgaguugugguaauggugggcgccacuauggcugaugacaucgggaugggagucacauaccucgcccugcuugcagcguucaaggugcggcccaccuuugccgcuggcuugcuguuacguaaacucacguccaaggagcugaugaugacuaccauugguaucguucuucugucucaaagcacaauaccugaaaccgugcuagagcucacugaugcccuggcauuggggaugaugguccugaagaucgugagaaauauggaaaaauaucaguuagcuguuacaauuauggccauccucugcgugcccaacgcagucauucugcagaaugccuggaagguaucauguaccauccuugcugugguuaguguguccccacuguugcucacaucuagccagcagaagacugacuggauaccucuggcgcuaaccauuaagggacugaaccccacggccaucuuccuuacaacccucuccaggacuaauaaaaagcgcucauggccacugaacgaggcaaucauggcugucggcauggugagcauuuuggccaguucucugcucaaaaaugacauaccgaugaccggcccucuaguagccgggggacugcuuacagugugcuacguccugacuggucgguccgcugauuuggaacucgagagagcaaccgacguuaagugggaggaucaggccgaaaucagcggcucgucacccauucugucuaucacgauuagugaggacggguccaugagcaucaagaacgaagaggaggaacagacacuaaccauacugaucaggacuggacuucucgugauuucuggccuguuuccaaucagcauucccaucacagcggcugccugguauuugugggaggugaaaaagcagcgagccggugucuuaugggaugugccuuccccacccccuauggggaaagccgaacuggaggacggagcuuaccgcauaaagcaaaaaggcauucucggcuauucacagaucggggcaggaguuuacaaggaagguaccuuccauacuauguggcacguaacacggggcgccgugcugaugcacaaggggaaaagaaucgagccgaguugggcggaugucaagaaagaccuuauuagcuacggaggcgguuggaagcuggagggggaauggaaagagggagaagaggugcagguuuuggcucuagaaccaggcaagaaucccagggccgugcagaccaagccuggccuguuuaaaacgaacacugggaccaucggagcagucucucucgauuucuccccagguacaucaggcagucccauaauugacaagaaagggaaggugguaggacuguauggcaacggugucgugacccguagcggggccuacguuuccgcuaucgcccaaacagagaaaaauauugaggauaacccugaaaucgaggacgauauauuucgcaagcggagacuuacuauuauggacuuacauccgggagcaggcaagaccaaaagguaucugcccgcuaucgugcgagaagccaucaagcggggccuccgcacguugauucuggcgccaacaagagucguggccgcagagauggaagaggcucucagggggcugccuauccgguaccagacucccgccauucgagcugagcacaccggaagagaaauaguugaccuuaugugucaugcaacauucaccaugcgccuguugucuccagugagggucccuaauuauaaccuaaucauuauggaugaggcccacuucacugaccccgccucgaucgcugcgcgugguuacaucagcacccggguggaaaugggcgaggcagccgggauuuuuaugacagcuacgccaccgggaucaagagauccuuucccccaguccaaugccccaauaaucgacgaggaaagggagauucccgaacgcaguuggaacucuggccaugaguggguaacugauuuuaaagguaagaccgugugguucguuccuagcaucaaagcagggaaugacauugccgcuugccugcgaaagaacggaaagaaagucauccaacucuccagaaagacauuugauucagaauaugugaaaacccggacuaaugacugggauuucguggucacaaccgacauaucugagaugggcgcgaacuuuaaggccgagaggguaaucgauccacgccguuguaugaaacccgugauuuuaacggacggcgaagagagaguuauccuggcagggccuaugccggugacucacagcagugcugcccagcggaggggacgcauuggucgaaauccaaagaacgaaaaugaccaguacaucuacaugggcgagccccuugaaaacgaugaggacugcgcacacuggaaagaggccaagaugcugcucgauaauauaaacacaccugaagggauuauccccuccauguucgagccagaaagagagaaggucgacgcuauugauggagaauaucgguugaggggcgaggcccgcaaaaccuuuguggaccugaugagaaggggugaucucccuguuuggcuggcguacaagguggcagccgaggggaucaacuaugcugaccggcguugguguuucgauggcaucaaaaauaaccagauccuugaagagaaugucgaaguggagauuuggaccaaggagggagaacgcaaaaagcuaaagccccgauggcuggacgccagaaucuacagcgauccauuggcuuuaaaagaguuuaaggaguucgcagccggcaggaaaucucugacucucaaccugauuacagagauggggcggcuuccuaccuucaugacacaaaagacucgcgacgcucuggauaaucucgccguauugcauacggcagaagcgggagguagagccuauaaccacgcucugucagagcuaccggagacccuggaaacacuccuucuguuaacuuugcuggccaccgugacaggcgggaucuuucucuuccugauguccggaaggggcauagguaaaaugacccuugggaugugcugcauuaucacugcaaguauccugcucugguacgcucagauucagccccauuggaucgccgcaagcauaauuuuggaguuuuuccugaucguuuuacuaauuccagaaccugagaagcagcggacgccccaagacaaucagcugaccuaugucgugaucgccauacucacaguggucgcugcgacuauggccaacgaaaugggcuuucuugagaagaccaaaaaggaccugggauugggcucgaucgcaacacagcagccagagucuaauauucuggauaucgaccuccgaccugcuuccgccuggacccuguacgccguugcaacuacauucgugacgcccaugcuuagacacagcauugaaaacucaaguguaaaugugucucucaccgcuaucgccaaccaagcgacuguccugaugggguugggaaaagguuggccgcuguccaagauggauauuggcgugccauuacuagcuaucggguguuacagccagguuaauccuauaacacugaccgccgcacuccuucuguugguggcccacuaugcuauuaucggacccggccugcaggcaaaagccacccgcgaggcgcagaagagggcugccgcagguaucaugaagaacccaacagucgacgggauuacuguaauagaucucgaccccaucccuuacgauccgaaauuugaaaagcaacugggccaggugaugcuuuuaauucugugcguuacacaggugcucaugaugcggaccacaugggccuugugugaggcucugacucuagccaccggacccaucucaacacugugggaaggcaauccagggcguuucuggaacaccacuauugcagucaguauggcuaauaucuuuagaggaagcuaucucgccggcgcgggucuucuguucuccauaaugaaaaacacgacaaacaccaggcgcgggacuggaaauaccggcgagacauugggugagaaguggaaaucucggcugaacgcccucggcaagagcgaauuucaaaucuacaaaaaguccgggauucaggagguggaccgaacucuggcaaaggaaggaaucaaaagaggcgagaccgaucaucacgcugucucaagggggucugccaaguuacgcugguucguggagcggaauaugguuacaccugaaggaaaagugguagaccuuggcugcgguagagggggauggaguuauuacuguggcggucugaagaacgugcgugaggucaaaggccucacgaaagggggacccggccaugaggaaccuauuccaaugucgaccuauggguggaaucuaguuaggcugcagagcggaguggaugucuuuuucauacccccugaaaagugcgacacuuugcugugugauauaggcgaguccucuccaaaccccacaguggaggcaggucggacccuccgcguacuuaaucugguggaaaacugguugaauaacaauacucaguucugcauuaaaguucugaacccguacaugccuucagugaucgagaagauggaagcucuccaacgaaaauacgggggagccuuagucagaaauccacugagcaggaacuccacacacgagauguauugggugaguaaugccucuggcaacaucgucagcucagugaacaugauuucccggaugcuuauaaaucgcuuuaccaugagacauaagaaagcgacguacgaacccgacguugaccugggcagugggaccaggaacaucggaauugagagcgagaucccuaaucuagauauuaucgguaagcgaauagaaaagaucaaacaggagcacgaaacaucuuggcacuaugaccaggaucauccauacaagacuugggcuuaucacggcuccuacgagaccaaacagacagggucagcaagcucgaugguaaacggagugguccggcuccugacuaagcccugggacguguugccgaccguuacacaaauggccaugaccgauacuacgccuuucggccagcagcguguguuuaaagaaaaggucgacacaagaacccaggagcccaaggaggguacuaaaaagcugaugaaaauuaccgcugaauggcucuggaaggagcuugggaaaaagaaaacaccacgcauguguacgagggaagaguucaccaagaaggugcggucuaaugccgcacugggagccaucuuuacugaugagaacaaauggaagagugcuagagaagcgguagaggacucccgcuucugggaauuaguggauaaagagaggaaucugcauuuggaaggcaagugcgagacauguguuuauaacaugaugggcaaacgagagaagaagcucggggaauuuggaaaagccaaggguagccgggcaauuugguacauguggcugggcgcuagauuccuagaguuugaagcccuuggguuccugaaugaggaccacugguuuucaagggaaaacucccucucuggagucgagggcgagggucugcacaaauugggguacauccugcgcgaugugagcaagaaagaaggaggcgcaauguaugccgacgacaccgcuggcugggauacucguauuacacucgaggaccuuaagaaugaagagauggugaccaaccauauggaaggggagcacaagaaacuggccgaggcgauauucaaguuaacauaccaaaauaaagucguucgggugcagagaccuacucccaggggaaccguaauggauaucauuagucgccgagaccagcgggguuccggccaaguggggacguauggacugaacaccuuuacaaauauggaagcacaguugaucagacagauggagggcgaaggugucuucaagaacauccagcaucucacugugaccgaggagguugccgugcacaacuggcuggcuagggucgggcgcgaaagacuaagccggauggccauuucuggagaugacugcgugguaaaaccacuugaugacagguucgcaaaugcucugacagcccucaacgauaugggcaagauacguaaggacauccaacagugggagcccucaaaaggcuggaaugauuggacucagguuccuuuuugcagucaucacuuccacgaacugauuaugaaggacgggcgaaucuugguggucccaugucgcaaccaggaugaguuaauuggcagagcucggaucucccaaggugccggcuggagccugagggaaaccgcaugccucgggaaaucuuacgcgcagauguggucgcuuauguauuuucaucgcagagaccugcggcuagccgcuaaugccauauguucagcagugccgagccacugggugcccacguccaggacaaccuggaguauccaugcuaagcacgaguggaugacuacagaggacaugcugaccgucuggaaccgaguuuggauucgugaaaauccuuggauggaggauaaaacuccaguggaaucuugggaggaaauccccuaccucggaaagagagaggaccaguggugcggcagcuugauuggucugaccucccgcgccacaugggcaaagaacauccaggccgcgauaaaucaaguacggucacuuauugggaacgaggaauauacggauuacaugccuaguaugaaaagguucagacgcgaggaagaggaagcuggagugcugugguga

SEQ ID NO: 14883 - RNA, 9876 nt, Artificial Sequence
  derived and/or modified CDS sequence (opt3) from DENV-2__EU482470__SS-prME
agcgccggaaugaucauuaugcugauacccaccgugauggcuuuccaccucaccacuagaaacggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggggcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagcgauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuaugaccauccucugcgugcccaacgccgucauucugcagaaugcauggaagguaucauguacaauccuugccgugguuaguguguccccacuguugcucacuucuagcagacagaaaaccgacuggauaccucuggcucuaacgauuaagggacugaaccccacagcgaucuuccuuaccacucucuccaggaccaauaaaaagcgcucauggccacugaacgaggccaucauggcagucggcauggugagcauuuuggcuaguucucuguuaaagaaugacauaccgaugacaggcccucucguagccgggggacugcuuacugugugcuauguccugaccggucgguccgccgauuuggaacucgagagagcuacggacguuaaaugggaggaucaagcagaaaucagcggcucgucacccauucugucuaucacaauuagugaggacggguccaugagcaucaagaacgaagaggaggaacagacccuaacuauacugaucaggacaggacuucucgugauuucuggccuguuuccaaucagcauucccaucaccgccgcggcuugguacuugugggaggugaaaaagcagcgagccggugucuuaugggaugugccuuccccacccccuauggggaaagcagaacuggaggacggagccuaucgcauaaagcagaagggcauucucggcuacucacaaaucggggcuggaguuuacaaagaagguacuuuccacacaauguggcauguaacccggggcgcagugcugaugcacaaggggaaaagaaucgagccgaguugggccgaugucaagaaagaccuuauuagcuauggaggcgguuggaagcuggagggggaauggaaggagggagaagaggugcagguuuuggcgcuagaaccaggcaaaaaucccagggcugugcagacgaagccuggccuguuuaaaacuaacaccgggacaaucggagccgucucucucgauuucuccccagguaccucaggcagucccauaauugacaagaaagggaaggugguaggacuguacggcaacggugucgugacacguagcggggcauauguuuccgccaucgcucagacugagaagucuauugaggauaauccugaaaucgaggacgauauauuucgcaaacggagacuuaccauuauggacuuacacccgggagccggcaagacgaaaagguaccugcccgcaaucgugcgagaagcuaucaagcggggccuccgcacauugauucuggccccaacuagagucguggcggccgagauggaagaggcacucagggggcugccuauccgguaucaaacccccgcuauucgagccgagcauacaggaagagaaauaguugaccuuaugugucacgcuaccuucacuaugcgccuguugucgccagugagggucccuaacuacaaucuaaucauuauggaugaggcacauuucaccgaccccgccagcaucgccgcucgugguuauaucucaacacggguggaaaugggcgaggcggcagggauuuuuaugacggccacuccaccgggauccagagauccuuucccccagaguaacgcuccaauaaucgacgaggaaagggagauucccgaacgcucuuggaauagcggccacgaguggguaaccgauuuuaaagguaagacagugugguucguuccuuccaucaaggccgggaacgacauugcagccugccugcggaaaaauggaaagaaagucauccagcucucaagaaagaccuuugauucugaauacgugaaaacuagaacaaacgacugggauuucguggucaccacggacauaagcgagaugggcgcuaauuuuaaggcggagaggguaaucgauccacgccguuguaugaaacccgugauuuuaacugacggcgaagagagaguuauccuggccgggccuaugccggugacacauaguuccgcagcucaacggaggggacgcauuggucgaaacccaaagaaugaaaacgaccaguacaucuauaugggcgagccccuugaaaaugaugaggacugcgcccacuggaaggaggcaaaaaugcugcucgauaacauaaauaccccugaagggauuauccccagcauguucgagccagaaagagagaaggucgacgccauugauggagaauaccgguugaggggcgaggcucgcaaaaccuuuguggaccugaugagaaggggugaucucccuguuuggcuggccuauaagguggcggcagaggggaucaacuacgccgaccggcguugguguuucgauggcaucaaaaacaaucagauccuugaagagaacgucgaaguggagauuuggacuaaggagggagaacgcaagaaacuaaagccccgauggcuggacgcuagaaucuauucugauccauuggccuuaaaagaguuuaaggaguucgcugcaggcaggaaaucacugacacucaaucugauuaccgagauggggcggcuuccuacauucaugacucagaagacgcgcgacgcccuggauaaccucgcuguauugcacaccgccgaagcaggagguagagcguacaaucaugcccuguccgagcuaccggagacacuggaaacucuccuucuguuaaccuugcuggcuacagugaccggcgggaucuuucucuuccugaugaguggaaggggcauagguaagaugacucuugggaugugcugcauuaucacggccagcauccugcucugguaugcacaaauucagccccacuggaucgcugccucgauaauuuuggaguuuuuccugaucguuuuacuaauuccagaaccugagaaacagcggacaccccaggacaaccaacugacauacgucgugaucgcaauacucacuguggucgccgcuaccauggcgaaugaaaugggcuuucuugagaagacuaaaaaggaccugggauugggcucuaucgccacccagcagccagaguccaacauucuggauaucgaccuccgaccugcaagcgcuuggacucuguacgccguugccacaacguucgugacccccaugcuuagacauucaauugaaaauaguucuguaaacgugucccucacugcaaucgcuaaucaggccacaguccugaugggguugggaaaagguuggccgcugagcaagauggauauuggcgugccauuacuagcgaucggguguuauucacaaguuaacccuauaacccugaccgcugcccuccuucuguugguggcacacuacgccauuaucggacccggccugcaggcuaaggcaacacgcgaggcccagaaaagggcggcugccgguaucaugaagaauccaacugucgacgggauuacgguaauagaucucgaccccaucccuuaugauccgaaauuugaaaagcagcugggccaagugaugcuuuuaauucugugcguuacccaggugcucaugaugcggacaacuugggcauugugugaggcccugacccuagcuacaggacccaucaguacccugugggaaggcaacccagggcguuucuggaauacuacgauugccgucagcauggcaaacaucuuuagaggauccuaccucgcuggcgccggucuucuguucucuauaaugaaaaauacaaccaacacuaggcgcgggaccggaaacaugggcgagacauugggugagaaguggaaaagccggcugaaugcgcucggcaaguccgaauuucagaucuauaagaaaucagggauucaagagguggaccgaacucuggccaaggaaggaaucaaaagaggcgagaccgaucaccaugcagucucuagggggagugcuaaguuacgcugguucguggagcggaacaugguuacaccugaaggaaaagugguagaccuuggcugcgguagagggggauggucguacuauuguggcggucugaagaaugugcgugaggucaagggccucacgaaagggggacccggccacgaagaaccuauuccaaugagcaccuacggguggaaccuaguuaggcugcaguccggaguggaugucuuuuucauacccccugaaaagugcgacacuuugcugugugauauaggcgagucuucaccaaaucccacaguggaggccggucggacccuccgcguacuuaaccugguggaaaauugguugaacaauaacacucaguucugcauuaaaguucugaauccguacaugccuagcgugaucgagaagauggaagcacuccagcgaaaauaugggggagcuuuagucagaaacccacuguccaggaauaguacacaugagauguacugggugucuaacgccagcggcaauaucgucucauccgugaacaugauuagucggaugcuuauaaaccgcuuuaccaugagacacaagaaggccacguaugaacccgacguugaccugggcagcgggaccaggaauaucggaauugagucugagaucccuaaccuagauauuaucgguaaacgaauagaaaagaucaaacaagagcaugaaacauccuggcacuacgaccaggaucacccauauaagacuugggcguaccauggcucauaugagaccaaacagacagggagcgcuucgucuaugguaaauggagugguccggcuccugacuaagcccugggacguguugccgaccguuacacagauggcaaugaccgauacuacgccuuucggccaacagcguguguuuaaggaaaaagucgacacaagaacccaggagcccaaggaggguacuaaaaagcugaugaaaauuaccgccgaauggcucuggaaggagcuugggaaaaagaagacaccacgcauguguacgagggaagaguucacccggaaagugagaaguaacgcugcccugggagcaaucuuuacugaugagaauaaguggaaauccgcccgcgaagcuguagaggacagcggcuucugggaauuaguggauaaggagaggaaccugcacuuggaaggcaaaugcgagacauguguuuacaauaugauggggaagcgagagaagaaacucggagaauuugguaaggcgaaaggcucacgggccauuugguacauguggcugggggcaagauuccuagaguuugaagcucuuggauuccugaacgaggaccauugguuuuccagggaaaauucucucagcggcgucgagggugaggggcugcacaaguugggauauauccugcgcgaugugaguaaaaaggaaggcggcgccauguacgcagacgacaccgccgggugggauacucguauuacacucgaggaccuuaagaacgaagagauggugaccaaucacauggaaggagagcauaaaaagcuggcugaggccauauucaaauuaacauaucagaacaaggucguucgggugcaaagaccuacucccagggguaccguaauggauaucauuucccgccgagaccagcggggcagcggacaggugggaacguacggccugaauaccuuuacaaacauggaagcgcaauugaucagacagauggagggugaaggggucuucaaaaauauccagcaccucacugugaccgaggagguugcagugcagaacuggcuggccagggucggacgcgaaagacuaucucggauggcuauuucaggcgaugacugcgugguaaagccacuugaugacagguucgccaacgcacugacagcucucaaugauaugggcaagauacguaaagacauccaacagugggagcccaguaagggguggaacgauuggacucagguuccuuuuugcucccaucacuuccaugaacugauuaugaaagacggacgaguguuggucgugccaugucgcaaucaggaugaguuaaucgguagagcccggauuagccaaggcgcuggguggucucugagggaaaccgccugccucggaaagucguaugcacagauguggucacuuauguacuuucaccgcagagaccugcggcuagcggccaacgcuaucuguagcgccgugccgucccacuggguccccacgaguaggacaaccuggucuauacaugcaaaacacgaguggaugacuacagaggacaugcugaccguuuggaaucgaguguggauccgugaaaacccuuggauggaggauaagacuccaguagaaagcugggaggaaauucccuaucucggcaagagagaggaccaguggugcgguuccuugaucgggcugaccucacgcgcuacaugggccaaaaauauucaggcagccaucaaccaagugcggagucuuauaggaaaugaggaauacacggauuacaugccuucuaugaagagguucagacgcgaggaagaggaagcgggcguccugugguga

SEQ ID NO: 14884 - RNA, 9876 nt, Artificial Sequence
  derived and/or modified CDS sequence (opt3) from DENV-2__EU482471__SS-prME
agcgccggcaugauaauuaugcugauacccaccgugauggcuuuccaccucacuacuagaaauggggagccucauaugaucgucgguauucaagaaaagggaaaaucccuucuguuuaagacggaggacggcguuaauaugugcaccuugauggcaauggauuuaggggaacugugugaggacacuaucacuuacaaaugcccauuacucaggcaaaacgaaccggaggauauugacuguuggugcaauucuaccucaacaugggugaccuauggaacuuguacgaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcauucagugggcaacgacacugggaaacacggaauggaaaucaagguaacgccgcagaguagcauuacagaggccgaacugaccggcuaugguacugugaccauggaguguucucccagaacagggcuugauuucaaugaaaugguccuguugcaaauggagaacaaggcuuggcucgugcacaggcagugguuucuggacuuaccucugccauggcuccccggcgccgauaagcaggaguccaauuggauccagaaggaaacccuuguuacuuucaaaaacccucaugcaaagaaacaagacguggucgugcugggaucacaggagggcgcuaugcacacagccuugacgggggcgaccgaaauacagaugagcaguggaaaucuacuguuuacuggucaucucaagugccggcugcguauggacaaacuucaacugaagggcaugucuuacuccauguguacagggaaguucaaaguaguuaaggagauugccgagacccagcacggaacaaucgugauccgcguccaguaugaaggcgaugguagcccaugcaaaauucccuucgagaucauggacuuggaaaagagauacgugcucgggaggcugauuacugucaacccgauagugaccgagaaagauucgccuguuaacaucgaagcagagcccccauuuggcgacucuuacauuaucaucggaguggagccuggccaguuaaagcugaauugguucaagaaaggguccucaauuggacaaauguuugaaacgaccaugcggggugcuaagcgaauggccauacuaggcgauacagcuugggacuucgggagucucggaggcguauuuacuagcaucgguaaagcccugcaucaggucuucggggcaauuuauggcgccgcuuuuuccggagugucuuggaccaugaagauccuuauuggcguuaucauaacauggaucgggaugaacagccgcucaacaaguuuguccgugagccugguccucgugggaauuguaacccuguaccuuggcgugaugguucaggcggauucugguugugucgugucauggaaaaauaaggagcugaagugcgggaguggaaucuucauuacggacaacgugcacacauggaccgaacaguauaaauuucaacccgagagcccauccaaguuggcaucugccauccagaaagcucaggaagagggcauaugugguauuagaucggucacuaggcucgagaaucugauguggaagcagaucacacccgaauuaaaccacauucuggccgagaaugaaguuaaacuaaccaucaugacuggcgauauacgggggaucaugcaagcaggaaagcgcagccucagaccucagccaaccgagcugaaauacuccuggaagacauggggcaaggccaaaaugcuuucaacggaaaguuauaaccagaccuucuugauugacgggccggagacugcugagugccccaauacaaacagggccuggaacucucuggaaguggaggauuacggauuuggcguguucaccacaaacaucuggcucaagcugaaagaaaagcaggacgcauuuugugacagcaaauuaauguccgcggcuauuaaggauaaucgugccguacaugcagacauggguuauuggaucgagucagcccugaacgauacuuggaagauagagaaagcuagcuucauugaagucaagaauugccacuggccuaaaucucauacccuuugguccaacgggguguuggagagugaaaugaucaucccaaagaaccucgccggacccguuagccaacacaauuaccggccuggcuaccacacgcagauugcagguccauggcaucugggcaaacuagagauggacuucgauuuuugugacgggacaaccgugaucgucacugaagauugcggaaaccgaggccccucucugagaaccacaacugcuuccgggaagcucauuaccgaguggugcuguaggucaugcacacugccgccucuucgcuaucggggagaggacggcuguugguacgguauggaaauaagaccauugaaggagaaagaagagaaucuggugaacaguuuaguuacggccgggcacggacagguggauaauuucagccucggcguacuggguauggcgcuuuuucuggaagagauguugaggacccgcgucggcacuaagcaugccauccuccugguggcugugucguucgucacacuaauuaccgggaacauguccuuuaaagaccugggacgaguugugguaauggugggcgcaacuauggccgaugacaucgggaugggagucacauaucucgcucugcuugccgcauucaaggugcggcccaccuuugcggccggcuugcuguuacguaaacucacgucuaaggagcugaugaugacuaccauugguaucguucuucugagccaaucaacaauaccugaaaccgugcuagagcucacugaugcucuggccuuggggaugaugguccugaagaucgugagaaauauggaaaaauaccaguuagcaguuacaauuauggcuauccucugcgugcccaacgccgucauucugcagaaugcauggaagguaaguuguaccauccuugccgugguuuccgugucuccacuguugcucacaagcucccagcagaaaacugacuggauaccucuggcucuaaccauuaagggacugaaccccacggcgaucuuccuuacaacccucucaaggacuaauaaaaagcgcagcuggccacugaacgaggccaucauggcagucggcauggugaguauuuuggcuucuucccugcucaaaaaugacauaccgaugaccggcccucuaguagccgggggacugcuuacagugugcuauguccugacuggucggagcgccgauuuggaacucgagagagcuaccaacguuaagugggaggaccaggcagaaaucucgggcucaucucccauucugaguaucacgauuuccgaggaugggagcaugucuaucaagaaugaagaggaggaacagacacuaaccauacugaucaggacuggacuucucgugauuagcggccuguuuccaaucuccauucccaucacagccgcggcuugguacuugugggaggugaaaaagcagcgagccggugucuuaugggacgugccuucaccacccccuauggggaaagcagaacuggaggauggagccuaucgcauaaagcaaaaaggcauucucggcuacagucagaucggggcuggaguuuacaaggaagguaccuuccacacuauguggcauguaacacggggcgcagugcugaugcacaaggggaaaagaaucgagccgagcugggccgacgucaagaaagaucuuauuucuuauggaggcgguuggaagcuggagggggaauggaaagagggagaagaggugcagguuuuggcgcuagaaccaggcaagaaccccagggcugugcagaccaagccuggccuguuuaaaacgaacacugggaccaucggagccgucucccucgacuucucaccagguacaaguggcagccccauaauugauaagaaagggaaggugguaggacuguacggcaauggugucgugacccguuccggggcauauguuucugccaucgcucaaacagagaaaucgauugaggacaacccugaaaucgaggaugacauauuucgcaagcggagacuuacuauuauggauuuacacccgggagccggcaagaccaaaagguaccugcccgcaaucgugcgagaagcuaucaagcggggccuccgcacguugauucuggccccaacaagagucguggcggccgagauggaagaggcacucagggggcugccuauccgguaucagacucccgcuauucgagccgagcauaccggaagagaaauaguugaccuuaugugucacgcuacauucaccaugcgccuguugagcccagugagggucccuaauuacaaccuaaucauuauggacgaggcacauuucacugaucccgccucaaucgccgcucgugguuauaucuccacccggguggaaaugggcgaggcggcagggauuuuuaugacagccacgccaccgggaaguagagacccuuucccccagucuaaugcuccaauaaucgaugaggaaagggagauucccgaacgcagcuggaacuccggccacgaguggguaacugacuuuaaagguaagaccgugugguucguuccuucaaucaaagccgggaaugauauugcagccugccugcgaaagaacggaaagaaagucauccaacucucuagaaagacauuugacagcgaauacgugaaaacccggacuaaugauugggacuucguggucacaaccgauauaagugagaugggcgcuaacuuuaaggcggagaggguaaucgacccacgccguuguaugaaacccgugauuuuaacggauggcgaagagagaguuauccuggccgggccuaugccggugacucauuccagcgcagcucagcggaggggacgcauuggucgaaauccaaagaacgaaaaugaccaguacaucuauaugggcgagccccuugaaaacgacgaggauugcgcccacuggaaagaggcaaagaugcugcucgacaauauaaacacaccugaagggauuauccccucuauguucgagccagaaagagagaaggucgaugccauugacggagaauaccgguugaggggcgaggcucgcaaaaccuuuguggaucugaugagaaggggugaccucccuguuuggcuggccuauaagguggcggcagaggggaucaacuacgccgaucggcguugguguuucgacggcaucaaaaauaaccagauccuugaagagaaugucgaaguggagauuuggaccaaggagggagaacgcaaaaagcuaaagccccgauggcuggaugcuagaaucuauucagacccauuggccuuaaaagaguuuaaggaguucgcugcaggcaggaaaucccugacucucaaccugauuacagagauggggcggcuuccuaccuucaugacacaaaagacucgcgaugcccuggacaaucucgcuguauugcacacggccgaagcaggagguagagcguacaaccaugcccugagugagcuaccggagacccuggaaacacuccuucuguuaacuuugcuggcuaccgugacaggcgggaucuuucucuuccugaugagcggaaggggcauagguaaaaugacccuugggaugugcugcauuaucacugccucgauccugcucugguaugcacagauucagccccacuggaucgcugccucuauaauuuuggaguuuuuccugaucguuuuacuaauuccagaaccugagaagcagcggacgccccaagauaaucagcugaccuacgucgugaucgcaauacucacaguggucgccgcuacuauggcgaacgaaaugggcuuucuugagaagaccaaaaaggaccugggauugggcuccaucgccacacagcagccagagagcaauauucuggacaucgaucuccgaccugcaucagcuuggacccuguacgccguugccacuacauucgugacgcccaugcuuagacauaguauugaaaacucuuccguaaaugugagccucaccgcaaucgcuaaccaagccacuguccugaugggguugggaaaagguuggccgcugucaaagauggacauuggcgugccauuacuagcgaucggguguuauagucagguuaauccuauaacacugaccgcugcccuccuucuguugguggcacacuacgccauuaucggacccggccugcaggcuaaagcaacccgcgaggcccagaagagggcggcugccgguaucaugaagaacccaacagucgaugggauuacuguaauagaccucgaucccaucccuuaugacccgaaauuugaaaagcaacugggccaggugaugcuuuuaauucugugcguuacacaggugcucaugaugcggaccacaugggcauugugugaggcccugacucuagcuaccggacccaucagcacacugugggaaggcaauccagggcguuucuggaacaccacuauugccgucuccauggcaaauaucuuuagaggaucuuaccucgcuggcgccggucuucuguucagcauaaugaaaaacacgacaaacaccaggcgcgggacuggaaauaucggcgagaccuugggugagaaguggaaaucccggcugaacgcgcucggcaagucagaauuucaaauuuauaaaaagucugggauccaggagguggaucgaacacuggccaaggaaggaauuaaaagaggcgagacugaccaccaugcagucaguagggggucggcuaaguuacgcugguucguggagcggaauaugguuaccccugaaggaaaagugguagaucuuggcugcgguagagggggauggagcuacuauuguggcggucugaagaacgugcgugaggucaaaggccucacaaaagggggacccggccacgaggaaccuaucccaauguccacguacggguggaaucuaguuaggcugcagucuggaguggacgucuuuuucauacccccugaaaagugcgauaccuugcugugugacauuggcgagucaagcccaaaccccacuguggaggccggucggacacuccgcguacuuaaucugguggaaaacugguugaauaacaauacccaguucugcaucaaaguucugaacccguacaugccuuccgugaucgagaagauggaagcacuccaacgaaaauaugggggagcuuuagucagaaauccacugaguaggaacucuacucaugagauguacugggugagcaaugccucaggcaacauugucuccagugugaacaugauaagccggaugcuuaucaaucgcuuuacaaugagacacaagaaagccaccuaugaacccgauguugaccugggcucugggacgaggaacauuggaaucgaguccgagauuccuaaucuagacaucauagguaagcgaaucgaaaagauuaaacaggagcaugaaaccucauggcacuacgaucaggaccacccauauaagacaugggcguaccauggcagcuaugagacuaaacagaccgggucggcuucuaguaugguaaacggagugguccggcuccugacaaagcccugggauguguugccgacuguuacccaaauggcaaugacagacaccacuccuuucggccagcagcguguguuuaaagaaaaggucgauacgagaacacaggagcccaaggaggguaccaaaaagcugaugaaaaucacugccgaauggcucuggaaggagcuugggaaaaagaaaaccccacgcauguguacaagggaagaguucacgcggaaggugagauccaaugcugcccugggagcaauuuuuaccgacgagaacaaguggaaaagcgcccgcgaagcuguagaggauucaagguucugggaauuaguggacaaggagcgaaaucugcacuuggaaggcaaaugcgagacuuguguuuacaacaugaugggcaagcgggagaaaaagcucggggaauuuggaaaggcgaaagguuccagagccaucugguacauguggcugggcgcaagguuccuagaguuugaagcucuuggguuccugaaugaggaucauugguuuucucgcgaaaacagccucaguggagucgagggcgagggucugcacaaguugggguauauucugcgugacguguccaaaaaggaaggaggcgccauguacgcagaugacacagccggcugggacacccggauaacucucgaggaucuuaaaaaugaagagauggugacaaaccacauggaaggggagcauaagaagcuggcugaggccaucuucaaauuaaccuaucaaaauaaggucguuagagugcagaggccuacaccccgcggaacuguaauggacauuaucagccgacgggaucagagagguucuggccaaguggggaccuacggacugaacacguuuaccaauauggaagcgcaguugaucaggcagauggagggcgaaggugucuucaaaaacauucagcaccucacagugacugaggagguugcagugcauaacuggcuggcccgcgucgggagagaacggcuaucaaggauggcuauaaguggagacgauugcgugguaaagccacuugacgaucguuucgccaaugcacugaccgcucucaacgacaugggcaaaauccgaaaggauauucaacagugggagcccuccaagggcuggaaugacuggacacagguuccuuuuugcagccaccauuuccacgaacugaucaugaaagaugggcgcauuuugguggucccauguagaaaccaggacgaguuaaucggacgggccaggauaucucaaggugcuggcuggucgcugcgcgaaacugccugccucgggaagucauaugcacagauguggagccuuauguacuuucacagacgggaucugaggcuagcggccaaugcuaucuguuccgccgugccgagucauugggugcccaccucucgaacgacauggagcauucacgcaaaacaugaguggaugaccacugaggacaugcugacagucuggaaccguguuuggaucagagaaaauccuuggauggaggacaagaccccaguggaauccugggaggaaauucccuaucucggaaaacgcgaggaucaguggugcggcucauugaucggucugacaagucgggcuaccugggccaagaacauacaggcagccauuaaucaaguaaggucucuuaucgggaacgaggaauacacagacuacaugccuagcaugaagagauuccgccgggaggaagaggaagcgggagugcugugguga

SEQ ID NO: 14885 - RNA, 9876 nt, Artificial Sequence
  derived and/or modified CDS sequence (opt3) from DENV-2__EU482472__SS-prME
agcgcaggaaugaucauuaugcugauaccaaccgugauggcuuuccaccucacuacuagaaacggggaaccucauaugaucgucggcauucaggaaaaggguaaaucccuucuguuuaagacggaggacggaguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauacgggggaucaugcaagccggaaaacgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggguuauuggauggaguccgcucugaacgauacuuggaaaaucgagaaggccucauucauagaagucaaaaauugccacuggccuaagagccauacccuuuggucuaacgggguguuggaguccgaaaugauuauccccaagaaccucgcaggacccguuagucaacacaauuaccggccuggcuaccacacgcagaucgcugguccauggcaucugggcaagcuagagauggacuucgauuuuugugacgggacaaccgugauugucacugaagauugcggaaaccgaggccccagccugagaaccacaacugccucugggaagcucaucaccgaguggugcuguagguccugcacacugccgccucuucgcuaucggggagaggacggcuguugguacgguauggaaauuagaccauugaaagagaaggaagagaaucuggugaacucauuaguuacggcggggcacggacagguggauaauuucagucucggcguacuggguauggcccuuuuucuggaagagauguugaggacccgcgucggcacuaaacaugcuauacuccugguggcagugagcuucgucacacuaaucaccgggaacaugucguuuaaggaccugggacgaguugugguaauggugggcgccacuauggcugaugacauugggaugggagucacauaucucgcccugcuugcagcguucaaagugcggcccaccuuugccgcuggcuugcuguuacguaagcucacguccaaggagcugaugaugacuaccaucgguauuguucuucugucucaaagcacaaucccugaaaccgugcuagagcucacugaugcccuggcauuggggaugaugguccugaaaauagugagaaauauggaaaaguaccaguuagcuguuacaaucauggccauucucugcgugcccaacgcagucauccugcagaaugccuggaaaguaucauguaccauucuugcugugguuaguguguccccacuguugcucacaucuagccagcaaaagacugacuggaucccucuggcgcuaaccauaaaaggacugaaccccacggccauuuuccuuacaacccucuccaggacuaauaagaaacgcucauggccacugaacgaggcaaucauggcugucggcauggugagcaucuuggccaguucucuguuaaagaaugacauuccgaugaccggcccucucguagccgggggacugcuuacagugugcuauguccugacuggucgguccgcugauuuggaacucgagagagcaaccgacguuaagugggaggaucaggccgaaauaagcggcucgucacccauccugucuauuacgaucagugaggacggguccaugagcauuaaaaacgaagaggaggaacagacacuaaccauccugauaaggacuggacuucucgugaucucuggccuguuuccaauuagcauccccauuacagcggcugccugguacuugugggaggugaagaaacagcgagccggugucuuaugggaugugccuuccccacccccuauggggaaggccgaacuggaggacggagcuuaucgcaucaaacaaaagggcauacucggcuacucacagauuggggcaggaguuuacaaggaagguaccuuccacacuauguggcauguaacacggggcgccgugcugaugcacaaagggaagagaaucgagccgaguugggcggaugucaaaaaggaccuuaucagcuauggaggcgguuggaaacuggagggggaauggaaggagggagaagaggugcagguuuuggcucuagaaccaggcaagaaucccagggccgugcagaccaaaccuggccuguuuaagacgaacacugggauuaucggagcagucucucucgauuucuccccagguaccucaggcagucccauaauugacaaaaaggggaaagugguaggacuguacggcaacggugucgugacacguagcggggccuauguuuccgcuaucgcccaaaccgagaagucuauugaggauaauccugaaaucgaggacgauauauuucgcaagcggagacuuacaauuauggacuuacacccgggagcaggcaaaacuaagagguaccugcccgcuaucgugcgagaagccaucaaacggggccuccgcaccuugauucuggcgccaacgagagucguggccgcagagauggaagaggcucucagggggcugccuauccgguaucagacacccgccauucgagcugagcauacuggaagagaaauaguugaccuuaugugucacgcaaccuucacaaugcgccuguugucgccagugagggucccuaacuacaaucuaaucauuauggaugaggcccauuucaccgaccccgccagcaucgcugcgcgugguuauaucucaacucggguggaaaugggcgaggcagccgggauuuuuaugaccgcuacaccaccgggauccagagauccuuucccccagaguaacgccccaauaaucgacgaggaaagggagauucccgaacgcucuuggaauagcggccacgaguggguaacggauuuuaaggguaaaacugugugguucguuccuuccaucaaggcagggaacgacauugccgcuugccugcgaaagaauggcaagaaggucauccaacucucaagaaaaaccuuugauucugaauacgugaagacacggaccaacgacugggauuucguggucacuacagacauaagcgagaugggcgcgaauuuuaaagccgagaggguaaucgauccacgccguuguaugaagcccgugauuuuaaccgacggcgaagagagaguuauccuggcagggccuaugccggugacgcauaguuccgcugcccagcggaggggacgcauuggucgaaaccccaaaaaugaaaacgaccaguacaucuauaugggcgagccccuugaaaaugaugaggacugcgcacacuggaaggaggccaagaugcugcucgauaacauaaauacuccugaagggauuauccccagcauguucgagccagaaagagagaaagucgacgcuauugauggagaauaccgguugaggggcgaggcccgcaagacauuuguggaccugaugagaaggggugaucucccuguuuggcuggcguauaaaguggcagccgaggggaucaacuacgcugaccggcguugguguuucgauggcauaaagaacaaucagauccuugaagagaacgucgaaguggagauuuggaccaaagagggagaacgcaagaagcuaaaaccccgauggcuggacgccagaaucuauucugauccauuggcuuuaaaggaguuuaaagaguucgcagccggcaggaagucacugacccucaaucugauuacugagauggggcggcuuccuacauucaugacccagaaaacucgcgacgcucuggauaaccucgccguauugcacacugcagaagcgggagguagagccuacaaucaugcucuguccgagcuaccggagacgcuggaaacccuccuucuguuaacauugcuggccacugugaccggcgggaucuuucucuuccugaugaguggaaggggcauagguaagaugacacuugggaugugcugcauuaucaccgcaagcauccugcucugguaugcucaaauucagccccacuggaucgccgcaucgauaauuuuggaguuuuuccugaucguuuuacuaauuccagaaccugagaagcagcggacuccccaagacaaccagcugacguacgucgugaucgccauacucaccguggucgcugcgacaauggccaaugaaaugggcuuucuugagaaaacuaagaaagaccugggauugggcucuaucgcaacccagcagccagaguccaacauucuggauaucgaccuccgaccugcuagcgccuggacacuguacgccguugcaaccacuuucgugacacccaugcuuagacauucaauugaaaauaguucuguaaacgugucccucacggcuaucgccaaucaagcgaccguccugaugggguugggaaaggguuggccgcugagcaaaauggauauuggcgugccauuacuagcuaucggguguuauucacagguuaacccuauaacucugacagccgcacuccuucuguugguggcccacuacgcuauuaucggacccggccugcaggcaaaggccacccgcgaggcgcagaagagggcugccgcagguaucaugaaaaauccaaccgucgacgggauuacaguaauagaucucgaccccaucccuuaugauccgaaguuugaaaaacaacugggccaggugaugcuuuuaauucugugcguuacucaggugcucaugaugcggacgaccugggccuugugugaggcucugacacuagccacuggacccaucaguacccugugggaaggcaacccagggcguuucuggaauacaaccauugcagucagcauggcuaacaucuuuagaggauccuaccucgccggcgcgggucuucuguucucuauaaugaagaauacuacgaacacaaggcgcgggaccggaaacaucggcgagacuuugggugagaaauggaaaagccggcugaaugcccucggcaaauccgaauuucaaauuuauaagaagucagggauccaggagguggaccgaacccuggcaaaagaaggaauuaagagaggcgagacagaucaccaugcugucucuagggggagugccaaauuacgcugguucguggagcggaacaugguuacuccugaaggaaaggugguagaccuuggcugcgguagagggggauggucguacuauuguggcggucugaaaaaugugcgugaggucaagggccucaccaaagggggacccggccacgaagaaccuaucccaaugagcacauacggguggaaccuaguuaggcugcaguccggaguggaugucuuuuucauacccccugaaaaaugcgacacguugcugugugauauuggcgagucuucaccaaaucccaccguggaggcaggucggacucuccgcguacuuaaccugguggaaaauugguugaacaauaacacacaguucugcaucaagguucugaauccguacaugccuagcgugaucgagaaaauggaagcucuccaacgaaaguaugggggagccuuagucagaaacccacuguccaggaauaguacccaugagauguacugggugucuaacgccagcggcaauauugucucauccgugaacaugauaagucggaugcuuaucaaccgcuuuacuaugagacacaaaaaggcgacauaugaacccgacguugaccugggcagcgggaccaggaauauuggaaucgagucugagauuccuaaccuagauaucauagguaagcgaaucgagaaaauuaagcaggagcaugaaacguccuggcacuacgaccaggaucacccauauaaaaccugggcuuaccauggcucauaugagacaaagcagacugggagcgcaucgucuaugguaaauggagugguccggcuccugaccaaacccugggacguguugccgacaguuacucaaauggccaugaccgauacaaccccuuucggccagcagcguguguuuaaggaaaaggucgacacuagaacgcaggagcccaaagaggguacaaagaaacugaugaagaucaccgcugaauggcucuggaaagagcuugggaagaaaaagacuccacgcauguguaccagggaagaguucacacggaaggugagaaguaacgccgcacugggagccauuuuuacggaugagaauaaauggaaguccgcucgcgaagcgguagaggacagcagguucugggaauuaguggauaaagagcgaaaccugcacuuggaaggcaagugcgagaccuguguuuacaauaugaugggcaaacgggagaagaagcucggggaauuuggaaaagccaaggguucaagagcaaucugguacauguggcugggcgcuagguuccuagaguuugaagcccuuggguuccugaacgaggaccauugguuuucccgcgaaaauucucucagcggagucgagggcgagggucugcacaaauugggguauauucugcgugaugugaguaagaaagaaggaggcgcaauguacgccgacgacacugcuggcugggauacacggauaacccucgaggaccuuaagaacgaagagauggugacuaaucacauggaaggggagcauaagaaacuggccgaggcgaucuucaaguuaacauaucaaaacaaagucguuagagugcagaggccuaccccacgcggaacaguaauggauauuaucucccgacgggaccagagagguagcggccaaguggggacuuacggacugaauaccuuuacgaacauggaagcacaguugaucaggcagauggagggcgaaggugucuucaagaauauucagcaccucaccgugacagaggagguugccgugcauaacuggcuggcucgcgucgggagagaacggcuaucuaggauggccauaucaggagaugacugcgugguaaaaccacuugaugaccguuucgcaaacgcucugacugcccucaaugauaugggcaagauccgaaaggacauucaacagugggagcccaguaaaggcuggaacgauuggacccagguuccuuuuugcucccaccauuuccacgaacugaucaugaaggacgggcgcguguuggucgugccauguagaaaucaggaugaguuaauuggacgggcuaggaucagccaaggugccggcuggucucugcgcgaaacagcaugccucgggaaaucguaugcgcagauguggucacuuauguacuuucacagacgggaccugaggcuagccgcuaacgccauauguagcgcagugccgucccauuggguccccacaagucgaaccacguggucuauccacgcuaagcaugaguggaugacaaccgaggacaugcugacuguuuggaaucguguguggauuagagaaaacccuuggauggaggauaaaacaccaguagaaagcugggaggaaauccccuaucucggaaagcgcgaggaccaguggugcggcuccuugauuggucugaccucacgggccacuugggcaaagaauauccaggccgcgauaaaccaagugaggagucuuauugggaaugaggaauacaccgauuacaugccuucuaugaaaagauuccgccgggaggaagaggaagcuggaguccugugguga

SEQ ID NO: 14886 - RNA, 9876 nt, Artificial Sequence
  derived and/or modified CDS sequence (opt3) from DENV-2__EU482473__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaauuaaagcugaauugguucaagaaagggucuuccauuggacagauguuugaaacgaccaugcggggugccaagcgaauggcuauacuaggcgauacagccugggacuucgggucacucggaggcguauuuacuaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaauauaaauuucagcccgagaguccaagcaaguuggccuccgcuauccagaaagcccaggaagagggcauaugugguauuagaucugucacuaggcucgagaaucugauguggaagcaaaucacacccgaauuaaaccacauucuggcagagaaugaaguuaaacuaaccaucaugacuggcgauauaaaggggaucaugcaggccggaaaacggucgcuccgcccucagccaaccgagcugaaguacagcuggaagacauggggcaaagcuaagaugcuuuccacggaaucauauaaccagaccuucuugauugacgggccggagacugccgagugccccaauacaaacagagcauggaauagucuggaaguggaggauuacggauuuggcguguucaccacaaacaucuggcucaaacugaaggaaaaacaagacgcguuuugugacucuaaguuaaugagcgcugccauuaaggauaauagggcaguacaugccgacauggguuauuggaucgaguccgcucugaacgauacuuggaaaauagagaaggccucauucauugaagucaaaaauugccacuggccuaagagccauacccuuuggucuaacgggguguuggaguccgaaaugaucaucccaaaaaaccucgcaggacccguuagucagcacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaagcucauuaccgaguggugcuguagauccugcacacugccgccucuuagguaucgcggagaggacggcuguugguacgguauggaaauacggccauugaaagagaaggaagagaaucuggugaacucauuaguuacggcggggcacggacaaguggauaauuucagucucggcguacuggguauggcccuuuuucuggaagagauguugagaaccagggucggcacuaaacaugcuauccuccugguggcagugagcuucgucacacuaauuaccgggaacaugucguuuaaggaccugggacgcguugugguaauggugggcgccacuauggcugaugacaucgggaugggagucacauaucucgcccugcuugcagcguucaaagugcgacccaccuuugccgcuggcuugcuguuacggaagcucacguccaaggagcugaugaugacuaccauugguaucguucuucugucucagagcacaauaccugaaaccgugcuagagcucacugaugcccuggcauuggggaugaugguccugaaaaucgugcguaauauggaaaaguaccaguuagcuguuacaauuauggccauccucugcgugcccaacgcagucauucugcagaaugccuggaaaguaucauguaccauccuugcugugguuaguguguccccacuguugcucacaucuagccaacagaagacugacuggauaccucuggcgcuaaccauuaaaggacugaaccccacggccaucuuccuuacaacccucuccagaacuaauaagaaaaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaagugggaggaucaggccgaaaucagcggcucgucacccauucugucuaucacgauuagugaggacggguccaugagcaucaaaaacgaagaggaggaacagacacuaaccauacugaucagaacuggacuucucgugauuucuggccuguuuccaaucagcauucccaucacagcggcugccugguacuugugggaggugaagaaacaaagggcaggugucuuaugggaugugccuuccccacccccuauggggaaggccgaacuggaggacggagcuuaucgaauaaaacagaagggcauucucggcuacucacagaucggggcaggaguuuacaaggaagguaccuuccacacuauguggcauguaacacgcggcgccgugcugaugcacaaagggaagcggaucgagccgaguugggcggaugucaaaaaggaccuuauuagcuauggaggcgguuggaaacuggagggggaauggaaggagggagaagaggugcagguuuuggcucuagaaccaggcaagaaucccagagccgugcaaaccaaaccuggccuguuuaagacgaacacugggaccaucggagcagucucucucgauuucuccccagguacaucaggcagucccauaauugacaggaaagggaaggugguaggacuguacggcaacggugucgugacccguagcggggccuauguuuccgcuaucgcccagacagagaaaucuauugaggauaauccugaaaucgaggacgauauauuucgcaagcggagacuuacuauuauggacuuacacccgggagcaggcaagaccaaaagguaccugcccgcuaucgugcgagaagccaucaagcggggccuccgcacguugauucuggcgccaacaagagucguggccgcagagauggaagaggcucucagggggcugccuauccgguaucagacucccgccauucgagcugagcauaccggaagagaaauaguugaccuuaugugucacgcaacauucaccaugcgccuguugucgccagugagggucccuaacuacaaucuaaucauuauggaugaggcccauuucacugaccccgccagcaucgcugcgcgugguuauaucucaacccggguggaaaugggcgaggcagccgggauuuuuaugacagcuacgccaccgggauccagagauccuuucccccaaaguaacgccccaauaaucgacgaggaaagggagauucccgaacgcucuuggaauagcggccacgaguggguaacugauuuuaaagguaagaccgugugguucguuccuuccaucaaagcagggaacgacauugccgcuugccugcgaaagaauggaaagaaagucauccagcucucaagaaagacauuugauucugaauacgugaaaacccggacuaacgacugggauuucguggucacaaccgacauaagcgagaugggcgcgaauuuuaaggccgagaggguaaucgauccacgccguuguaugaaacccgugauuuuaacggacggcgaagagagaguuauccuggcagggccuaugccggugacucauaguuccgcugcccagcggaggggacgcauuggucgaaacccaaagaaugaaaacgaccaguacaucuauaugggcgagccccuugaaaaugaugaggacugcgcacacuggaaagaggccaagaugcugcucgauaacauaaauacaccugaagggauuauccccagcauguucgagccagaaagagagaaggucgacgcuauugauggagaauaccgguugaggggcgaggcccgcaaaaccuuuguggaccugaugagaaggggugaucucccuguuuggcuggcguauaagguggcagccgaggggaucaacuacgcugaccggcguugguguuucgauggcauaaaaaacaaucaaauccuugaagagaacgucgaaguggagauuuggaccaaggagggagaacgcaaaaagcuaaagccccgauggcuggacgccagaaucuauucugauccauuggcuuuaaaagaguuuaaggaauucgcagccggcaggaaaucacugacucucaaucugauuacagagauggggcggcuuccuaccuucaugacacagaagacucgcgacgcucuggauaaccucgccguauugcacacggcagaagcgggagguagagccuacaaucaugcucuguccgagcuaccggagacccuggaaacacuccuucuguuaacuuugcuggccaccgugacaggcgggaucuuucucuuccugaugaguggaaggggcauagguaaaaugacccuugggaugugcugcauuaucacugcaagcauccugcucugguaugcucagauucagccccacuggaucgccgcaucgauaauuuuggaguuuuuccugaucguuuuacuaauuccagaaccugagaagcaacggacgccccaggacaaccagcugaccuacgucgugaucgccauacucacaguggucgcugcgacuauggccaaugaaaugggcuuucuugagaagaccaaaaaggaccugggauugggcucuaucgcaacacagcaaccagaguccaacauucuggauaucgaccuccgaccugcuagcgccuggacccuguacgccguugcaacuacauucgugacgcccaugcuuagacauucaauugaaaauaguucuguaaacgugucccucaccgcuaucgccaaucaggcgacuguccugaugggguugggaaaagguuggccgcugagcaagauggauauuggcgugccauuacuagcuaucggguguuauucacagguuaacccuauaacacugaccgccgcacuccuucuguugguggcccacuacgcuauuaucggacccggccugcaggcaaaagccacccgcgaggcgcaaaagagggcugccgcagguaucaugaagaauccaacagucgacgggauuacuguaauagaucucgaccccaucccuuaugauccgaaauuugaaaagcagcugggccaggugaugcuuuuaauucugugcguuacgcaagugcucaugaugcggaccacaugggccuugugugaggcucugacucuagccaccggacccaucaguacacugugggaaggcaacccagggcguuucuggaauaccacuauugcagucagcauggcuaacaucuuuagaggauccuaccucgccggcgcgggucuucuguucucuauaaugaaaaauacgacaaacaccaggcgcgggacuggaaacaugggcgagaccuugggugagaaguggaaaagccggcugaaugcccucggcaaguccgaauuucagaucuauaaaaagucagggauucaggagguggaccgaacacuggcaaaggaaggaaucaaaagaggcgagacugaucaccaugcugucucuagggggagugccaaguuacgcugguucguggagcggaacaugguuaccccugaaggaaaagugguagaccuuggcugcgguagagggggauggucguacuauuguggcggucugaagaaugugcgugaggucaaaggccucacaaaggggggacccggccacgaagagccuauuccaaugagcacguacggguggaaccuaguuaggcugcaguccggaguggaugucuuuuucauccccccugaaaagugcgacaccuugcugugugauauaggcgagucuucaccaaaucccacuguggaggcaggucggacacuccgcguacuuaaccugguggaaaauugguugaacaauaacacccaauucugcauuaaaguucugaauccguacaugccuagcgugaucgagaagauggaagcucuccagcgaaaauaugggggagccuuagucagaaacccacuguccaggaauaguacucaugagauguacugggugucuaacgccagcggcaauaucgucucauccgugaacaugauuagucggaugcuuauaaaccgcuuuacaaugagacacaagaaagcgaccuaugaacccgacguugaccugggcagcgggacgaggaauaucggaauugagucugagaccccuaaccuagauaucauugguaagcgaaucgaaaagauaaaacaggagcaugaaacauccuggcacuacgaccaggaucacccauauaagacuugggcuuaccauggcucauaugagaccaaacaaacagggagcgcaucgucuaugguaaauggagugguccggcuccugacuaagcccugggacguguugccgaccguuacacagauggccaugaccgauacuacgccuuucggccagcagcguguguuuaaagaaaaggucgacacaagaacccaagagcccaaggaggguacuaaaaagcugaugaaaaucaccgcugaauggcucuggaaggagcuugggaaaaagaaaacaccacgcauguguacgagggaagaguucacccggaaggugagaaguaacgccgcacugggagccauuuuuacugaugagaauaaguggaaauccgcucgcgaagcgguagaggacagcagguucugggaauuaguggauaaggagcgaaaccugcacuuggaaggcaaaugcgagacauguguuuacaauaugaugggcaagcgggagaaaaagcucggggaauuuggaaaggccaaagguucaagagcaaucugguacauguggcugggcgcuagguuccuagaguuugaagcccuuggguuccugaacgaggaccauugguuuucccgcgaaaauucucucagcggagucgagggcgagggucugcacaaguugggguauauucugcgugaugugaguaaaaaggaaggaggcgcaauguacgccgacgacaccgcuggcugggauacucggaucacacucgaggaccuuaaaaacgaagagauggugaccaaucacauggaaggggagcauaagaagcuggccgaggcgauuuucaaauuaacauaucagaacaaggucguuagagugcagaggccuacuccccgcggaaccguaauggauauaaucucccgacgggaccaaagagguagcggccagguggggacguacggacugaauaccuuuacaaacauggaagcacaguugauuaggcagauggagggcgaaggugucuucaaaaauauccaacaccucacugugaccgaggagguugccgugcagaacuggcuggcucgcgucgggagagaacggcuaucuaggauggccaucucaggagaugacugcgugguaaagccacuugaugaccguuucgcaaacgcucugacagcccucaaugauaugggcaaaauucgaaaggacauacagcagugggagcccaguaagggcuggaacgauuggacucaaguuccuuuuugcucccaucacuuccaugaacugaucaugaaagacgggcgcguguuggucgugccauguagaaaucaggaugaguuaauuggacgggcuaggaucagccagggugccggcuggucucugcgcgaaaccgcaugccucgggaagucguaugcgcagauguggucacuuauguacuuucacagacgggaccugaggcuagccgcuaacgccauuuguagcgcagugccgucccacuggguccccacgagucgaacaaccuggucuauccaugcuaaacacgaguggaugacuacagaggacaugcugaccguuuggaaucguguguggauaagagaaaacccuuggauggaggauaagacuccaguagaaagcugggaggaaauccccuaucucggaaaacgcgaggaccaauggugcggcuccuugauuggucugaccucacgggccacaugggcaaagaauauccagguggccauuaaccaggucaggagucuuaucgggaaugaggaauacacggauuacaugccuucuaugaagagauuccgccgggaggaagaggaagcgggagugcugugguga

SEQ ID NO: 14887 - RNA, 9876 nt, Artificial Sequence
  derived and/or modified CDS sequence (opt3) from DENV-2__EU482474__SS-prME
agcgcaggaaugauaauuaugcugauaccaaccgugauggcuuuccaccucacuacuagaaacggggaaccucauaugaucguagguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccacaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuaucaacauugaagcugagcccccauuuggcgacucguacaucaucauuggaguugagccuggccaguuaaagcugaauugguucaaaaaggggucuuccauaggacaaauguuugaaacgaccaugcggggugccaaacgaauggcuauccuaggcgauacagccugggacuucgggucacucggaggcguguuuacaaguauugguaaggcacugcaucagguauucggggccaucuauggcgcugcguuuagcggagucuccuggaccaugaaaauucuuaucggcgugauaaucacauggauugggaugaacucucgcagcacuucauugaguguuucccuggugcucgucggaaucgugacccuguaccuuggcguaauggugcaggcagauagcgguuguguugucucuuggaagaauaaggagcugaaaugcgggucaggaauuuucaucacggacaacgugcacacauggaccgaacaguauaaguuucaacccgagaguccaagcaaauuggccuccgcuauacagaaggcccaggaagagggcauuugugguaucagaucugugacuaggcucgagaaucugauguggaaacagauuacacccgaauuaaaccacauccuggcagagaaugaagucaagcuaaccauaaugacuggcgauaucaaagggauuaugcaagccggaaagcggucgcuccgcccucagccaaccgagcugaaguacagcuggaaaacauggggcaaggcuaaaaugcuuuccacggaaucacauaaccagaccuucuugaucgacgggccggagacugccgagugccccaauacaaacagagcauggaauagucuggaaguugaggauuauggauuuggcguguucaccacaaacauuuggcucaggcugaaggaaaaacaggacgcguuuugugacucuaaguuaaugagcgcugccaucaaggauaaucgugcagugcacgccgacauggguuacuggauagaguccgcucugaacgauacuuggaaaauugagaaggccucauucaucgaagucaagaauugccauuggccuaagagccacacccuuuggucuaacggggucuuggaguccgaaaugaucauucccaagaaccucgcaggacccgugagucaacacaauuaucggccuggcuaccauacgcagaucgcugguccauggcaccugggcaagcuagagauggacuucgauuuuugugacgggacaaccguuauugugacugaagauugcggaaaccgaggccccagccugagaaccacaacugccucugggaagcucauaaccgaguggugcuguagguccugcacacugccgccucuucgcuaccggggagaggacggcuguugguaugguauggaaaucagaccauugaaagagaaggaagagaaucuggucaacucauuagugacggcggggcauggacagguugauaauuucagucucggcgugcuggguauggcccuuuuucuggaagagauguugaggacccgcguaggcacuaaacacgcuauucuccuggucgcagugagcuucgugacacuaaucaccgggaacaugucguuuaaggaccugggacgagucguugugaugguaggcgccacuauggcugaugacauugggaugggagugacauaccucgcccugcuugcagcguucaaaguccggcccaccuuugccgcuggcuugcuguuacguaagcucacguccaaggagcugaugaugacuaccaucgguauagugcuucugucucaaagcacaaucccugaaaccguucuagagcucacugaugcccuggcauuggggaugauggugcugaaaauugucagaaauauggaaaaguaucaguuagcugugacaaucauggccauucucugcguucccaacgcagugauccugcagaaugccuggaaagucucauguaccauacuugcuguagugaguguuuccccacuguugcucacaucuagccagcaaaagacugacuggauuccucuggcgcuaaccaucaaaggacugaaccccacggccaucuuccuuacaacccucuccaggacuaauaagaaacgcucauggccacugaacgaggcaauuauggcugugggcauggucagcauauuggccaguucucuguuaaagaaugacaucccgaugaccggcccucucguggccgggggacugcuuacaguaugcuacgugcugacuggucgguccgcugauuuggaacucgagagagcaaccgacgucaagugggaggaucaggccgaaauuagcggcucgucacccauccugucuauuacgaucagugaggacggguccaugagcaucaaaaacgaagaggaggaacagacacuaaccauccugauuaggacuggacuucucguuaucucuggccuguuuccaauuagcauccccauaacagcggcugccugguauuugugggaggugaagaaacagcgagccgguguguuaugggaugucccuuccccacccccuauggggaaggccgaacuggaggacggagcuuaccgcauuaaacaaaagggcauccucggcuauucacagaucggggcaggaguguacaaggaagguaccuuccauacuauguggcacguuacacggggcgccguacugaugcacaaagggaagagaauugagccgaguugggcggaugugaaaaaggaccuuaucagcuacggaggcgguuggaaacuggagggggaauggaaggagggagaagagguccagguguuggcucuagaaccaggcaagaaucccagggccguucagaccaaaccuggccuguuuaagacgaacacugggaccauaggagcagugucucucgauuucuccccagguacaucaggcagucccauuaucgacaaaaaggggaaagucgugggacuguauggcaacgguguagucacccguagcggggccuacguguccgcuauugcccaaacagagaagucuaucgaggauaauccugaaauagaggacgauauuuuucgcaagcggagacuuacuaucauggacuuacauccgggagcaggcaaaaccaagagguaucugcccgcuaucguucgagaagccauuaaacggggccuccgcacguugauccuggcgccaacaagaguggucgccgcagagauggaagaggcucucagggggcugccuauucgguaccagacucccgccauacgagcugagcacaccggaagagaaaucguggaccuuaugugucaugcaacauucaccaugcgccuguugucgccaguuagggugccuaacuauaaucuaauuaucauggaugaggcccacuucacugaccccgccagcaucgcugcgcgugguuacauuucaacccgggucgaaaugggcgaggcagccgggauauuuaugacagcuacgccaccgggauccagagauccuuucccccagaguaacgccccaaucauugacgaggaaagggagauccccgaacgcucuuggaauagcggccaugagugggugacugauuuuaaggguaaaaccguaugguucgugccuuccauuaaggcagggaacgacaucgccgcuugccugcgaaagaauggcaaaaagguuauacaacucucaagaaaaacauuugauucugaauaugucaagacccggacuaacgacugggauuucguggugacaaccgacaucagcgagaugggcgcgaauuuuaaagccgagagggucauugauccacgccguuguaugaagcccguaaucuuaacggacggcgaagagagagugauucuggcagggccuaugccgguuacucacaguuccgcugcccagcggaggggacgcaucggucgaaaccccaaaaaugaaaacgaccaguacauauacaugggcgagccccuugaaaaugaugaggacugcgcacacuggaaggaggccaagaugcugcucgauaacauuaauacaccugaagggaucauucccagcauguucgagccagaaagagagaaaguggacgcugucgauggagaauaucgguugaggggcgaggcccgcaagaccuuuguggaccugaugagaaggggugaucucccuguuuggcuggcguacaaaguggcagccgaggggaucaacuaugcugaccggcguugguguuucgauggcauaaagaacaaucagauccuugaagagaacgucgaaguggagauuuggaccaaagagggagaacgcaagaagcuaaaaccccgauggcuggacgccagaaucuacucugauccauuggcuuuaaaggaguuuaaagaguucgcagccggcaggaagucacugacucucaaucugauuacagagauggggcggcuuccuaccuucaugacacagaaaacucgcgacgcucuggauaaccucgccguauugcauacggcagaagcgggagguagagccuauaaucacgcucuguccgagcuaccggagacccuggaaacacuccuucuguuaacuuugcuggccaccgugacaggcgggaucuuucucuuccugaugaguggaaggggcauagguaagaugacccuugggaugugcugcauuguuacugcaagcauccugcucugguacgcucagauccagccccauuggauugccgcaucgaucauauuggaguuuuuccugauugucuuacuaaucccagaaccugagaagcagcggacgccccaagacaaccagcugaccuauguggugauugccauccucacagucguugcugcgacuauggccaaugaaaugggcuuucuugagaaaaccaagaaagaccugggauugggcucuauagcaacacagcagccagaguccaacauccuggauauugaccuccgaccugcuagcgccuggacccuguacgccguggcaacuacauucguaacgcccaugcuuagacacucaaucgaaaauaguucugugaacgucucccucaccgcuauugccaaucaagcgacugugcugaugggguugggaaaggguuggccgcugagcaaaauggauaucggcguuccauuacuagcuauuggguguuacucacaggugaacccuaucacacugaccgccgcacuccuucuguuggucgcccacuaugcuauaauuggacccggccugcaggcaaaggccacccgcgaggcgcagaagagggcugccgcagguaucaugaaaaauccaacaguagacgggaucacugugauugaucucgaccccauaccuuacgauccgaaguuugaaaaacaacugggccagguuaugcuuuuaauccugugcgugacgcagguccucaugaugcggaccacaugggccuugugugaggcucugacucuagccaccggacccauuaguacacugugggaaggcaacccagggcguuucuggaauaccacuaucgcagugagcauggcuaacauuuuuagaggauccuaucucgccggcgcgggucuucuguucucuaucaugaagaauacgacaaacaccaggcgcgggacuggaaacaugggcgagaccuugggugagaaauggaaaagccggcugaaugcccucggcaaauccgaauuucaaauauacaagaagucagggauccaggaggucgaccgaacacuggcaaaagaaggaauuaagagaggcgagacugaucaucacgcugugucuagggggagugccaaauuacgcugguucguugagcggaacauggugaccccugaaggaaagguaguggaccuuggcugcgguagagggggauggucguauuacuguggcggucugaaaaauguccgugagguuaagggccucacaaaagggggacccggccaugaagaaccuaucccaaugagcacguauggguggaaccuagugaggcugcaguccggagucgauguguuuuucauucccccugaaaaaugcgacaccuugcugugugauaucggcgagucuucaccaaaucccacuguagaggcaggucggacacuccgcgugcuuaaccugguugaaaauugguugaacaauaacacccaguucugcauaaaggugcugaauccguacaugccuagcgucauugagaaaauggaagcucuccaacgaaaguacgggggagccuuagugagaaacccacuguccaggaauaguacucacgagauguauugggucucuaacgccagcggcaauaucgugucauccguuaacaugaucagucggaugcuuauuaaccgcuuuacaaugagacauaaaaaggcgaccuacgaacccgacguagaccugggcagcgggacgaggaauauaggaaucgagucugagauuccuaaccuagauaucauugguaagcgaaucgagaaaauaaagcaggagcacgaaaccuccuggcacuaugaccaggaucauccauacaaaacaugggcuuaucacggcucauacgagacuaagcagaccgggagcgcaucgucuauggugaauggagucgugcggcuccugacaaaacccugggacguuuugccgacugugacccaaauggccaugacagauaccacuccuuucggccagcagcgugucuuuaaggaaaagguggacacgagaacacaggagcccaaagaggguaccaagaaacugaugaagaucacugcugaauggcucuggaaagagcuugggaagaaaaagaccccacgcauguguacaagggaagaguucacgcggaagguaagaaguaacgccgcacugggagccauuuuuaccgaugagaauaaauggaaguccgcucgcgaagcgguggaggacagcagguucugggaauuaguugauaaagagcgaaaccugcauuuggaaggcaagugcgagacuugugucuauaauaugaugggcaaacgggagaagaagcucggggaauuuggaaaagccaaggguucaagagcaaucugguacauguggcugggcgcuagguuccuagaguuugaagcccuuggguuccugaacgaggaccacugguuuucccgcgaaaauucucucagcggaguggagggcgagggucugcacaaauugggguacauucugcgugaugugaguaagaaagaaggaggcgcaauguaugccgacgacacagcuggcugggauacccggaucacucucgaggaccuuaagaacgaagagauggucacaaaucauauggaaggggagcacaagaaacuggccgaggcgauuuucaaguuaaccuaccaaaacaaaguugugagaguacagaggccuacaccccgcggaacugugauggauauaaucucccgacgggaccagagagguagcggccaagucgggaccuauggacugaauacguuuaccaacauggaagcacaguugauuaggcagauggagggcgaagguguguucaagaauauccagcaucucacaguuacugaggagguggccguccaaaacuggcuggcucgcguggggagagaacggcuaucuaggauggccaucucaggagaugacugcguaguuaaaccacuugaugaccguuucgcaaacgcucugaccgcccucaaugauaugggcaagauucgaaaggacauacagcagugggagcccaguaaaggcuggaacgauuggacacaggugccuuuuugcucccaccauuuccacgaacugaucaugaaggacgggcgcgucuugguggugccauguagaaaucaagaugaguuaauuggacgggcuaggaucagccagggugccggcuggucucugcgcgaaacugcaugccucgggaaaucguacgcgcagauguggucacuuauguauuuucacagacgggaccugaggcuagccgcuaacgccauuuguagcgcagucccgucccauuggguucccaccagucgaacgacauggucuauccacgcuaagcaugaguggaugaccacugaggacaugcugacaguguggaaucguguauggauaagagaaaacccuuggauggaggauaaaaccccaguggaaagcugggaggaaauccccuaccucggaaagcgcgaggaccaguggugcggcuccuugauuggucugacuucacgggccaccugggcaaagaauauccaagccgcgauuaaccaggucaggagucuuaucgggaaugaggaauauacagauuacaugccuucuaugaaaagauuccgccgggaggaagaggaagcuggagugcugugguga

SEQ ID NO: 14888 - RNA, 9876 nt, Artificial Sequence
  derived and/or modified CDS sequence (opt3) from DENV-2__EU482475__SS-prME
agcgcaggcaugaucauuaugcugauacccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucauucugcagaaugccuggaagguaucauguaccauccuugcugugguuaguguguccccacuguugcucacaucuagccagcagaagacugacuggauaccucuggcgcuaaccauuaagggacugaaccccacggccaucuuccuuacaacccucuccagaacuaauaaaaagaggucauggccacugaacgaggcaaucauggcugucggcauggugagcauuuuggccaguucucuguuaaagaaugacauaccgaugaccggcccucucguagccgggggacugcuuacagugugcuauguccugacuggucgcuccgcugauuuggaacucgagcgggcaaccgacguuaaaugggaggaucaggccgaaaucagcggcucgucacccauucugucuaucacgauuagugaggacggguccaugagcaucaagaacgaagaggaggaacagacacuaaccauacugaucagaacuggacuucucgugauuucuggccuguuuccaaucagcauucccaucacagcggcugccugguacuugugggaggugaaaaagcagagggccggugucuuaugggaugugccuuccccacccccuauggggaaagccgaacuggaggacggagcuuaucgaauaaagcaaaagggcauucucggcuacucacagaucggggcaggaguuuacaaagaagguaccuuccacacuauguggcauguaacacgcggcgccgugcugaugcacaaggggaaacggaucgagccgaguugggcggaugucaagaaagaccuuauuagcuauggaggcgguuggaagcuggagggggaauggaaggagggagaagaggugcagguuuuggcucuagaaccaggcaaaaaucccagagccgugcagaccaagccuggccuguuuaaaacgaacacugggaccaucggagcagucucucucgauuucuccccagguacaucaggcagucccauaauugacaagaaagggaaggugguaggacuguacggcaacggugucgugaccaggagcggggccuauguuuccgcuaucgcccaaacagagaagucuauugaggauaauccugaaaucgaggacgauauauuucguaaacgccggcuuacuauuauggacuuacacccgggagcaggcaagaccaaaagauaccugcccgcuaucgugagggaagccaucaagcgaggccuccggacguugauucuggcgccaacacgcgucguggccgcagagauggaagaggcucucagagggcugccuaucagguaucagacucccgccauucgggcugagcauaccggacgagaaauaguugaccuuaugugucacgcaacauucaccaugagacuguugucgccagugcgcgucccuaacuacaaucuaaucauuauggaugaggcccauuucacugaccccgccagcaucgcugcgagggguuauaucucaacccguguggaaaugggcgaggcagccgggauuuuuaugacagcuacgccaccgggaucccgggauccuuucccccagaguaacgccccaauaaucgacgaggaaagagagauucccgaaaggucuuggaauagcggccacgaguggguaacugauuuuaaagguaagaccgugugguucguuccuuccaucaaggcagggaacgacauugccgcuugccugcgcaaaaauggaaagaaagucauccaacucucacgaaagacauuugauucugaauacgugaaaaccagaacuaacgacugggauuucguggucacaaccgacauaagcgagaugggcgcgaauuuuaaggccgagcggguaaucgauccaaggcgcuguaugaaacccgugauuuuaacggacggcgaagaacguguuauccuggcagggccuaugccggugacucauaguuccgcugcccagagacggggaaggauuggucgcaacccaaagaaugaaaacgaccaguacaucuauaugggcgagccccuugaaaaugaugaggacugcgcacacuggaaggaggccaaaaugcugcucgauaacauaaauacaccugaagggauuauccccagcauguucgagccagaacgagagaaggucgacgcuauugauggagaauacagauugcggggcgaggccaggaaaaccuuuguggaccugaugcgcagaggugaucucccuguuuggcuggcguauaagguggcagccgaggggaucaacuacgucgacaggcggugguguuucgauggcaucaaaaacaaucagauccuugaagagaacguggaaguagagauuuggaccaaggagggagaacguaagaaacuaaagccccgcuggcuggacgcucgaaucuauucugauccauuggccuuaaaagaguuuaaggaguucgcugcaggcagaaaaucacugacucucaaucugauuacagagauggggaggcuuccuaccuucaugacacaaaagacucgggacgcccuggauaaccucgcuguguugcacacggccgaagcaggaggucgcgcguacaaucaugcccuguccgagcuaccggagacccuggaaacacuccuucuguuaacuuugcuggcuaccguuacaggcgggaucuuucucuuccugaugaguggaagaggcauagguaagaugacccuugggaugugcugcauuaucacugccagcauccugcucugguaugcacagauucagccccacuggaucgcugccucgauaauuuuggaguuuuuccugaucgucuuacuaauuccagaaccugagaaacagaggacgccccaagacaaccagcugaccuacguggugaucgcaauacucacagucguugccgcuacuauggcgaaugaaaugggcuuucuugagaagaccaaaaaggaccugggauugggcucuaucgccacacagcagccagaguccaacauucuggauaucgaccuccggccugcaagcgcuuggacccuguacgccguggccacuacauucguaacgcccaugcuucgacauucaauugaaaauaguucugugaacgucucccucaccgcaaucgcuaaucaagccacugugcugaugggguugggaaaagguuggccgcugagcaagauggauauuggcguuccauuacuagcgaucggguguuauucacaggugaacccuauaacacugaccgcugcccuccuucuguuggucgcacacuacgccauuaucggacccggccugcaggcuaaggcaaccagagaggcccagaaacgcgcggcugccgguaucaugaagaauccaacaguagacgggauuacugugauagaucucgaccccaucccuuaugauccgaaauuugaaaagcaacugggccagguuaugcuuuuaauucugugcgugacgcagguccucaugaugaggaccacaugggcauugugugaggcccugacucuagcuaccggacccaucaguacacugugggaaggcaacccagggcgguucuggaauaccacuauugccgugagcauggcaaacaucuuucguggauccuaccucgcuggcgccggucuucuguucucuauaaugaaaaauacgacaaacaccagaagggggacuggaaacaugggcgagaccuugggugagaaguggaaaagccgccugaaugcgcucggcaaguccgaauuucaaaucuauaagcggucagggauucaggaggucgaccgaacacuggccaaagaaggaaucaagagaggcgagacugaucaccaugcagugucuagggggagugcuaaauuacgcugguucguugagcggaacauggugaccccugaaggaaagguaguggaccuuggcugcgguagagggggauggucguacuauuguggcggucugaaaaauguccgugagguuaagggccucacaaaagggggacccggccacgaagaaccuauuccaaugagcacguacggguggaaccuagugaggcugcaguccggagucgauguguuuuucauacccccugaaaaaugcgacaccuugcugugugauauaggcgagucuucaccaaaucccacuguagaggccggucggacacuccgcgugcuuaaccugguugaaaauugguugaacaauaacacccaguucugcauuaaggugcugaauccguacaugccuagcgucaucgagaaaauggaagcacuccaacgaaaguaugggggagcuuuagugagaaacccacuguccaggaauaguacucaugagauguacugggucucuaacgccagcggcaauaucgugucauccguuaacaugauuagucggaugcuuauaaaccgcuuuacaaugagacacaaaaaggccaccuaugaacccgacguagaccugggcagcgggacgaggaauaucggaauugagucugagaucccuaaccuagauauuaucgguaagcgaauagagaaaaucaagcaggagcaugaaaccuccuggcacuacgaccaggaucacccauauaaaacaugggcguaccauggcucauaugagacuaagcagaccgggagcgcuucgucuauggugaauggagucgugcggcuccugacaaaacccugggacguuuugccgacugugacccaaauggcaaugacagauaccacuccuuucggccagcagcgugucuuuaaggaaaagguggacacgagaacacaggagcccaaagaggguaccaagaaacugaugaagauuacugccgaauggcucuggaaagagcuugggaagaaaaagaccccacgcauguguacaagggaagaguucacgcggaagguaagaaguaacgcugcccugggagcaaucuuuaccgaugagaauaaauggaaguccgcccgcgaagcuguggaggacagcagguucugggaauuaguugauaaagagcgaaaccugcacuuggaaggcaagugcgagacuugugucuacaauaugaugggcaaacgggagaagaagcucggggaauuuggaaaagcgaaggguucaagagccauuugguacauguggcugggcgcaagguuccuagaguuugaagcucuuggguuccugaacgaggaccauugguuuucccgcgaaaauucucucagcggaguggagggcgagggucugcacaaauugggguauauccugcgugaugugaguaagaaagaaggaggcgccauguacgcagacgacacagccggcugggauacccggauuacucucgaggaccuuaagaacgaagagauggucacaaaucacaugaagggggaacauaaaaagcuggcugaggccauauucaaauuaaccuaucaaaacaagguugugagaguacagaggccuacaccccgcggaacugugauggauaucauuucccgacgggaccagagagguagcggccaagucgggaccuacggacugaauacguuuaccaacauggaggcgcaguugaucaggcagauggaaggcgaggguguguucaaaaauauccagcaccucacaguuacugaagagguggcaguccaaaacuggcuggcccgcguggggagagagcggcuaucuaggauggcuauuucaggagaugacugcguaguuaagccacuugaugaccguuucgccaacgcacugaccgcucucaaugauaugggcaagauacgaaaagacauccagcagugggaacccaguaagggcuggaacgauuggacacaggugccuuuuugcucccaucacuuccaugagcugauuaugaaagacgggcgcgucuugguggugccauguagaaaucaagaugaauuaaucggacgggccaggauuagccagggugcuggcuggucucugcgcgagacugccugccucgggaagucguaugcacagauguggucacuuauguacuuucacagacgggaccugaggcuagcggccaacgcuaucuguagcgccgucccgucccacuggguucccaccagucgaacgacauggucuauacaugcaaaacacgaauggaugaccacugaggacaugcugacaguguggaaucguguauggaucagagagaacccuuggauggaagauaagaccccaguggagagcugggaagagauucccuaucucggaaagcgcgaagaccaguggugcggcuccuugaucggucugacuucacgggcuaccugggccaaaaauauucaagcagccaucaaccaggucaggagucuuauagggaaugaggaguacacagauuacaugccuucuaugaagagauuccgccgggaagaggaagaggcgggagugcugugguga

SEQ ID NO: 14889 - RNA, 9876 nt, Artificial Sequence
  derived and/or modified CDS sequence (opt3) from DENV-2__EU482541__SS-prME
agcgccggaaugauaauuaugcugauacccaccgugauggcuuuccaccucaccacuagaaacggggagccucauaugaucgucggcauucaggaaaaggguaaaucccuucuguuuaagacggaggacggcguuaauaugugcaccuugauggcaauggauuuaggggaacugugugaggacacaaucacuuacaaaugcccauuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaauggaaaucaagguaacgccgcagucaaguauuacagaggcugaacugaccggcuaugguacugugaccauggaguguagccccagaacagggcuugauuucaaugaaaugguccuguugcaaauggagaacaaagccuggcucgugcacaggcagugguuucuggacuuaccucugccauggcuccccggcgcagauaagcaggagucuaauuggauccagaaggaaacccuuguuacuuucaaaaacccucaugcuaagaaacaagacguggucgugcugggaucccaggagggcgccaugcacacagcguugacgggggccaccgaaauacagaugucaagcggaaaucuacuguuuacuggucaucucaagugccggcugcguauggacaaacuucaacugaagggcaugaguuacucuauguguacagggaaguucaaaguaguuaaggagauugcagagacccagcacggaacaaucgugauccgcguccaguaugaaggcgaugguuccccaugcaaaauucccuucgagaucauggacuuggaaaagagauacgugcucgggaggcugauuacugucaacccgauagugaccgagaaagauagcccuguuaacaucgaagcugagcccccauuuggcgacucguacauuaucaucggaguggagccuggccaguuaaagcugaauugguucaagaaagggucuuccauuggacaaauguuugaaacgaccaugcggggugccaagcgaauggcuauacuaggcgauacagccugggacuucgggucacucggaggcguauuuacaaguaucgguaaagcacugcaucaggucuucggggccauuuauggcgcugcguuuagcggaguguccuggaccaugaagauccuuauuggcguuaucauaacauggaucgggaugaacucucgcagcacuucauugagugugucccugguccucgugggaauuguaacccuguaccuuggcgugaugguucaggcagauagcgguugugucgugucuuggaaaaauaaggagcugaagugcgggucaggaaucuucauuacggacaacgugcacacauggaccgaacaguauaaauuucaacccgagaguccaagcaaguuggccuccgcuauccagaaagcccaggaagagggcauaugugguauuagaucugucacuaggcucgagaaucugauguggaagcagaucacacccgaauuaaaccacauucuggcagagaaugaaguuaaacuaaccaucaugacuggcgauauacgggggaucaugcaagccggaaagcgcucgcucagaccucagccagcugagcugaaauacagcuggaagaccuggggcaaggccaaaaugcuuuccacagaaucauauaaccagacguucuugauugacgggccggagaccgcagagugccccaauacuaacagggcguggaauagucuggaaguggaggauuacggauuuggcguguucacaaccaacaucuggcucaagcugaaagaaaagcaggacgcuuuuugugacucuaaauuaaugagcgccgcaauuaaggauaaucgugccguacaugcugacauggguuauuggaucgaguccgcccugaacgauacauggaagauagagaaagcaucauucauugaagucaagaauugccacuggccuaaaagccauacucuuuggucuaacgggguguuggaguccgaaaugaucaucccaaagaaccucgcuggacccguuagucaacacaauuaccggccuggcuaccacacccagauugccgguccauggcaucugggcaaacuagagauggacuucgauuuuugugacgggacgacagugaucgucaccgaagauugcggaaaccgaggccccagccugagaacuaccacagcgucugggaagcucauuacugaguggugcuguagguccugcacccugccgccucuucgcuaucggggagaggacggcuguugguacgguauggaaauaagaccauugaaggagaaagaagagaaucuggugaacucauuaguuacagccgggcacggacagguggauaauuucagucucggcguacuggguauggcucuuuuucuggaagagauguugaggacgcgcgucggcaccaagcaugcaauccuccugguggccgugagcuucgucacucuaauuacagggaacaugucguuuaaagaccugggacgaguugugguaauggugggcgcuaccauggccgaugacaucgggaugggagucacuuaucucgcacugcuugcggccuucaaggugcggcccacauuugcugccggcuugcuguuacguaaacucaccuccaaggagcugaugaugacgacuauugguaucguucuucugucucaaagcaccauaccugaaacagugcuagagcucaccgaugcacuggcuuuggggaugaugguccugaagaucgugagaaauauggaaaaauaccaguuagccguuacuauuauggcaauccucugcgugcccaacgccgucauucugcagaaugcuuggaagguaucauguacaauccuugcggugguuaguguguccccacuguugcucaccucuagccagcaaaagacugacuggauaccucuggcccuaacuauuaagggacugaaccccaccgcaaucuuccuuacgacacucuccaggaccaauaaaaagcgcucauggccacugaacgaggcuaucauggccgucggcauggugagcauuuuggccaguucucugcucaaaaaugacauaccgaugacuggcccucuaguagcugggggacugcuuaccgugugcuauguccugacaggucgguccgcagauuuggaacucgagagagccacugacguuaagugggaggaucaggcggaaaucagcggcucgucacccauucugucuaucaccauuagugaggacggguccaugagcaucaagaacgaagaggaggaacagacgcuaacaauacugaucaggaccggacuucucgugauuucuggccuguuuccaaucagcauucccaucacugcugccgcaugguacuugugggaggugaaaaagcagcgagccggugucuuaugggaugugccuuccccacccccuauggggaaagcugaacuggaggacggagcauaucgcauaaagcaaaaaggcauucucggcuacucacagaucggggccggaguuuacaaggaagguacauuccacaccauguggcauguaacucggggcgcggugcugaugcacaaggggaaaagaaucgagccgaguugggcugaugucaagaaagaccuuauuagcuauggaggcgguuggaagcuggagggggaauggaaagagggagaagaggugcagguuuuggcccuagaaccaggcaagaaucccagggcagugcagacaaagccuggccuguuuaaaaccaacacggggacuaucggagccgucucucucgauuucuccccagguaccucaggcagucccauaauugacaagaaagggaaggugguaggacuguacggcaacggugucgugacacguagcggggcuuauguuuccgccaucgcacaaaccgagaaaucuauugaggauaauccugaaaucgaggacgauauauuucgcaagcggagacuuacaauuauggacuuacacccgggagcuggcaagacuaaaagguaccugcccgccaucgugcgagaagcgaucaagcggggccuccgcaccuugauucuggccccaacgagagucguggcagcugagauggaagaggcccucagggggcugccuauccgguaucagacacccgcuauucgagcagagcauacuggaagagaaauaguugaccuuaugugucacgccaccuucacaaugcgccuguugucgccagugagggucccuaacuacaaucuaaucauuauggaugaggcccauuucaccgaccccgcuagcaucgcggcacgugguuauaucucaacucggguggaaaugggcgaggccgcugggauuuuuaugaccgccacaccaccgggauccagagauccuuucccccagaguaacgcaccaauaaucgacgaggaaagggagauucccgaacgcucuuggaauagcggccacgaguggguaacggauuuuaaagguaagacugugugguucguuccuuccaucaaagccgggaacgacauugcugcgugccugcgaaagaauggaaagaaagucauccaacucucaagaaagaccuuugauucugaauacgugaaaacacggaccaacgacugggauuucguggucacuacagacauaagcgagaugggcgccaauuuuaaggcagagaggguaaucgauccacgccguuguaugaaacccgugauuuuaaccgacggcgaagagagaguuauccuggcugggccuaugccggugacgcauaguuccgccgcacagcggaggggacgcauuggucgaaacccaaagaaugaaaacgaccaguacaucuauaugggcgagccccuugaaaaugaugaggacugcgcccacuggaaagaggcuaagaugcugcucgauaacauaaauacuccugaagggauuauccccagcauguucgagccagaaagagagaaggucgacgccauugauggagaauaccgguugaggggcgaggcgcgcaaaacauuuguggaccugaugagaaggggugaucucccuguuuggcuggcauauaagguggccgcugaggggaucaacuacgccgaccggcguugguguuucgauggcaucaaaaacaaucagauccuugaagagaacgucgaaguggagauuuggaccaaggagggagaacgcaaaaagcuaaagccccgauggcuggacgcuagaaucuauucugauccauuggcauuaaaagaguuuaaggaguucgccgcuggcaggaaaucacugacccucaaucugauuacugagauggggcggcuuccuacauucaugacccaaaagacacgcgacgcccuggauaaccucgcaguauugcacacugcggaagccggagguagagcuuacaaucaugcccuguccgagcuaccggagacgcuggaaacccuccuucuguuaacauugcuggcaacugugaccggcgggaucuuucucuuccugaugaguggaaggggcauagguaaaaugacacuugggaugugcugcauuaucaccgcuagcauccugcucugguaugcccagauucagccccacuggaucgcagccucgauaauuuuggaguuuuuccugaucguuuuacuaauuccagaaccugagaagcagcggacuccccaagacaaccagcugacguacgucgugaucgcuauacucaccguggucgcggccacaauggcaaaugaaaugggcuuucuugagaagacuaaaaaggaccugggauugggcucuaucgcuacccagcagccagaguccaacauucuggauaucgaccuccgaccugccagcgccuggacacuguacgcaguugcuaccacuuucgugacacccaugcuuagacauucaauugaaaauaguucuguaaacgugucccucacggccaucgcgaaucaagcuaccguccugaugggguugggaaaagguuggccgcugagcaagauggauauuggcgugccauuacuagccaucggguguuauucacagguuaacccuauaacucugacagcagcccuccuucuguugguggcucacuacgcaauuaucggacccggccugcaggccaaagcgacccgcgaggcucagaagagggccgcagccgguaucaugaagaauccaaccgucgacgggauuacaguaauagaucucgaccccaucccuuaugauccgaaauuugaaaagcaacugggccaggugaugcuuuuaauucugugcguuacucaggugcucaugaugcggacgaccugggcuuugugugaggcccugacacuagcaacuggacccaucaguacccugugggaaggcaacccagggcguuucuggaauacaaccauugcugucagcauggccaacaucuuuagaggauccuaccucgcgggcgccggucuucuguucucuauaaugaaaaauacuacgaacacaaggcgcgggaccggaaacaucggcgagacuuugggugagaaguggaaaagccggcugaaugcacucggcaaguccgaauuucaaauuuauaaaaagucagggauccaggagguggaccgaacccuggcuaaggaaggaauuaaaagaggcgagacagaucaccaugccgucucuagggggagugcaaaguuacgcugguucguggagcggaacaugguuacuccugaaggaaaagugguagaccuuggcugcgguagagggggauggucguacuauuguggcggucugaagaaugugcgugaggucaaaggccucaccaaagggggacccggccacgaggaaccuaucccaaugagcacauacggguggaaccuaguuaggcugcaguccggaguggaugucuuuuucauacccccugaaaagugcgacacguugcugugugauauuggcgagucuucaccaaaucccaccguggaggcuggucggacucuccgcguacuuaaccugguggaaaauugguugaacaauaacacacaguucugcaucaaaguucugaauccguacaugccuagcgugaucgagaagauggaagcccuccaacgaaaauaugggggagccuuagucagaaacccacuguccaggaauaguacccaugagauguacugggugucuaacgcgagcggcaauauugucucauccgugaacaugauaagucggaugcuuaucaaccgcuuuacuaugagacacaagaaagcuacauaugaacccgacguugaccugggcagcgggaccaggaauauuggaaucgagucugagauuccuaaccuagauaucauagguaagcgaaucgaaaagauuaaacaggagcaugaaacguccuggcacuacgaccaggaucacccauauaagaccugggcauaccauggcucauaugagacaaaacagacugggagcgccucgucuaugguaaauggagugguccggcuccugaccaagcccugggacguguugccgacaguuacucaaauggcuaugaccgauacaaccccuuucggccagcagcguguguuuaaagaaaaggucgacacuagaacgcaggagcccaaggaggguacuaaaaagcugaugaaaaucaccgccgaauggcucuggaaggagcuugggaaaaagaaaacuccacgcauguguaccagggaagaguucacacggaaggugagaaguaacgcagcccugggagcuauuuuuacggaugagaauaaguggaaauccgcgcgcgaagccguagaggacagcagguucugggaauuaguggauaaggagcgaaaccugcacuuggaaggcaaaugcgagaccuguguuuacaauaugaugggcaagcgggagaaaaagcucggggaauuuggaaaggcaaaagguucaagagcuaucugguacauguggcugggcgccagguuccuagaguuugaagcacuuggguuccugaacgaggaccauugguuuucccgcgaaaauucucucagcggagucgagggcgagggucugcacaaguugggguauauucugcgugaugugaguaaaaaggaaggaggcgccauguacgcugacgacacugccggcugggauacacggauaacccucgaggaccuuaaaaacgaagagauggugacuaaucacauggaaggggagcauaagaagcuggcggaggcaaucuucaaauuaacauaucaaaacaaggucguuagagugcagaggccuacaccccgcggaacaguaauggauauuaucucccgacgggaccagagagguagcggccaaguggggacuuacggacugaauaccuuuacgaacauggaagcccaguugaucaggcagauggagggcgaaggugucuucaaaaauauucagcgccucaccgugacagaggagguugcugugcacaacuggcuggccagagucgggcgggaaaggcuaucucguauggcaauaucaggagaugacugcgugguaaagccacuugaugaccgauucgcuaacgcccugacugcucucaaugauaugggcaaaauccgcaaggacauucaacagugggagcccaguaagggcuggaacgauuggacccagguuccuuuuugcucccaucacuuccaugaacugaucaugaaagacgggagaauuuugguggucccaugucggaaucaggaugaguuaaucggaagggcccgcauaagccaaggugcaggcuggucucugagagaaacagcgugccucgggaagucguaugcccagauguggucacuuauguacuuucaccggagggaccugcgacuagcugccaacgcaaucuguagcgcugugccgucccacugggugcccacaagucguaccacguggucuauucaugccaaacacgaguggaugacaaccgaggacaugcugacugucuggaauagaguuuggauccgcgaaaacccuuggauggaggauaagacaccaguggaaagcugggaggaaauucccuaucucggaaaacgggaggaccaguggugcggcuccuugaucggucugaccucaagggcaacuugggccaagaauauacaggcggcuauuaaccaaguaagaagucuuaucgggaaugaggaauacaccgauuacaugccuucuaugaagcgcuuccggagggaggaagaggaagccggagugcugugguga

SEQ ID NO: 14890 - RNA, 9876 nt, Artificial Sequence
  derived and/or modified CDS sequence (opt3) from DENV-2__EU482542__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagagcaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggacaggaaaucaagguaacgccgcaaucaaguauuacagaggcugaacugaccggcuaugguacugugaccauggaguguagccccagaacagggcuugauuucaaugaaaugguccuguugcagauggagaacaaagccuggcucgugcacaggcagugguuucuggacuuaccucugccauggcuccccggcgcagauaagcaggagucuaauuggauccaaaaggaaacccuuguuacuuucaaaaacccucaugcuaagaaacaggacguggucgugcugggaucccaggagggcgccaugcacacagcguugacgggggccaccgaaauacaaaugucaagcggaaaucuacuguuuacuggucaucucaagugccggcugcguauggacaaacuucagcugaagggcaugaguuacucuauguguacagggaaguucaaaguaguuaaggagauugcagagacccagcacggaacaaucgugauccgcguccaguaugaaggcgaugguuccccaugcaaagugcccuucgagauuauggacuuggaaaagagauacguccucgggaggcugaucacugugaacccgauuguuaccgagaaagauagcccugugaacauagaagcugagcccccauuuggcgacucguacaucauuaucggaguagagccuggccaauuaaagcugaauugguucaagaaagggucuuccaucggacagauguuugaaacgaccaugcggggugccaagcgaauggcuauucuaggcgauacagccugggacuucgggucacucggaggcgucuuuacuaguauagguaaagcacugcaucagguguucggggccaucuauggcgcugcguuuagcggaguuuccuggaccaugaagauucuuaucggcgugauuaucacauggauagggaugaacucucgcagcacuucauugagugucucccuggugcucguaggaaucgugacccuguaccuuggcguuaugguccaggcagauagcgguuguguggugucuuggaaaaauaaggagcugaagugcgggucaggaauuuucaucacggacaacguccacacauggaccgaacaauauaaauuucagcccgagaguccaagcaaguuggccuccgcuauucagaaagcccaggaagagggcacuugugguaucagaucuguuacaaggcucgagaaucugauguggaagcaaauaacccccgaauuaaaccacauucuggcagagaaugaagugaaacuaacuaucaugaccggcgauauuaaggggaucaugcaggccggaaaacggucgcuccgcccucagccaacagagcugaaguacagcuggaagacguggggcaaagcuaagaugcuuuccaccgaaucauauaaccagacuuucuugauagacgggccggagacagccgagugccccaauaccaacagagcauggaauagucuggaaguggaggauuacggauuuggcguauucacaacuaacaucuggcucaaacugaaggaaaaacaagacgcguuuugugacucuaaguuaaugagcgcugccauuaaggauaauagggcaguccaugccgacauggguuauuggaucgaguccgcucugaacgauaccuggaaaauugagaaggccucauucaucgaagugaaaaauugccacuggccuaagagccauacgcuuuggucuaacgggguuuuggaguccgaaaugauaauuccaaaaaaccucgcaggacccgugagucagcacaauuaccguccuggcuaccacacacagaucgcugguccauggcaucugggcaagcuagagauggacuucgauuuuugugacgggaccacugucaucgugaccgaagauugcggaaaccggggccccagccugcgaacaacuaccgccucugggaagcucauuacagaguggugcuguagauccugcacgcugccgccucuuagguaucgcggagaggacggcuguugguacgguauggaaauccggccauugaaagagaaggaagagaaucugguuaacucauuagugaccgcggggcacggacaaguagauaauuucagucucggcguccuggguauggcccuuuuucuggaagagauguugaaaacuagagugggcacaaagcaugcuauucuccugguggcagucagcuucguuacccuaauaacugggaacaugucguuuaaagaccugggaagggugguagugauggucggcgccacaauggcugaugacaucgggaugggagugaccuaucucgcccugcuugcagcguucaagguucgccccacguuugccgcuggcuugcuguuacgaaagcucacuuccaaagagcugaugaugaccacaauugguaucgugcuucugucucagagcaccauuccugaaacuguccuagagcucacagaugcccuggcauuggggaugauggugcugaagaucguucggaauauggaaaaauaccaguuagcugugaccauaauggccauccucugcguccccaacgcaguaauucugcagaaugccuggaaggugucauguacaauccuugcuguugugagugucuccccacuguugcucacuucuagccaacagaaaaccgacuggauuccucuggcgcuaacgaucaagggacugaaccccacagccauauuccuuaccacucucucccguaccaauaaaaagagaucauggccacugaacgaggcaauuauggcugugggcaugguaagcaucuuggccaguucucuguuaaagaaugacaucccgaugacaggcccucucguggccgggggacugcuuacugucugcuauguucugaccgguagguccgcugauuuggaacucgagcgcgcaacggacgugaaaugggaggaucaggccgaaauuagcggcucgucacccauacugucuaucacaauuagugaggacggguccaugagcaucaagaacgaagaggaggaacagacccuaacuauucugauccggacaggacuucucgugauaucuggccuguuuccaaucagcauucccaucaccgcggcugccugguacuugugggaggucaaaaagcaaagagcagguguguuaugggauguuccuuccccacccccuauggggaaagccgaacuggaggacggagcuuauaggauuaagcagaagggcauccucggcuacucacagauaggggcaggaguauacaaagaagguacuuuccacacaauguggcaugugacccgaggcgccguccugaugcacaaggggaaacgcauugagccgaguugggcggaugugaagaaagaccuuaucagcuauggaggcgguuggaagcuggagggggaauggaaggagggagaagagguucagguguuggcucuagaaccaggcaaaaauccccgggccguccaaacgaagccuggccuguuuaaaacuaacaccgggacaaucggagcagugucucucgauuucuccccagguaccucaggcagucccauuaucgacaagaaagggaagguagucggacuguacggcaacggugugguuacaagaagcggggccuauguguccgcuauagcccagacugagaagucuauugaggauaauccugaaaucgaggacgauauuuuuaggaaacgucgccuuaccaucauggacuuacacccgggagcaggcaagacgaaacgguaccugcccgcuauagucagagaagccauuaagaggggccuccgaacauugauccuggcgccaacucgggugguugccgcagagauggaagaggcucuccgcgggcugccuaucagauaucagacccccgccauuagggcugagcauacaggacgggaaaucguggaccuuaugugucacgcaaccuucacuaugcgacuguugucgccagucagagugccuaacuacaaucuaauuauaauggaugaggcccauuucaccgaccccgccagcaucgcugcgcgcgguuauauuucaacaaggguagaaaugggcgaggcagccgggaucuuuaugacggcuacuccaccgggaucccgugauccuuucccccaaaguaacgccccaaucauugacgaggaacgggagauacccgaaagaucuuggaauagcggccacgagugggugaccgauuuuaaagguaagacaguuugguucgucccuuccaucaaggcagggaacgacauugccgcuugccugaggaaaaauggaaagaaagugauccagcucucacgcaagaccuuugauucugaauacgugaaaacucgaacaaacgacugggauuucgucguaaccacggacauuagcgagaugggcgcgaauuuuaaggccgagagagugaucgauccacggagguguaugaaacccguuauauuaacugacggcgaagagcgcgugauccuggcagggccuaugccggucacacauaguuccgcugcccagcguagaggacggauugguaggaacccaaagaaugaaaacgaccaguacaucuauaugggcgagccccuugaaaaugaugaggacugcgcacacuggaaggaggccaaaaugcugcucgauaacauuaauaccccugaagggaucauacccagcauguucgagccagaacgcgagaagguggacgcuauugauggagaauaccgauugagaggcgaggcccggaaaaccuuuguugaccugaugaggcgcggugaucucccuguguggcuggcguauaaggucgcagccgaggggaucaacuacgcugacagaaggugguguuucgauggcauuaaaaacaaucaaauccuugaagagaacguggaaguagagauauggacuaaggagggagaacggaagaaacuaaagccccguuggcuggacgcccgcaucuauucugauccauuggcuuuaaaagaguuuaaggaauucgcagccggccgaaaaucacugacacucaaucugauuaccgagauggggagacuuccuacauucaugacucagaagacgagggacgcucuggauaaccucgccguguugcacaccgcagaagcgggaggucgggccuacaaucaugcucuguccgagcuaccggagacacuggaaacucuccuucuguuaaccuugcuggccacaguuaccggcgggaucuuucucuuccugaugaguggaaagggcauugguaaaaugacucuugggaugugcugcaucauaacggcaagcauucugcucugguaugcucagauccagccccacuggaucgccgcaucgauuaucuuggaguuuuuccugauagucuuacuaauuccagaaccugagaagcaacgcaccccccaggacaaccagcugacauacguggugaucgccauucucacugucguugcugcgaccauggccaaugaaaugggcuuucuugagaaaacaaagaaagaccugggauugggcucuaucgcaacccagcaaccagaguccaacauacuggauaucgaccucagaccugcuagcgccuggacucuguacgccguggcaacaacguucguaacccccaugcuuaggcauucaauugaaaauaguucugugaacgucucccucacugcuaucgccaaucaggcgacagugcugaugggguugggaaaggguuggccgcugagcaagauggauauuggcguuccauuacuagcuaucggguguuauucacaggugaacccuauuacccugaccgccgcacuccuucuguuggucgcccacuacgcuaucauaggacccggccugcaggcaaaagccacacgggaggcgcaaaagcgagcugccgcagguauuaugaaaaauccaacuguagacgggaucacggugaucgaucucgaccccauuccuuaugauccgaaguuugaaaaacagcugggccagguuaugcuuuuaauacugugcgugacccaaguccucaugaugagaacaacuugggccuugugugaggcucugacccuagccacaggacccaucaguacccugugggaaggcaacccagggcgcuucuggaauacuacgauugcagugagcauggcuaacaucuuuaggggauccuaccucgccggcgcgggucuucuguucucuauuaugaagaauacaaccaacacucggcgugggaccggaaacaugggcgagacauugggugagaaauggaagagcagacugaaugcccucggcaaguccgaauuucagaucuauaaaaagucagggauacaggaggucgacaggacucuggcaaaagaaggaaucaagcgcggcgagaccgaucaccaugcugugucucgggggagugccaaauuacgaugguucguugagagaaacauggugacaccugaaggaaagguaguggaccuuggcugcgguagggggggauggucguacuauuguggcggucugaagaauguccgcgagguuaaaggccucacgaaggggggacccggccacgaagagccuauuccaaugagcaccuacggguggaaccuagugcggcugcaguccggagucgauguguuuuucauccccccugaaaaaugcgacacuuugcugugugauauuggcgagucuucaccaaaucccacaguagaggcagguagaacccuccgugugcuuaaccugguugaaaauugguugaacaauaacacucaauucugcaucaaggugcugaauccguacaugccuagcgucauagagaaaauggaagcucuccagaggaaguaugggggagccuuagugcggaacccacugucccgcaauaguacacaugagauguacugggucucuaacgccagcggcaauauugugucauccguuaacaugaucagucgaaugcuuaucaacagauuuaccaugaggcacaagaaagcgacguaugaacccgacguagaccugggcagcgggacccggaauauuggaauagagucugagaucccuaaccuagauauuaucgguaagcgcauugaaaaaaucaagcaggagcaugaaacauccuggcacuacgaccaggaucacccauauaaaacuugggcuuaccauggcucauaugagaccaagcaaacagggagcgcaucgucuauggugaauggagucgugagacuccugacuaagcccugggacguuuugccgaccgugacacagauggccaugaccgauacuacgccuuucggccagcagagggucuuuaaagaaaagguggacacacgaacccaagagcccaaagaggguacuaagaaacugaugaagauaaccgcugaauggcucuggaaagagcuugggaagaagaaaacaccacggauguguacgcgugaagaguucaccagaaagguacgcaguaacgccgcacugggagccaucuuuacugaugagaauaaauggaaguccgcuagggaagcgguggaggacagccgguucugggaauuaguugauaaagagagaaaccugcacuuggaaggcaagugcgagacaugugucuacaauaugaugggcaagcgcgagaaaaagcucggggaauuuggaaaagccaaggguucaagggcaauuugguacauguggcugggcgcucgauuccuagaguuugaagcccuuggguuccugaacgaggaccauugguuuucccgggaaaauucucucagcggaguggagggcgagggucugcacaaauugggguauauccugagagaugugaguaagaaggaaggaggcgcaauguacgccgacgacaccgcuggcugggauacuaggauuacacucgaggaccuuaaaaacgaagagauggucaccaaucacauggaaggggagcauaagaaacuggccgaggcgaucuucaaguuaacauaucagaacaaaguugugcgcguacagcguccuacuccccggggaaccgugauggauauuauauccagaagggaccaacgcgguagcggccaggucgggacguacggacugaauaccuuuacaaacauggaagcacaguugauccgacagauggagggcgaagguguguucaagaauauucaacaccucacuguuaccgaggagguggccguccagaacuggcuggcucggguggggagagaaaggcuaucucgcauggccaucucaggagaugacugcguaguuaagccacuugaugacagauucgcaaacgcucugacagcccucaaugauaugggcaaaauccggaaggacauucagcagugggagcccaguaaaggcuggaacgauuggacucaagugccuuuuugcucccaucacuuccaugaacugauaaugaaggacgggaggaucuuggucgugccaugucguaaucaggaugaguuaauuggacgagcucgcaucagccagggugccggcuggucucugagagaaaccgcaugccucgggaaaucguaugcgcagauguggucacuuauguacuuucaccggagggaccugcgccuagccgcuaacgccauuuguagcgcagugccgucccacuggguccccacgaguagaacaaccuggucuauccaugcuaagcacgaguggaugacuacagaggacaugcugaccguuuggaaucggguguggauaagggaaaacccuuggauggaggauaagacuccaguagaaagcugggaggaaauccccuaucucggaaaacgagaggaccaauggugcggcuccuugauuggucugaccucacgugccacaugggcaaagaauauccaggccgcgauuaaccaggugagaagucuuaucgggaaugaggaauacacggauuacaugccuucuaugaaacgcuuccggagggaggaagaggaagcuggaguccugugguga

SEQ ID NO: 14891 - RNA, 9876 nt, Artificial Sequence
  derived and/or modified CDS sequence (opt3) from DENV-2__JX966380__SS-prME
accgccggcaugaucauuaugcugauacccacagugauggcuuuccaccucacuacgagaaacggggagccucauaugaucgucagcaggcaggaaaagggaaaaucccuucuguuuaagaccaaagacgguacaaauaugugcacuuugauggcaauggauuuaggcgagcugugugaagacaccauuacauacaagugcccauuccuaaaacaaaacgagccggaagauaucgacuguuggugcaauucuaccucaacuuggguuacauaugggaccuguacgacuaccggagagcaccggcgcgagaagcgaaguguggcccucguaccccaugugggcaugggucuggaaacacguacugagaccuggaugagcuccgaaggggcguggaagcacgcucagagaauugagacauggauccuuaggcauccuggauuuaccauaauggccgcaauccuggccuacacgauuggcacuacacacuuccagcgggucuugaucuuuauucuccugaccgcuaucgcaccaucuaugacuaugcgcugcauaggcauuucgaacagagauuucguggaggggguuucaggagguagcuggguggacaucguccuggaacacggcaguugugugacaaccauggccaaaaauaagcccacgcucgauuuugaguuaauuaaaaccgaagcuaagcagccugccacacugaggaaauauugcaucgaggcgaagcuuacuaacaccacaacugacucccgguguccaacccaaggggaacccacauugaaugaggagcaggauaagcgcuucguaugcaaacauucuaugguugaccgaggauggggcaacgguugugggcuguuuggaaagggcggcaucgugaccugcgcaauguucacuugcaaaaagaauauggaagggaaaauuguccagccugagaaccuagaauacacgguggugauaacaccacacagcggagaggaacaugccgucgguaaugauaccggcaagcacgggaaagagguuaagaucacuccgcaguccucaauuaccgaggcugaacucacaggauauggcaccgugacuauggaguguagucccagaacaggucuggacuuuaacgaaaugguacuucugcaaaugaaggauaaagccugguuggugcacaggcagugguuccucgaccugccuuuaccauggcugcccggggcagacacgcagggcagcaauuggauccagaaggagacccucgucacuuuuaaaaacccucaugcuaagaaacaagaugugguugugcuuggaucucaggaaggcgccaugcacacagcgcugaccggggccacagagauacagauguccucaggaaauuugcuauucacuggucaucugaagugccggcuccguauggacaagcugcaacuuaaaggcaugagcuacaguauguguaccgggaaguucaaaauugucaaggagaucgcagaaacgcagcacggaaccaucgugauucgcguacaguaugagggcgaugguucuccaugcaaaauccccuuugaaauuauggaccuggagaagagacauguuuuggggaggcucauaacagugaacccgaucgucacugagaaggauuccccugugaacauugaagcugagcccccauucggcgacagcuacaucaucauuggagucgaaccuggccagcugaaauuagauugguuuaagaaagggucgucuauaggacaaauguucgagaccacaaugcggggugccaagcgaauggcuauccugggcgacacugccugggauuuugggucccuaggaggcguguucaccucaauugguaaagcacuccaccagguuuuuggggccaucuacggcgcugcguucaguggagugagcuggacgaugaagauucugaucggcguaauaaucacauggauugggaugaauucccgcucuaccagccuuucagucaguuuggugcugguuggaaucgugacucucuaucugggcgucauggugcaggcagacuccgguuguguagugagcuggaagaacaaagaacuuaagugcgggucuggaauuuuuguuacagauaauguccacaccuggacugagcaguacaaauuccaacccgagucaccaaguaagcuggccagcgcuauccagaaagcccaugaagagggcauaugugguauuagauccgugaccagguuggaaaaccucauguggaagcagaucacaucugagcugaaucacauuuuaucggaaaacgaggugaaacugacgaucaugaccggcgacauaaaggggaucaugcaggucggaaagcggagccuacgcccccaaccuacugagcucagauauuccuggaaaacauggggcaaggcaaaaacccugucaacagaacuucauaaucagacuuuuuugauugacgggccagagaccgccgaaugcccgaacacgaauagggcuuggaacagucuggagguugaagauuacggauucggcguguuuacaaccaauaucuggcuccgucugcgggagaagcaggacguguucugugauucuaaauuaaugagcgccgcaauuaaggacaaccgagcgguacacgcugauauggguuauuggaucgaguccgcccugaaugacacuuggaagauagaaaaagcaucauucauugaggucaagagcugccacuggcccaaaucucauacccuuugguccaacgggguguuggaaagugagaugguuaucccuaagaauuuugccggaccagugagccagcacaacaacagacccggcuaccauacacaaacugcugguccuuggcaccucggcaaacuggagauggauuucgacuuuugugaagggaccacagucgugguuacggaggauugcggaaauaggggcccaucucuacgcaccacuacagccuccgggaagcugaucaccgaauggugcugucggucaugcacucuccccccgcugagauauaggggagaggacggcuguugguacgguauggaaauucgcccucuuaaggagaaagaggaaaacuuggugaguagccugguaacagcagggcauggacagaucgauaauuucucguuaggcauucucgguauggcucuguuucuugaggaaaugcugcgaacccgggucggcacgaagcacgccauauugcucguggcgguguccuucgucacucugaucaccgggaacaugucuuuucgugaccuaggaagaguuauggugaugguaggcgccacaaugaccgaugacauugggaugggagugacuuaccuggcucuccuggcagccuucaaagucaggccaacauuuaccgcuggccuuuugcugcgcaaguuaacaagcaaagagcucaugaugacuaccaucgguauugugcugcuuucacagaguuccauccccgaaacgauacuggagcuaacagacgcccucgcacuggggaugaugguuuugaagauggugcggaauauggagaaguaucaacuggcggucaccaucauggccauuuuaugcgugccuaacgcuguuauccuccagaaugccuggaaagugucuuguacuauucuggcagucguaagcguguccccccuucuguugaccucaagccagcagaaggcugauuggaucccacucgcccugacaauaaaaggacuaaacccuacugcaauuuuccugaccacgcuuaguagaacaucuaagaaaagguccuggccccucaaugaagccaucauggcuguuggcauggugagcauccuggcgucgucauugcugaagaacgacauuccaaugaccggcccguuagucgccgggggacuccugacugugugcuacguacuuacaggucgaucugcagaucuggaguuggaacgcgcuaccgacgugaaaugggaugaccaagccgagauaaguggcuccagcccuauccucucuauuacuaucagcgaagauggguccaugucaauuaagaaugaggaggaagagcagacacugaccauccuaauacggacgggacugcuugucaucaguggccucuuucccguuagcauuccaaucacugccgcugcaugguaucugugggaagugaagaaacagagagccgguguguugugggacguccccucuccuccacccguggggaaggcggaguuagaggauggagcuuacaggauuaaacagaagggcauccugggcuauucccaaauaggggccggaguuuacaaagaagguaccuuccacacaauguggcauguaacccguggcgcagugcucaugcacaaggggaagcgcauugagccuucaugggccgacgucaaaaaggaucugaucaguuauggaggcgguuggaaacuugaaggggaguggaaggaaggagaggaggugcagguucuggcuuuggaaccgggcaaaaacccacgggcagugcagacaaagcccggccuauuuagaacuaauaccgggacgaucggagccgucagccuggacuucuccccugguacaucuggcucgccaauuguggauaagaaagggaagguagucggacucuacggcaacggugugguuacuaggagcggggcguacgugucagcuaucgcccagaccgagaaauccauagaagacaaucccgagauugaagacgauaucuuccgaaagcggcgccugacaauuauggaccuucauccuggagcaggcaaaaccaagagauauuuaccggccaucgucagggaggcuauaaagcggggccugcgaacucucauuuuggcccccaccagagugguugcagcugagauggaagaggcccugcgcgggcucccaaucagguaccaaacaccugcgauccgugccgaacacacgggacgggagauuguggaucugaugugucaugcaacuuuuaccaugagacuucugagucccaucagggucccaaacuauaacuugauuauaauggacgaagcucacuucacagauccugccucuaucgcugcacgcgguuacauuagcacccgaguggagaugggcgaggccgccgggaucuuuaugacugcuacacccccaggauccagagacccguucccucagucaaaugcgcccaucauggaugaagagcgggaaauuccagagaggucuuggaacagcggccacgaguggguaaccgacuuuaaagguaagacggugugguucguucccaguauaaaaacugggaaugauaucgcagccugccuacgcaagaacggaaaacgugucauucagcuguccagaaagacauuugacagcgaauaugugaagacccggaccaaugauugggacuucguggucacuacagacaucucugagaugggcgcuaacuuuaaagccgaaaggguaauugauccucgccgauguaugaagccagugauccucaccgacggcgaggaaagaguuauauuagcagggcccaugccugugacacauucauccgccgcucaacggaggggacgcaucgguagaaauccgaggaacgagaaugaucaguacauuuauaugggcgagccacuggaaaacgacgaggauugcgcgcacuggaaagaagccaagaugcuucuggacaauaucaacacucccgaggggauuaucccuaguauguucgaacccgagcgggagaaagucgaugcaauagacggagaauaccgucuccgcggcgaggcucgaaagacguuuguggauuugaugagaaggggugaccugccaguuuggcucgccuacaaaguggcagccgaagggauuaauuaugcugaucggcgcugguguuucgacggcaccagaaacaaucagauccuggaggaaaacgucgagguggagauuuggacaaaggaaggagagaggaagaaacuuaagccucgguggcuagaugcccgaaucuacagcgacccccuggcguugaaagaauucaaggaguuugcagccggcagaaaaucguuaacucugaaccucauaaccgagauggggcgccugccaacauucaugacccagaaggcuagggacgcccuugauaaucuggcuguacuccauacugcagaagccggagguaaggcuuauaaccacgccuugucugagcugccugaaacgcuagagacccugcuccuucugacauuauuggcaacugugaccggcgggaucuuucuguuccucauguccggacggggcauugguaaaaugacacuggggaugugcugcaucauuaccgcgagcauccuucugugguacgcccaaauacagccgcacuggauugcugccucaaucauccucgaauuuuucuugauuguucuguuaauccccgagccagagaagcagcguacuccucaggacaaucaacuaacauaugucauaauugcaauccugacggugguggcugccaccauggcaaacgaaaugggcuuucucgagaaaacuaagaaagaucuuggacugggcaauauugccacacagcagcccgaaaguaacaucuuggacauagaucugagaccagcuucugcguggacccucuacgccgucgcaaccacauucaucacuccuaugcugaggcauuccauugagaauagcucaguuaacgugagucuuacggcuaucgccaaucaggccaccguacucauggggcugggaaaggguuggcccuugagcaagauggacauuggcgugccgcuguuagcaaucggguguuauucccaagucaacccaauuacacuaacugcugcccugcuccuucugguggcgcacuacgcuaucauaggaccuggcuugcaggccaaagcaacccgcgaagcccagaagcgggcugcagccgguauuaugaaaaaucccacaguugaugggaucaccgugaucgaccuggauccaauucccuacgacccuaaguuugagaaacagcucggccaagucaugcugcuuguauuaugcgugacucagguucugaugaugcgaacgacaugggcgcucugugaggcuuugacccuggccacuggaccggugucuacccuaugggaaggcaaccccgggagauucuggaauacaacuauagcagucagcauggccaacaucuuuaggggauccuaucuggcuggcgccggucuccuuuucucaauuaugaagaauaccacaucuacgcgccgggggaccggaaacaucggcgagacucugggugaaaaguggaaaaguagauugaaugcacugggcaagucggaguuucagauuuacaaaaagagcgggauccaagaaguggaucguacacucgcuaaagagggaauaaagaggggcgagaccgaccaucacgccgucucccgggggucugcgaaacugcgcugguucguggaacgaaacuuaguuacuccagagggaaaggugguagaucuuggcugcgguagagggggauggucauauuacuguggcggucugaagaacgugagggaagucaaaggccucacaaaggggggaccuggccaugaggagcccaucccuaugagcaccuauggguggaaucuaguucggcugcaguccggaguggacgucuucuuugugccacccgaaaaaugcgacacguugcugugugauauuggcgagaguucuccuaacccaaccguagaagccggucgcacacucagagugcuuaaucugguugagaacugguugaauaacaauacucaguucugcgugaagguccugaaccccuacaugccgagcgugaucgaaaggauggagacccuccagcgaaaauaugggggagcauuaguccggaauccucugucacguaacuccacacacgagauguacugggugaguaaugcuagcggcaacauuguuucuuccguaaauaugaucucaagaaugcuuauaaaccgcuuuacuaugaggcacaagaaggccaccuacgaaccagacguggaucugggcagcgggacacggaauauuggaaucgagucggaaacccccaaccuagacaucauugguaaaagaauagagaagaucaaacaagaacaugagacuucuuggcacuaugaucaggaccauccuuacaagacgugggcauaucacggcaguuacgagacaaaacagaccggguccgcuagcucaauggucaacggagugguucgccuccugacuaagccaugggaugugguccccauggugacccagauggccaugacagacacgaccccguucggccaacagaggguauuuaaggaaaaaguggauacucgaacacaggagccuaaggaagguaccaaaaaguugaugaaaauuacugccgaguggcuguggaaggaacucgggaagaaaaagacaccccggauguguaccagagaggaguucacaaaaaagguuagguccaaugcggcucuuggagcaaucuuuacugacgaaaacaaauggaagucugcccgcgaggcugucgaagauagccguuucugggagcugguggacaaagagcggaauuuacaccuggaaggcaagugcgagaccuguguguauaacaugaugggcaagagagaaaaaaaguugggggaguuuggaaaagccaaggguaguagggcaauuugguacauguggcucggcgcccgcuuccuggaauuugaggcucuaggguuccuuaaugaggaccauugguuuucccgagaaaacagccugucuggagucgagggcgaaggucuccacaaacugggguauaucuugcgggagguuucaaagaaggaaggaggcgcgauguacgccgaugacacggcaggcugggauaccagaauaacaaucgaggaccugaaaaaugaggaaaugauuacuaaccauauggcuggggagcacaagaaacucgccgaagcaaucuucaagcuuaccuaccagaauaaagugguaagggugcaacgcccaacaccuagaggaacugucauggauauuaucagucggagggaccagcgugguuccggccagguggggaccuauggacugaacacguucacaaauauggaggcccaauuaauucgacagauggaaggcgaggguauauuuaagaacauccagcaucugaccgcuagcgaggaaauugccguucaggauugguuggugcgcgucgggagagagcggcucucuaggauggcgaucucgggagacgauugcgugguaaagccccuggacgaucgcuucgcaagagcccuaacugcucuuaaugacaugggcaaaguucggaaggauauccaacagugggaaccaucaaggggcuggaacgacuggacacaggugcccuuuugcagccaccacuuccaugagcugauuaugaaagacgggcgaacccucgucgugccuugucguaaucaggaugagcugauaggaagagcccgcaucucccaaggugcaggcuggaguuugcgggaaacugcuugcuuagggaagucuuacgcccagauguggagccugauguauuuucacaggagagaccuccgccuugcugccaacgcaauuuguuccgcggugccaucacauugggucccgaccagucggacaacguggucuauccacgccagccacgaguggaugaccacugaagauaugcugacaguuuggaacaaaguguggauucuagagaaucccuggauggaagacaagaccccuguagaguccugggaggaaaucccauaccugggaaagagggaggaucaguggugcggcucacucauagguuugacuagccgagcuacaugggccaaaaacauccagaccgcaauuaaucaagugagaucucugaucgggaacgaagaguauacggacuacaugcccuccaugaagcgguucaggcgcgaagaggaggaagcuggaguccuuugguga

SEQ ID NO: 14892 - RNA, 9876 nt, Artificial Sequence
  derived and/or modified CDS sequence (opt3) from DENV-2__JX966379__SS-prME
accgccggcaugaucauuaugcugauacccacagugauggcuuuccaccucacuacgagaaacggggagccucauaugaucgucagcaggcaggaaaagggaaaaucccuucuguuuaagaccaaagacgguacaaauaugugcacuuugauggcaauggauuuaggcgagcugugugaagacaccauuacauacaagugcccauuccuaaaacaaaacgagccggaagauaucgacuguuggugcaauucuaccucaacuuggguuacauaugggaccuguacgacuaccggagagcaccggcgcggcaagcgaaguguggcccucguaccccauguggguauggggcuggagacacguacugaaaccuggaugagcuccgagggagcguggaagcacgcucagagaauugaaacauggauccuuaggcauccuggcuuuaccauaauggccgcaauccuggccuacacgauuggcacuacacacuuccagcgggucuugaucuuuauucuccugaccgcuaucgcaccaucuaugacuaugcgcugcauagggauuucgaacagagauuucguggagggaguuucagguggcagcuggguggacaucguccuggagcacgggaguugugugacaaccauggccaaaaauaagcccacgcucgauuuugaauuaauuaaaaccgaggcuaagcagccugccucccugaggaaauauugcaucgaagcgaagcuuacaaacacuaccacagacucucgguguccaacucaaggagagcccaccuugaaugaagagcaggauaagcgcuucguaugcaaacauagcaugguugaccgaggcugggguaacggguguggacuguuuggcaagggcgggaucgugacaugcgcaauguucaccugcaaaaagaauauggagggaaaaauuguccagccugaaaaccuagaguacacuguggugauaacgccacacuccggugaagagcaugccgucggcaaugauacagggaagcacggaaaagaaguuaagaucaccccgcagucaaguauuacugaggcugagcucaccggcuaugguacagugaccauggaauguagccccagaacugggcuggacuuuaacgagaugguacuucugcaaauggaagauaaggccugguuggugcacaggcagugguuccucgaccugccuuuaccauggcugcccggcgcagacacacagggaucuaauuggauccagaaagagacgcucgucaccuuuaagaacccucaugcuaaaaagcaagaugugguugugcuuggcucccaggaaggggccaugcacacugcgcugacaggagccaccgagauacagaugucaagcgguaauuugcuauucacaggccaucugaaaugccggcuccguauggacaagcugcaacuuaaggggaugaguuacucuauguguacuggaaaauucaagauugucaaagagaucgcagaaacccagcacggcacgaucgugauucgcguacaguaugagggugauggguccccaugcaagauccccuuugaaauuauggaccuggagaaaagacauguuuugggcaggcucauaaccgugaacccgaucgucacagagaaggauagcccugugaacauugaagcugagcccccauucggagacucguacaucaucauuggcgucgaaccugggcagcugaaguuagauugguuuaaaaagggaucuuccauaggucaaauguucgagacuaccaugcggggcgccaaacgaauggcuauccugggggacacagccugggauuuuggaucacuaggcgguguguucacuaguauugggaaggcacuccaccagguuuuuggcgccaucuacggagcugcguucagcggcguguccuggaccaugaaaauucugaucgggguaauaaucacguggauuggaaugaauucucgcagcacaucacuuagugucuccuuggugcugguuggcaucgugacccucuaucugggugucauggugcaggcagacagcggguguguagugucuuggaagaacaaggaacuuaaaugcggaucaggcauuuuuguuacugauaauguccacacauggaccgagcaguacaaguuccaacccgagaguccaagcaaacuggccuccgcuauccagaaggcccaugaagaggguauauguggcauuagaucugugacuagguuggaaaaccucauguggaaacagaucacccccgagcugaaucacauuuuaucggaaaacgaggugaagcugacaaucaugacgggggacauaaaaggaaucaugcaggucggcaagcggagccuacgcccucaaccaaccgagcucagauauuccuggaagacuugggggaaagcaaagaugcugucaacagaacuucauaaucagaccuuuuugauugacggaccggagacagccgaaugccccaacacuaauagggcuuggaacagucuggagguugaagauuacggcuucgguguguuuaccacgaauaucuggcuccgucugcgggagaaacaggacguguucugugauucuaaguuaaugagcgccgcaauuaaagacaaccgagcgguacacgcugauaugggguauuggaucgaguccgcccugaaugacacauggaagauagaaaaggcaucauucauugaggucaaaagcugccacuggccuaagucucauacccuuugguccaacggaguguuggaaagugagaugguuaucccaaaaaauuacgccggccccgugagccagcacaacaacagaccugguuaucauacucaaaccgcuggcccauggcaccucgggaagcuggagauggauuuugacuucugugaaggaacaacugucgugguuaccgaggaaugcggcaauagggggcccucucuacgcacaacgaccgccuccggaaaacugaucacugaguggugcugucggucaugcacacucccgccucugagauacaggggcgaagaugguuguugguacgggauggagauucgcccacuuaaggagaaggaagagaacuuggugaguagccugguaaccgcaggacauggccagaucgacaauuuuucguuagguauucucggcauggcucuguuccuugaagagaugcugcgaucccgggucgggacuaaacacgccauauugcucguggcggugucuuuugucacacugaucaccggaaacaugagcuuccgugaucuaggcagaguuauggugaugguaggggccacgaugacugacgauauuggaaugggcgugaccuaucuggcucuccuggcagccuacaaggucaggcccacauuugcugccggucuuuugcugcgcaaauuaaccucaaaggaacucaugaugacuacaaucgggauugugcugcuuagucaguccucuaucccugagaccauacuggagcuaacagacgcacucgcgcugggaaugaugguuuugaaaauggugcggaauauggaaaaguaucaacuggccgucacuaucauggcuauuuuaugcgugcccaacgccguuauccuccagaaugcauggaaggugagcuguaccacgcuggcugucguauccgugucaccacuucuguugacaagcagucagcagaaagccgacuggauuccucucgcacugaccaucaagggccuaaaccccacugccauauuccugaccacacuuucuagaacuuccaaaaagaggagcuggccacucaaugaggcuauuauggcgguuggcauggugucgauccuggccucaucuuugcugaaaaacgauaucccgaugaccgggccuuuagucgcaggaggucuccugacggugugcuacguacuuacaggccgaagugcugaccuggaauuggagcgcgccaccgaugugaagugggacgaucaagccgaaauuuccgggagcucucccauacucagcaucacuauuuccgaggacggaucaaugaguaucaaaaaugaggaagaggaacagacacugaccauucuaauccggacuggccugcuugucauaagcggucucuuuccaguuucuacacccaucaccgcugcagccugguaucugugggaggugaagaagcagagagcggggguguugugggaugucccuuccccacccccugugggaaaagcugaguuagaagacggcgccuacaggauuaagcagaaaggcauccugggguauucacaaauuggagcagguguuuacaaggagggcacguuccacacuauguggcauguaacccguggggccgugcucaugcacaaaggaaagcgcaucgaaccgaguugggcugaugucaagaaagaccugauaagcuacggcgguggguggaagcuugagggagaauggaaagagggcgaggaagugcagguucuggcauuggagccaggcaagaacccccgggccgugcagacaaaaccugggcuauuuagaaccaauacaggaacuauuggugcggucucccuggauuucucuccaggcaccucggggagccccaucguggacaagaagggaaaaguagucggccucuaugguaacggggugguuacgaggucaggagcuuacguguccgccaucgcacagacagaaaagaguauugaggauaauccugaaaucgaggacgacauauuucgaaaacggcgccugacuauuauggaucuucauccgggcgccggcaagaccaaaagauauuuacccgcuaucgucagggaggccauuaagcgggggcugcgaacacucaucuuggcaccaaccagagugguugcugccgaaauggaggaagcgcugcgcggacucccuauaagguaccaaacucccgccauucgugcagagcacaccggucgggaaaucguggaccugaugugucaugcuacauucacgaugagacuucugucuccaaucagggucccuaacuauaacuugauuaucauggaugaggcccacuucacugaccccgcuagcauugcagcccgcggcuacauauccacccgaguggagaugggggaagccgcuggaaucuuuaugacagcgaccccaccgggcucaagagauccuuucccccagucuaaugcaccaauuauggacgaggaacgggagauccccgagaggagcuggaacaguggucacgaauggguaacugauuuuaaggggaaaacagugugguucguuccuuccaucaaggccggaaaugacauugcuaccugccuacgcaaaaacggcaagcgugucauacagcugagcagaaaaacguuugauucugaguaugugaagacucggacaaaugacugggauuucguggucaccaccgacaucucagaaaugggcgccaacuuuaaggcagagaggguaauugacccacgccgauguaugaaacccgugauccucacugauggggaagagagaguuauuuuagccggaccuaugccggugacacauuccagugcugcgcaacggaggggucgcaucggcagaaauccaaggaacgagaaugaccaguacauauacaugggggaaccccuggagaacgaugaagacugcgcccacuggaaggaggcaaaaaugcuucuggauaauaucaacaccccugaaggaauuauccccagcauguucgagccagagcgggaaaaggucgacgcuauugauggcgaguaucgucuccgcggugaagcccgaaaaacauuuguggacuugaugagaaggggggaucugccuguuuggcucgcauacaagguggccucggagggcaucaauuaugcugaccggcgcugguguuucgauggaacuagaaacaaucagauacuggaagagaacgucgagguggaaauuuggacgaaagagggcgaaaggaagaagcuuaaaccccgguggcuagacgcccgaaucuacucugauccacuggcguugaaggaguuuaaagaguucgcagccgggagaaaguccuuaacccugaaccucauuacagaaaugggacgccugccuacuuucaugacccagaaagcuagggacgcccuugacaaucuggcuguacuccauacagcagaggccgguggcaaggcuuauaaccacgccuugagcgaacugccggagacccuagaaacucugcuccuucugacguuauuggcaaccgugacagggggaaucuuucuguuccucaugucaggccgggguauagggaagaugacucugggcaugugcugcaucauuaccgcgaguauccuucugugguacgcccaaauucagccccacuggaucgcugccucuauaauucucgaguuuuucuugaucguucuguuaaucccagagccugaaaaacagcguacaccccaggauaaucaacuaaccuaugucauuaucgcaauacugacugugguggcugccacaauggcaaacgagaugggauuucucgaaaagacgaaaaaggaccuuggccuggggcauauugccacccagcagccagaguccaauaucuuggauauugaccugagaccugcuagcgcguggacucucuacgccgucgcaacaaccuucaucacccccaugcugaggcacucaauagaaaacaguagcguuaaugugucccuuacagcuaucgccaaccaggccacuguacucaugggacuggguaaaggcuggccguugucuaagauggauauuggggugccacuguuagcaaucggauguuacagccaagucaauccuauuacgcuaaccgcugcccugcuccuucugguggcgcauuaugcuaucauuggccccgguuugcaggccaaggcaacacgcgaggcccagaaacgggcugcagccgggaucaugaagaacccaacuguugacggcauaaccgugauugaucuggaccccaucccuuacgauccgaaauuugagaagcagcucggacaagucaugcugcuuguauuaugcgugacacagguucugaugaugcgaaccacuugggcgcucugugaagcuuugacgcuggccacaggccccguguccacccuaugggaggggaauccaggaagauucuggaacacuaccaucgcagucucaauggccaauauuuuuaggggcucuuaucuggcuggugccgggcuccuuuucaguauaaugaaaaacacaacuucgacccgccggggaacaggcaauaucggugaaacgcugggcgagaaguggaagagcagauugaacgcacuggggaaauccgaauuucagauuuacaagaaaucuggaauccaagagguggaccguacccucgcuaaggagggcauuaaaaggggggaaacugaucaccaugccgucucacggggaagcgcgaagcugcgcugguucguggagcgaaauuuaguuacaccugaaggcaaagugguagaccuugguugcgggagaggaggcugguccuauuacugugguggccugaagaacgugagggaggucaaggggcucaccaaaggaggccccgggcacgaggaaccuaucccaaugaguacuuauggauggaaccuaguucggcugcagucuggcguggaugucuuuuucgugcccccugagaagugcgacacauugcugugugacauaggugaaagcucaccaaaucccaccguagaggccgggcgcacgcucagagugcuuaaccugguugaaaauugguugaacgauaauacccaguucugcgugaaaguccugaacccguacaugccuuccgugaucgagaggauggagacacuccagcgaaaguacggaggcgcauuaguccggaauccacugagucguaacagcacucacgaaauguauugggugucuaaugcuuccggcaacguuguaucaagcgugaauaugauuucgagaaugcuuaucaaccgcuuuaccaugaggcauaaaaaggccacauacgagcccgacgucgaucuggggucuggaacucggaauauugguaucgaaagugagaccccuaaccuagacauaauuggcaagagaaucgaaaaaaucaagcaagagcacgaggcauccuggcauuaugaucaggaccacccauacaaaacaugggcuuaucacgggagcuacgaaaccaagcagacuggaucagccuccucuauggugaauggcguugugcgccuccugacgaaacccugggaugucgugccgaugguaacacagauggccaugaccgacacuaccccuuucggucaacagaggguguuuaaggagaagguugauacacgaacgcaggaacccaaagaggggaccaagaaauugaugaagauuacugcggaauggcuguggaaagagcucggaaagaagaaaacaccacggauguguaccagagaggaauucacuaagaaagucaggagcaacgcugcacuuggcgccauauuuacagacgagaacaaguggaaaagugcucgcgaagccguggaggauaaucguuucugggagcugguggacaaggaacggaacuuacaucuggagggcaaaugcgaaaccugugucuauaauaugauggggaagagagagaagaaauugggagaauuugguaaggcaaggggcucccgcgccaucugguacauguggcucggggcucgauuccuggaguuugaggcgcuaggauuccuuaacgaagaccacugguuuagccgggagaauucucugucaggcguugaaggugaggggcuccauaaacugggauacauuuugagagaagugaguaagaaagagggcggcgccauguaugcagaugacacagcugggugggauacuaggaucaccauugaggaccugaagaacgaagagaugaucacgaaucacauggccggagaacauaagaaacucgcagaggccauauucaagcuuaccuaccagaacaaaguagugcgcguccaaagaccuacaccccgggguacugugauggauaucauuuccaggcgugaccagcgaggcagcgggcagguugugaccuauggacugaauacauuuacuaacauggaagcucaauuaauccgccagauggagggcgaggguauuuucaagucuauccagcaccugaccgccucggaagagauugcgguccaggauugguuggcaagaguggggcgggaaaggcucucacgcauggccauaagcggagacgauugcguaguuaaaccacuggacgauagauucgcucgggcccuaacggcacuuaaugacaugggcaaggugaggaaggauauccaacagugggagcccucccgaggcuggaacgacuggacacaggucccuuuuugcagucaccauuuccacgagcugauuaugaaagacgggcguacccucguggugccauguagaaaucaggaugaacugaucggacgcgcucggaucucucaaggugccggcuggagcuugagggagacugcuugcuuagggaaguccuacgcccagauguggucacugauguauuuucauagacgcgaccuccggcuugcagcgaacgccauuuguagugcugucccgucucacuggguucccacaagcaggaccacuugguccauacacgccucacaugaauggaugaccacagaggauaugcugacgguguggaaucgaguauggauccuagaaaacccuuggauggaggacaaaaccccaguggagagcugggaagagauucccuaccugggaaagagagaagaucaguggugcggcucucucaucgguuugacuucccgggcaacaugggcuaaaaacauucagaccgccaucaaucaagucaggagucugauagggaacgaggaauauacugacuacaugccuagcaugaagcgcuuccguagagaggaggaagaggcaggagugcuuugguga

SEQ ID NO: 14893 - RNA, 9876 nt, Artificial Sequence
  derived and/or modified CDS sequence (opt3) from DENV-2__KP012546__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaagcgagaacgaagugaaacugacuaucaugaccggcgacauuaaggggaucaugcaggcuggaaaacgcucccuaagaccucagccaacagagcucaaguacucauggaaaacguggggcaaggccaagaugcugaguaccgaacuucacaaucauacuuucuugauagaugggccggagacagcagaaugccccaacaccaauagggcguggaacucucuggagguagaggacuauggauuuggcgucuucacaacuaauaucuggcucaaacugaaggaacgucaagauguguuuugugacagcaaauuaauguccgcugccauuaaggacaaccgggcaguucacgccgauauggguuacuggaucgagucagcucugaacgacaccuggaaaauugaaaaggccagcuucaucgaggugaagucuugccacuggccuaaaucccauacgcuuuggaguaauggggucuuggagagcgaaaugauaauuccaaagaacuucgcaggacccgugucucagcacaauuaucgaccuggcuaccauacacagaccgcugguccauggcaccucggcagacuggagauggauuuugacuucugugaagggacuaccguugugguaacagaggauugcggaaacaggggccccucccuacgcacuaccacagccucagggaaacugaucacggaauggugcugucggaguugcacccucccgccucugagauacaggggagaggacggcuguugguaugguauggagauccgcccacuuaaggaaaaagaggaaaauuuggucaacagccuggugacugcggggcauggacagauugauaauuuuucguuaggcgugcucgguauggcccuguuccuugaggaaaugcugcgaacacgggucggcaccaagcacgcuaucuugcucguugcaguguccuuuguaacucugauuacagggaacaugucuuuccgugaccuaggaagagugauggucauggugggcgccgcuaugaccgaugacauagggaugggaguuacguaccuggcccuccuggcagcguuuaaggugaggcccacuuucgccgcuggccuuuugcugcgcaaauuaaccagcaaggagcucaugaugacaaccaucgguauuguccugcuuucacaaaguacuaugccugagacaauccuggaacuaaccgaugcccucgcacuggggaugaugguguugaaaauuguucggaauauggagaaguaucagcuggcugugacaaucauggccauauuaugcguccccaacgcaguaauccuccagaaugccuggaaaguguccuguacuacccuggcuguugugucugucagcccacuucuguugacguccucacaacagaaggcggacuggauuccucucgcccugacaaucaagggacuaaaccccaccgcaauuuuucugacuacccuuagcagaacaaguaaaaagaggucuuggccacucaaugaagcuaucauggccgugggcaugguauccauacuggccagcucguugcugaaaaacgauauuccgaugacuggcccuuuaguggcugggggacuccugaccgucugcuacguucuuacgggucgaucagcagaccuggaguuggaacgcgccgcggacgugcggugggaggagcaggcugaaaucucuggcaguucccccauccucagcauuacaauaucugaggaugggagcauguccaucaagaaugaagaggaggaacagacccugacuauucuaaucagaacaggacugcuugugauuucaggccucuucccagucaguauccccauaaccgccgcagccugguaucugugggaggugaaaaagcaaagggcugguguuuugugggacguaccuagcccacccccuguggggaaagcagaauuagaggauggagccuaccguaucaagcagaagggcauucugggcuauucucagaucggggcgggagucuacaaagaagguacuuuucacacaauguggcaugugacccgcggcgcuguucucaugcacaaggggaaacggauugagccguccugggccgacgugaagaaagaucugaucucauacggaggcgguuggaagcuugagggggaauggaaggagggagaagagguccaggugcuggcauuggaaccaggcaaaaaccccagagccguacaaacgaagccuggccuauucaaaacuaacaccgggacaauaggagcugucagucuggacuuuagcccagguaccuccggcucucccauuguggauaagaaagggaagguugugggacucuauggcaauggugucgugacaaggucggggacuuacguuagcgccaucgcacagaccgagaagucaaucgaggacaacccugaaauugaggaugacaucuuccgaaaaaagcggcugacgauaauggaucuucauccgggagcuggcaaaacaaagcgcuauuuacccgccauugugagagaagcgaucaaaaggggccugcggacucucauuuuggccccaacccgagucguggcagcugagauggaagaggcccugagagggcucccuauccgcuaccagacacccgcuauaagggcagagcacaccggacgugaaauuguagaccugaugugucaugccacuuucaccaugcggcuucuguccccaaucagagugccuaauuauaacuugaucauuauggaugaggcccacuuuacagaccccgcuaguaucgcggcaagggguuacauuucuacgcgcguugaaaugggcgaggccgcugggauauucaugacugccaccccaccgggaagccgagacccuuuuccccaguccaaugcaccaaucauggaugaggaaagagagauucccgaacggucauggaacucuggccacgagugggucacagacuucaaggguaagaccgugugguuugugccuagcaucaaagccgggaaugauaucgcugcgugccuaaggaagaacggaaaaaaggucauucaacugagucgcaaaacuuucgacuccgaauauauaaagacacguaccaaugauugggacuuuguagugacgacugauaucagcgagaugggcgccaacuucaaggcagagagaguuauugacccacggagguguaugaaacccgugauccucacagauggcgaagagcgcgucauuuuagcugggccuaugccggugacccauucuucagccgcacagcgaagaggacggguugguaggaauccaaagaacgaaaaugaccaguacaucuacaugggcgagccccuggaaaacgaugaggacugcgcccacuggaaagaggcuaagaugcuucuggacaauauauccaccccugaagggaucauucccaguauguuugagccagaacgcgagaaaguggaugccaucgacggagaauauagacucaggggcgaggcgcggaagacuuucgucgauuugaugcgucgcggugaccugccuguguggcucgcauaccgaguagccgcugaggggauuaacuaugccgauagaaggugguguuuugacggcgugaaaaacaaucaaauccuggaagagaacguugaagucgagauauggacaaaggagggagaacggaagaaacuuaagccccgcuggcuagaugcuagaauuuacagcgacccacuggcauugaaagaguucaaggaauucgccgcuggcaggaaaucguuaacccugaaucucaucacagagauggggcggcugccuacuuuuaugacgcagaaggcccgaaacgcacuugauaaucuggcggugcuccauaccgccgaagcuggagguagagccuauaaccacgcauugucugagcugccggagacacuagaaacucugcuccuucugaccuuauuggcugccgugacaggcgggauuuuccuguuucucauguccggaaagggcaucgguaaaaugacccuggggaugugcugcauaaucacugcaagcauucuucugugguacgcccagauccagccccacuggauugcugcgucaaucauacucgaguucuuuuugauuguccuguuaaucccagaaccugagaagcaacgcacgccccaggacaaucagcuaaccuauguugugaucgccauucugacaguaguggcagcuacuauggccaacgaaaugggcuuccucgagaaaaccaagaaagauuuuggacuuggcaguacaaccacucagcaaccagagucuaauauccuggacauagauuugaggccugccuccgcauggacacuguacgcugucgccacgaccuucauuacucccaugcuccggcauagcaucgaaaacucaagugugaauguuagccugacagcgauugcuaaccaggccaccgugcuuauggggcucggaaaggguuggccgcuguccaagauggacaucggcgucccauugcuggcaauaggguguuacucucagguaaauccuaucaccuuaacagccgcucuacugcuccuuguggcacacuaugccauuaucggacccggccugcaggcgaaagcuacucgugaggcccaaaagagagcagccgcugguauuaugaaaaacccaacgguugacgggaucaccgugauugauuuggaccccaucccuuacgauccgaaguuugaaaaacagcugggccaggucaugcuccuggugcuuugcgucacacagguguuaaugaugaggacuaccugggcccugugugaggcacucacauuggcuaccggacccauaagcacucugugggaaggcaauccagggcgcuucuggaacacgacaauugccguuuccauggcgaauaucuuucggggaucauaucuagccggcgcaggucugcucuucucuaucaugaagaacaccgcuaacacucgaagagggaccggaaauacaggcgagacucuuggugagaaguggaaaaacaggcugaaugccuugggcaagagugaauuucaaauuuacaaaaagucggggauacaggagguggaccgcacccuggcaaaagaaggaaucaagcggggcgagacagaucaucacgcuguaagcagaggguccgccaaacuccguugguucguggagaggaaccuggucacgccugaaggaaagguuguggacuuaggcugcggucgggggggauggucuuauuacuguggcggucuuaagaaugucaaagaggugaagggccugaccaaagggggacccggccaugaagagccuauuccaaugucaacuuauggguggaaccucguacgccuacagagcggaguggauguuuucuuuacacccccugaaaagugcgacacccuguugugugauaucggcgaguccaguccaaaucccacuguggaggccggucgaacacugagaguccucaaccuuguggaaaauuggcugaacaauaacacccaauucugcauuaaagucuugaauccguacaugccuucugugaucgagaagauggaagcgcugcagaggaaguacgggggagcucucguucggaacccauuaagccgcaauucaacgcacgagauguauuggguauccaacgcaaguggcaacauagugagcucugucaauaugaucuccagaaugcugauuaacagguuuaccaugcgacacaaaaaggccacauacgaacccgacguggaucuuggcucagggacucggaauaucggaauugagagcgagaccccuaaccuggacaucauagguaaacguauugaaaagaucaaacaggagcaugaaacaucguggcacuaugaucaggaccauccauacaagacuugggcuuaucacggcucuuacgagaccaagcaaacagggagugccuccagcaugguuaauggaguggucagacuacucaccaaacccugggacgugaucccgaugguaacucagauggcaaugacggauacaaccccuuucggccagcagcgcguguuuaaggaaaaaguugacacuaggacccaagagcccaaggaggguacaaaaaagcugaugaagauuacggccgaaugguuguggaaagagcuggggaagaaaaagaccccacggauguguacuagagaagaguucacacgcaaagucaggucaaacgcugcgcucggagccauauuuaccgaugagaauaaguggaaauccgcacgagaagcuguggaggacucuggcuucugggaacuuguggauaaggagcggaaccugcacuuagaaggcaagugcgagacuugugucuauaauaugauggggaaaagagagaagaaacugggagaauuugguaaggccaaaggcagcagggcaaucugguacaugugguugggggcccgcuuccucgaguuugaagcucugggauuccuaaacgaggaccauugguuuagucgugaaaauucccuuagcggcguugagggugaggggcugcacaagcucggauacauucugcgggaugugucuaagaaagaaggcggcgccauguaugcggacgauacagcagggugggacaccagaaucacauuggaggaucugaagaacgaagagaugguaacuaaucauauggaaggagagcacaaaaagcucgccgaggcuauuuucaaacuuaccuaccagaacaagguggucagggugcagcgcccuacgccccgagguaccguuauggacaucauaucacggagagaccagaggggcagugggcaaguggucacauauggacugaauacuuucaccaacauggaagcccaguuaauccgccagauggagggcgaagguguguuuaaguccauucaacagcugacaguaacugaggagaucgcaguuaaaaacugguuggugagagucgggcgggaaaggcucagccguauggcuauuucuggagaugacugcguggugaagccacuggaugaccgauucgccucggcucuaaccgcccuuaaugauaugggcaaaguccgcaaggacauccagcagugggagcccucaagaggcuggaacgauuggacgcaaguuccuuuuugcagccaucacuuccacgaacugauuaugaaagacgggcgggugcucguagugccauguaggaaucaggaugagcugauaggacgcgcaagaaucucccagggugcgggcuggaguuugcgggaaacagccugcuuagggaagucuuacgcucagauguggaaccugauguauuuucauaggcgagaccuccgucuugccgcaaaugcuauuuguagcgccgucccgucccacugggugcccaccucaagaacuacauggaguauccaugcaacccacgaguggaugacuaccgaggauaugcugacaguuuggaaccgcguguggauccaagaaaauccuuggauggaggacaagacgccagucgaaucuugggaggaaauucccuaccuaggaaaacgggaggaucaguggugcggcagccugauaggucucaccuccagggccacuugggcgaagaacauccagacagcuauuaaucaggugagaucauugaucgggaacgaggaauauaccgacuacaugccuagcaugaaacgcuuccggagggaggaagaggaagccggaguacugugguga

SEQ ID NO: 14894 - RNA, 9876 nt, Artificial Sequence
  derived and/or modified CDS sequence (opt3) from DENV-2__KP723478__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaagcgagaacgaagugaaacugacuaucaugaccggcgacauuaaggggaucaugcaggcuggaaaacgcucccuaagaccucagccaacagagcucaaguacucauggaaaacguggggcaaggccaagaugcugaguaccgaacuucacaaucauacuuucuugauagaugggccggagacagcagaaugccccaacaccaauagggcguggaacucucuggagguagaggacuauggauuuggcgucuucacaacuaauaucuggcucaaacugaaggaacgucaagauguguuuugugacagcaaauuaauguccgcugccauuaaggacaaccgggcaguucacgccgauauggguuacuggaucgagucagcucugaacgacaccuggaaaauugaaaaggccagcuucaucgaggugaagucuugccacuggccuaaaucccauacgcuuuggaguaauggggucuuggagagcgaaaugauaauuccaaagaacuucgcaggacccaugucucagcacaauuaucgaccuggcuaccauacacagaccgcugguccauggcaccucggcagacuggagauggauuuugacuucugugaagggacuaccgugguugugacagaggauugcggaaacaggggccccucccuacgcacuaccacagccucagggaaacugaucacggaauggugcugucggaguugcacccucccgccucugagauacaggggagaggacggcuguugguaugguauggagauccgcccacuuaaggaaaaagaggaaaauuugguaaacagccuggucacugcggggcauggacagauugauaauuuuucguuaggcgugcucgguauggcccuguuccuugaggaaaugcugcgaacacgggugggcaccaagcacgcuaucuugcucgucgcaguuuccuuugugacucugauuacagggaacaugucuuuccgugaccuaggaagaguaauggugauggucggcgccgcuaugaccgaugacauagggaugggagugacguaccuggcccuccuggcagcguuuaagguuaggcccacuuucgccgcuggccuuuugcugcgcaaauuaaccagcaaggagcucaugaugacaaccaucgguauugugcugcuuucacaaaguacuaugccugagacaauccuggaacuaaccgaugcccucgcacuggggaugauggucuugaaaauugugcggaauauggagaaguaucagcuggcuguuacaaucauggccauauuaugcgugcccaacgcagucauccuccagaaugccuggaaaguauccuguacuacccuggcugugguuucugugagcccacuucuguugacguccucacaacagaaggcggacuggauuccucucgcccugacaaucaagggacuaaaccccaccgcaauuuuucugacuacccuuagcagaacaaguaaaaagaggucuuggccacucaaugaagcuaucauggccgucggcaugguguccauacuggccagcucguugcugaaaaacgauauuccgaugacuggcccuuuaguagcugggggacuccugaccgugugcuacguccuuacgggucgaucagcagaccuggaguuggaacgcgccgcggacguucggugggaggagcaggcugaaaucucuggcaguucccccauccucagcauuacaauaucugaggaugggagcauguccaucaagaaugaagaggaggaacagacccugacuauucuaaucagaacaggacugcuugugauuucaggccucuucccagugaguacccccaucacugccgcagccugguaucugugggaggucaaaaagcaaagggcugguguguugugggacguuccuagcccacccccuguagggaaagcagaauuagaggauggagccuaccguauaaagcagaagggcauccugggcuauucucagauuggggcgggaguguacaaagaagguacauuucacaccauguggcaugucacgcgcggcgcugugcucaugcacaaggggaaacggaucgagccguccugggccgacguuaagaaagaucugauuucauacggaggcgguuggaagcuugagggggaauggaaggagggagaagaggugcagguccuggcauuggaaccaggcaaaaaccccagagccgugcaaacuaagccuggccuauucaaaaccaacacagggaccaucggagcuguaagucuggacuuuagcccagguacauccggcucucccauagucgauaagaaagggaaggugguuggacucuauggcaaugguguggucacuaggucggggaccuacgugagcgccauugcacagacggagaagucaaucgaggacaacccugaaaucgaggaugacauuuuccgaaaaaagcggcugacaaucauggaucuucauccgggagcuggcaaaacuaagcgcuauuuacccgccauaguuagagaagcgauuaaaaggggccugcggacccucaucuuggccccaacacgaguggucgcagcugagauggaagaggcccugagagggcucccuauucgcuaccagacccccgcuaucagggcagagcacacuggacgugaaauaguggaccugaugugucaugccaccuucacaaugcggcuucuguccccaauuagaguaccuaauuauaacuugaucaucauggaugaggcccacuuuacggaccccgcuaguauugcggcaagggguuacaucucuacucgcguggaaaugggcgaggccgcugggauuuucaugaccgccacaccaccgggaagccgagacccuuuuccccaguccaaugcaccaauaauggaugaggaaagagagauccccgaacggucauggaacucuggccacgaguggguuaccgacuucaaggguaagacugucugguuugugccuagcauuaaagccgggaaugauaucgcugcgugccuaaggaagaacggaaaaaaggugauccaacugagucgcaaaacauucgacuccgaauauauuaagacccguacgaaugauugggacuuugucguaacuacagauauaagcgagaugggcgccaacuucaaggcagagagagugaucgacccacggagguguaugaaacccguuauucucaccgauggcgaagagcgcgugaucuuagcugggccuaugccggucacccauucuucagccgcacagcgaagaggacggguggguaggaauccaaagaacgaaaaugaccaguacauuuacaugggcgagccccuggaaaacgaugaggacugcgcccacuggaaagaggcuaagaugcuucuggacaauaucuccacuccugaagggauaauccccaguauguuugagccagaacgcgagaaaguugaugccauugacggagaauauagacucaggggcgaggcgcggaagacauucguggauuugaugcgucgcggugaccugccugucuggcucgcauaccgaguggccgcugaggggaucaacuaugccgauagaaggugguguuuugacggcguaaaaaacaaucaaauucuggaagagaacguggaaguugagaucuggaccaaggagggagaacggaagaaacuuaagccccgcuggcuagaugcuagaauauacagcgacccacuggcauugaaagaguucaaggaauucgccgcuggcaggaaaucguuaacacugaaucucauuacugagauggggcggcugccuacguuuaugacccagaaggcccgaaacgcacuugauaaucuggcgguccuccauacagccgaagcuggagguagagccuauaaccacgcauugucugagcugccggagacucuagaaacccugcuccuucugacauuauuggcugccgugaccggcgggaucuuccuguuucucauguccggaaagggcauugguaaaaugacucuggggaugugcugcaucauaacggcaagcauccuucugugguacgcccagauucagccccacuggaucgcugcgucaauuauccucgaguucuuuuugauagugcuguuaauuccagaaccugagaagcaacgcaccccccaggacaaucagcuaacauaugucguuaucgccauccugacugugguagcagcuaccauggccaacgaaaugggcuuccucgagaaaacaaagaaagauuuuggacuuggcaguaccacuacacagcaaccagagucuaauauucuggacaucgauuugaggccugccuccgcauggacgcuguacgcuguggccaccacuuucauaacacccaugcuccggcauagcauugaaaacucaagugucaaugugagccugaccgcgaucgcuaaccaggccaccguucuuauggggcucggaaaggguuggccgcuguccaagauggacauuggcgugccauugcuggcaaucggguguuacucucaggucaauccuauaacauuaacugccgcucuacugcuccuuguagcacacuaugccaucauuggacccggccugcaggcgaaagcuacgcgugaggcccaaaagagagcagccgcugguaucaugaaaaacccaaccguggacgggauuacaguuaucgauuuggaccccauuccuuacgauccgaaguuugaaaaacagcugggccaggugaugcuccugguccuuugcgugacucaggucuuaaugaugaggaccacaugggcccugugugaggcacucaccuuggcuacuggacccaucagcacgcugugggaaggcaauccagggcgcuucuggaacacaaccauagccguguccauggcgaauauuuuucggggaucauaucuagccggcgcaggucugcucuucucuaucaugaagaacacugcuaacacccgaagagggacaggaaauacuggcgagacccuuggugagaaguggaaaaacaggcugaaugccuugggcaagagugaauuucaaaucuacaaaaagucggggauucaggagguugaccgcacacuggcaaaagaaggaauaaagcggggcgagacggaucaucacgcugugagcagaggguccgccaaacuccguugguucguagagaggaaccuggugaccccugaaggaaaggucguugacuuaggcugcggucgggggggauggucuuauuacuguggcggucuuaagaaugugaaagaggucaagggccugacuaaagggggacccggccaugaagagccuaucccaaugucaacauauggguggaaccucgugcgccuacagagcggaguagauguguucuuuacccccccugaaaagugcgacacucuguugugugauauuggcgaguccaguccaaaucccacaguugaggccggucgaacccugagagugcucaaccuugucgaaaauuggcugaacaauaacacgcaauucugcaucaaaguguugaauccguacaugccuucugucauugagaagauggaagcgcugcagaggaaguacgggggagcucucgugcggaacccauuaagccgcaauucaacccacgagauguauuggguuuccaacgcaaguggcaacaucguaagcucugugaauaugauauccagaaugcugaucaacagguuuacaaugcgacacaaaaaggccacuuacgaacccgacgucgaucuuggcucagggacccggaauauuggaaucgagagcgagacaccuaaccuggacauuaucgguaaacguauagaaaagauuaaacaggagcaugaaacuucguggcacuaugaucaggaccauccauacaagaccugggcuuaucacggcucuuacgagacaaagcaaaccgggagugccuccagcauggugaauggaguugugagacuacucacuaaacccugggacgucaucccgauggugacgcagauggcaaugacagauaccacuccuuucggccagcagcgcguauuuaaggaaaaaguggacaccaggacacaagagcccaaggaggguacgaaaaagcugaugaagaucaccgccgaaugguuguggaaagagcuggggaagaaaaagacuccacggauguguacaagagaagaguucacccgcaaaguuaggucaaacgcugcgcucggagccauuuuuacugaugagaauaaguggaaauccgcacgagaagcugucgaggacucuggcuucugggaacuuguggauaaggagcggaaccugcacuuagaaggcaagugcgagacauguguguauaauaugauggggaaaagagagaagaaacugggagaauuugguaaggccaaaggcagcagggcaauaugguacaugugguugggggcccgcuuccucgaguuugaagcucugggauuccuaaacgaggaccauugguuuagucgugaaaauucccuuagcggcgucgagggugaggggcugcacaagcucggauacauccugcgggauguuucuaagaaagaaggcggcgccauguaugcggacgauaccgcagggugggacacaagaauuacuuuggaggaucugaagaacgaagagauggugaccaaucauauggaaggagagcacaaaaagcucgccgaggcuaucuucaaacuuacguaccagaacaagguagugaggguccagcgcccuaccccccgagguacagugauggacauuaucucacggagagaccagaggggcagugggcaaguugugacuuauggacugaauaccuucacaaacauggaagcccaguuaauacgccagauggagggcgaaggugucuuuaaguccauccaacagcugacugugaccgaggagauugcaguaaaaaacugguugguuagaguggggcgggaaaggcucagccguauggcuaucucuggagaugacugcgucgugaagccacuggaugaccgauucgccucggcucuaacggcccuuaaugauaugggcaaagugcgcaaggacauucagcagugggagcccucaagaggcuggaacgauuggacacaagucccuuuuugcagccaucacuuccacgaacugaucaugaaagacgggcggguucucgugguaccauguaggaaucaggaugagcugauuggacgcgcaagaauaucccagggugcgggcuggaguuugcgggaaaccgccugcuuagggaagucuuacgcucagauguggaaccugauguauuuucauaggcgagaccuccgucuugccgcaaaugcuaucuguagcgccgugccgucccacuggguccccacuucaagaacaaccuggaguauucaugcaacucacgaguggaugaccacagaggauaugcugacgguguggaaccgcguuuggauccaagaaaauccuuggauggaggacaagaccccaguggaaucuugggaggaaauccccuaccuaggaaaacgggaggaucaguggugcggcagccugauuggucucacuuccagggccacaugggcgaagaacauacagaccgcuaucaaucaggucagaucauugauugggaacgaggaauauacugacuacaugccuagcaugaaacgcuuccggagggaggaagaggaagccggagugcugugguga

SEQ ID NO: 14895 - RNA, 9876 nt, Artificial Sequence
  derived and/or modified CDS sequence (opt3) from DENV-2__KP723479__SS-prME
accgcaggaaucauuauaaugaugauccccaccgugauggcuuuccaccugacuacgcgaaacggggagccucauaugauugucagcaggcaggaaaagggaaaaucccuccuuuuuaagaccgagaaugguguuaacaugugcacccugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugcggugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaagcgagaacgaagugaaacugacuaucaugaccggcgacauuaaggggaucaugcaggcuggaaaacgcucccuaagaccucagccaacagagcucaaguacucauggaaagccuggggcaaggcaaagaugcugaguacggaacuucacaaucauaccuucuugauagaugggccggagacugcggaaugccccaacacaaauagggcuuggaacucucuggagguagaggacuauggauuuggcgucuucaccacaaauaucuggcucaaaaugaaggaacgucaagauguguuuugugacagcaaacugauguccgccgcaauuaaggacucacgggccguucacgcugauauggguuacuggaucgagagcgccuuaaacgacacuuggaaaauugaaaaggcaucuuucaucgaggugaaguccugccacuggccuaaaagucauacccuguggagcaacgggguccuugagucugaaaugauaauuccaaagaauuucgcuggacccgugucccagcacaacuaucgaccuggcuaccauacgcagacagccgguccauggcacuugggcagacucgagauggauuuugacuucugugaagggaccacuguugugguaaccgaggauugcggaaauaggggccccucacugcgcacaacuaccgcgagugggaaacuaaucacagaauggugcugucggagcugcacgcugccgccucucagauacaggggagaggacggcuguugguaugguauggagauccgcccacugaaggaaaaagaggaaaaccuugucaauucguuggugaccgccgggcauggacagauugauaacuuuucccugggcguguuagguauggcucucuuccuggaggaaaugcuucgaacucgggucggcacaaagcacgcaauccuguugguugccgugucuuuuguaacccucauuacugggaauaugagcuuccgugaccugggaagagugauggucauggugggcgcuacaaugaccgaugacauagggaugggaguuacguaccuagcccugcucgcagcguuuaaggugaggcccacuuucgccgcuggccugcuuuugcgcaaacugaccucaaaggaguuaaugaugacaaccaucgguauuguccuccugagucaagccacuaucccugagacaauucuugaacugaccgaugcacuagcucucgggaugauggugcugaaaaucguucggaacauggagaaguaucaguuggccgugacaauaauggcaauccugugcguccccaaugccguaauuuuacagaacgcuuggaaaguguccuguacuacccucgcgguugugucugucagcccacugcuucugacguccucacaacagaaggccgacuggaucccuuuggcacucacaauuaagggacugaaucccaccgcuaucuuucuaacuacccugagcagaacaaacaaaaagaggaguuggccacuuaaugaagccauaauggccgugggcaugguaucuauucucgcuuccagccuguugaaaaacgauaucccgaugacuggcccucugguggcagggggauuacucaccgucugcuacguucugacgggucgaucggccgaccuugagcuggaacgcgcggcugacgugcggugggaggagcaggccgaaaucucaggcucuagucccauuuuguccauaacaaucagcgaggaugggucuaugagcauuaagaaugaagaggaggaacagacccucacuauccugauuagaacaggacuacugguggucuccggccuuuucccagugucaacccccaucacugcagccgcuugguaucucugggagguuaaaaagcaaagggccgguguacugugggacgugccuaguccacccccugucgggaaagccgaauuggaggauggagcguaccguauaaagcagaagggcaucuuaggcuauagccagauuggggcuggaguguacaaagaagguacauuucacaccauguggcauguuacgcgcggcgccgugcugaugcacaaggggaaacggaucgagccgucuugggcagacgucaagaaagaucucauuuccuacggaggcgguuggaagcuggagggggaauggaaggagggagaagaggugcagguacuugcccuggaaccaggcaaaaaccccagagcuguccaaacuaagccuggcuuguucaaaaccaacacagggaccaucggagccgugucacuagacuuuaguccagguacaagcggcucccccauaguugauaagaaagggaagguggucggacuguauggcaauggugugguuacuaggucugggaccuacgugucggcaauugcucagacggaaaagagcaucgaggacaacccugaaaucgaggaugacauuuuccggaaaaagagacucacaaucauggaucugcauccgggagccggcaaaacuaagcgcuaucuucccgcgauagucagagaagccauuaaaaggggcuuacggacccugauccucgcaccaacacgagugguagcugccgagauggaagaggcuuugagagggcugccuauucgcuaccagacccccgcaaucagggccgagcacacuggacgugaaauaguggaccucaugugucaugccaccuucacaaugcggcugcuuucaccaauuagaguuccuaauuauaaccugaucaucauggaugaggcucacuuuacggaccccgcguccauugcagccagggguuacaucaguacucgcgucgaaaugggcgaggcugccgggauuuucaugaccgcaacaccaccgggaucucgagacccuuuuccccagagcaaugccccaauaauggaugaggaaagagagauccccgaacgguccuggaacucaggccacgagugggugaccgacuucaaggguaagacugugugguuugucccuucuauuaaagcugggaaugauaucgcggccugcuugaggaagaacggcaaaaagguaauccaacuaagccgcaaaacauucgacagugaauauauuaagacccguacgaaugauugggacuuugugguuacuacagauauauccgagaugggcgcaaacuucaaggcugagagagugaucgacccacggagguguaugaaacccgucauucugaccgauggcgaggaacgcgugauccucgccgggccuaugccgguuacccauagcucugcagcccagcgaagaggacggguggguaggaauccaaagaacgaaaaugaccaguacauuuacaugggcgagcccuuagaaaacgaugaggacugcgcucacuggaaagaggccaagaugcugcuugacaauaucaacacuccugaagggauaauccccucaauguuugagccagaacgcgagaaagucgaugcgauugacggagaauauagacugaggggcgaggcacggaagacauucguggaucucaugcgucgcggugacuugccuguauggcuggccuaccgaguggcugccgaggggaucaacuaugcugauagaaggugguguuuugacggcguuaaaaauaaccaaauucucgaagagaaugucgaaguggagaucuggaccaaggagggagaacggaagaaacugaagccccgcuggcuugaugcaagaauauacuccgacccacuagcccugaaagaguucaaggaguucgcugccggcaggaaaaguuugacauuaaaccugauuacugagauggggcggcucccuacguuuaugacccagaaggcacgaaaugcgcuggauaaccuugccgugcugcauacagcugaagccggagguagagcauauaaucacgcucucagcgaguugccggagacucuggaaacccuacugcuccuuacacuguuagccaccgucacuggcgggaucuucuuguuucugaugucgggaaagggcauugguaaaaugacgcucgggaugugcugcaucauaaccgcaucuauccugcuuugguacgcccagauucagccccacuggaucgcugcguccauuauccuggaguucuuucucauaguuuugcugauuccagaaccugagaagcaacgcacaccccaggacaaccaguuaacuuaugugguaaucgccauccuaaccguggucgcagcuacaauggccaaugaaaugggcuuccuggagaaaaccaagaaagauuuuggacucggcagcauuacuacacagcaaccagagaacaauauccuugacauagaucugaggccugccucagcauggacguuguacgcuguggccaccacuuucauuacacccaugcugcggcauaguaucgaaaacucuuccguuaaugugagccucaccgcgauugcuaaccaggccaccguccugauggggcuuggaaaggguuggccgcucucaaagauggacaucggcguaccacuguuggcaauaggguguuacagucaggugaauccuaucacacugacugccgcuuuacuacugcucguugcacacuaugccauuaucggacccggccuucaggcgaaagcuacgcgugaggcccaaaagagagcagccgcugguauuaugaaaaacccaaccguggacgggaucacagucauugaucuggaccccaucccuuacgauccgaaguuugaaaaacaguugggccaggugaugcugcucguccugugcgugacucagguucuuaugaugaggaccacaugggccuuaugugaggcacugacccucgcuacuggacccauaagcacguugugggaaggcaauccagggcgcuucuggaacacaaccauugccguguccauggcgaacaucuuucggggaucuuaucuggccggcgcaggucuacuguucagcaucaugaagaauacugcuaacacccgaagagggacaggaaauacuggcgagacccucggugagaaguggaaaaacaggcuuaaugcccugggcaaguccgaauuucaaauuuacaaaaagucagggauacaggagguagaccgcacauuggcaaaagaaggaaucaagcggggcgagacggaucaucacgcugugucuagagggagugccaaacugcguugguucgucgagaggaaccucguuaccccugaaggaaagguggucgaccugggcugcgguagaggcggguggucguauuacuguggggguuuaaagaaugugaaagagguaaagggccuuacuaaagggggacccggccaugaggaaccuauuccaaugagcacauauggguggaaccuggugcgccuccaguccggaguugauguguucuuuacacccccugaaaagugcgacacucuacugugugauaucggcgagucuucaccaaaucccacagucgaggccggucgaaccuugagagugcugaaccucgucgaaaauuggcuuaacaauaacacgcaauucugcauuaaagugcugaauccguacaugccuagcguuaucgagaagauggaagcguugcagaggaaguacgggggagcucugguacggaacccacucucccgcaacaguacccacgagauguauugggugucuaaugcaagcggcaacauagucucauccgugaauaugaucaguagaauguuaauuaacagguuuacaaugcgacacaaaaaggccacuuacgaacccgacguugaucugggcagcgggacccggaauaucggaauugagucugagacaccuaaccuugacaucauagguaaacguauugaaaagaucaaacaggagcaugaaacuuccuggcacuaugaucaggaccauccauacaagaccugggcuuaucacggcucauacgagacaaagcaaaccgggagcgccucgucuauggugaauggagucgugagacugcuaacuaaacccugggacguaaucccgauggugacgcagauggcaaugacagauaccacuccuuucggccagcagcgcguuuuuaaggaaaaagucgacaccaggacacaagagcccaaggaggguacgaaaaagcucaugaagauuaccgccgaauggcuguggaaagaguuggggaagaaaaagacuccacggauguguacaagagaagaguucacccgcaaagugaggaguaacgcugcgcugggagccauauuuacugaugagaauaaguggaaauccgcacgagaagcuguggaggacagcggcuucugggaacucgucgauaaggagcggaaccuucaccuggaaggcaagugcgagacauguguuuauaauaugauggggaaaagagagaagaaauuaggagaauuugguaaggccaaaggcucaagggcaaucugguacauguggcugggggcccgcuucuuggaguuugaagcucucggauuccugaacgaggaccauugguuuucccgugaaaauucucuaagcggcguggagggugaggggcuucacaagcugggauacauucuccgggauguaaguaagaaagaaggcggcgccauguaugcggacgauaccgcagggugggacacaagaaucacucuggaggauuugaagaacgaagagauggugaccaaucauauggaaggagagcacaaaaagcuggccgaggcuauuuucaaacucacguaccagaacaaggucgugaggguucagcgcccuacaccccgagguacagugauggacaucauaucccggagagaccagaggggcagcgggcaagucgugacuuauggacuuaacaccuucacaaauauggaagcccagcugauccgccagauggagggcgaagguguauuuaagucuauucaacaguuaacuguuaccgaggagaucgcagugaaaaacuggcuggucagaguggggcgggaaagguugucacguauggcuauuaguggagaugacugcguggucaagccacucgaugaccgauucgccuccgcucugacggcccuaaaugauaugggcaaaguucgcaaggacauccagcagugggagcccagcagaggcuggaacgauuggacacaagugccuuuuugcucucaucacuuccacgaacuuauuaugaaagacgggcggguacugguggucccauguaggaaucaggaugagcucauaggacgcgcaagaaucucgcagggugcgggcuggucacugcgggaaaccgccugcuugggaaagagcuacgcucagaugugguccuuaauguauuuucauaggcgagaccugcgucucgccgcaaacgcuauuuguagugccgugccgucucacuggguucccacuagcagaacaaccugguccauccaugcaacucacgaguggaugaccacagaggauaugcuuacgguguggaaucgcgucuggauccaagaaaacccuuggauggaggacaagaccccaguggaaucaugggaggaaauucccuaccugggaaaacgggaggaucaguggugcggcagucuaauaggucugacuucuagggccacaugggcgaagaauauccagaccgcuauuaaccagguaagaagccucaucgggaaugaggaauauacugacuacaugccuuccaugaaacgcuuccggagggaggaagaggaagccggaguuuugugguga

SEQ ID NO: 14896 - RNA, 9876 nt, Artificial Sequence
  derived and/or modified CDS sequence (opt3) from DENV-2__KT187554__SS-prME
acagccggaaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccauuauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguugauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaagcgagaacgaagugaaacugacuaucaugaccggcgacauuaaggggaucaugcaggcuggaaaacgcucccuaagaccucagccaacagagcucaaguacucauggaaaacguggggcaaggccaagaugcugaguaccgaacuucacaaucauacuuucuugauagaugggccggagacagcagaaugccccaacaccaauagggcguggaacucucuggagguagaggacuauggauuuggcgucuucacaacuaauaucuggcucaaacugaaggaacgucaagauguguuuugugacagcaaauuaauguccgcugccauuaaggacaaccgggcaguucacgccgauauggguuacuggaucgagucagcucugaacgacaccuggaaaauugaaaaggccagcuucaucgaggugaagucuugccacuggccuaaaucccauacgcuuuggaguaauggggucuuggagagcgaaaugauaauuccaaagaacuucgcaggacccgugucucagcacaauuaucgaccuggcuaccauacacagaccgcugguccauggcaccucggcagacuggagauggauuuugacuucugugaagggacuaccguugugguaacagaggauugcggaaacaggggccccucccuacgcacuaccacagccucagggaaacugaucacggaauggugcugucggaguugcacccucccgccucugagauacaggggagaggacggcuguugguaugguauggagauccgcccacuuaaggaaaaagaggaaaauuuggucaacagccuggugacugcggggcauggacagauugauaauuuuucguuaggcgugcucgguauggcccuguuccuugaggaaaugcugcgaacacgggucggcaccaagcacgcuaucuugcucguugcaguguccuuuguaacucugauuacagggaacaugucuuuccgugaccuaggaagagugauggucauggugggcgccgcuaugaccgaugacauagggaugggaguuacguaccuggcccuccuggcagcguuuaaggugaggcccacuuucgccgcuggccuuuugcugcgcaaauuaaccagcaaggagcucaugaugacaaccaucgguauuguccugcuuucacaaaguacuaugccugagacaauccuggaacuaaccgaugcccucgcacuggggaugaugguguugaaaauuguucggaauauggagaaguaucagcuggcugugacaaucauggccauauuaugcguccccaacgcaguaauccuccagaaugccuggaaaguguccuguacuacccuggcuguugugucugucagcccacuuuuucugacguccucacaacagaaggcggacuggauuccuuuggcccucacaaucaagggacugaaccccaccgcaauuuuccuaacuacccugagcagaacaaguaaaaagaggucuuggccacuuaaugaagcuaucauggccgugggcaugguauccauacucgccagcucgcuguugaaaaacgauauuccgaugacuggcccucugguggcugggggauuacucaccgucugcuacguucugacgggucgaucagcagaccuugagcuggaacgcgccgcggacgugcggugggaggagcaggcugaaaucucuggcaguucccccaucuugagcauuacaauaucugaggaugggagcauguccaucaagaaugaagaggaggaacagacccucacuauucugaucagaacaggacuacuggugauuucaggccuuuuuccagucaguauccccauaaccgccgcagccugguaucucugggaggugaaaaagcaaagggcugguguucugugggacguaccuagcccacccccuguggggaaagcagaauuggaggauggagccuaccguaucaagcagaagggcauuuuaggcuauucucagaucggggcgggagucuacaaagaagguacuuuccacacaauguggcaugugacccgcggcgcuguucugaugcacaaggggaaacggauugagccguccugggccgacgugaagaaagaucucaucucauacggaggcgguuggaagcuggagggggaauggaaggagggagaagagguccaggugcuugcacuggaaccaggcaaaaaccccagagccguacaaacgaagccuggcuuguuuaaaacuaacaccgggacaauaggagcugucagucuagacuucagcccagguaccuccggcucucccauuguggauaagaaagggaagguugugggacuguauggcaauggugucgugacaaggucggggacuuacguuagcgccaucgcacagaccgagaagucaaucgaggacaacccugaaauugaggaugacaucuuccggaaaaagagacucacgauaauggaucugcauccgggagcuggcaaaacaaagcgcuaucuucccgccauugugagagaagcgaucaaaaggggcuuacggacucugauucucgccccaacccgagucguggcagcugagauggaagaggccuugagagggcugccuauccgcuaccagacacccgcuauaagggcagagcacaccggacgugaaauuguagaccucaugugucaugccacuuuuaccaugcggcugcuuuccccaaucagagugccuaauuauaaccugaucauuauggaugaggcccacuucacagaccccgcuaguaucgcggcaagggguuacauuucuacgcgcguugaaaugggcgaggccgcugggauauuuaugacugccaccccaccgggaagccgagacccuuucccccaguccaaugcaccaaucauggaugaggaaagagagauucccgaacggucauggaacucuggccacgagugggucacagacuuuaaggguaagaccgugugguucgugccuagcaucaaagccgggaaugauaucgcugcgugcuugaggaagaacggcaaaaaggucauucaacuaagucgcaaaacuuuugacuccgaauauauaaagacacguaccaaugauugggacuucguagugacgacugauaucagcgagaugggcgccaacuuuaaggcagagagaguuauugacccacggagguguaugaaacccgugauccugacagauggcgaagaacgcgucauucucgcugggccuaugccggugacccauucuucagccgcacagcgaagaggacggguugguaggaauccaaagaacgaaaaugaccaguacaucuacaugggcgagcccuuagaaaacgaugaggacugcgcccacuggaaagaggcuaagaugcugcuugacaauauauccaccccugaagggaucauucccaguauguucgagccagaacgcgagaaaguggaugccaucgacggagaauauagacugaggggcgaggcgcggaagacuuuugucgaucucaugcgucgcggugacuugccuguguggcuggcauaccgaguagccgcugaggggauuaacuaugccgauagaaggugguguuucgacggcgugaaaaacaaucaaauccucgaagagaacguugaagucgagauauggacaaaggagggagaacggaagaaacugaagccccgcuggcuugaugcuagaauuuacagcgacccacuagcacugaaagaguucaaggaauuugccgcuggcaggaaaucguugaccuuaaaucugaucacagagauggggcggcucccuacuuucaugacgcagaaggcccgaaacgcacuggauaaucuugcggugcugcauaccgccgaagcuggagguagagccuauaaccacgcacucucugaguugccggagacacuggaaacucuacugcuccuuacccuguuagcugccgugacaggcgggauauuuuuguuccugauguccggaaagggcaucgguaaaaugacccucgggaugugcugcauaaucacugcaagcauucugcuuugguacgcccagauccagccccacuggauugcugcgucaaucauacuggaguuuuuccucauugucuugcugaucccagaaccugagaagcaacgcacgccccaggacaaucaguuaaccuauguugugaucgccauucuaacaguaguggcagcuacuauggccaacgaaaugggcuuucuggagaaaaccaagaaagauuucggacucggcaguacaaccacucagcaaccagagucuaauauccuugacauagaucugaggccugccuccgcauggacauuguacgcugucgccacgaccuuuauuacucccaugcugcggcauagcaucgaaaacucaagugugaauguuagccucacagcgauugcuaaccaggccaccgugcugauggggcuuggaaaggguuggccgcucuccaagauggacaucggcgucccacuguuggcaauaggguguuacucucagguaaauccuaucacccugacagccgcuuuacuacugcucguggcacacuaugccauuaucggacccggccuucaggcgaaagcuacucgugaggcccaaaagagagcagccgcugguauuaugaaaaacccaacgguugacgggaucaccgugauugaucuggaccccaucccuuacgauccgaaguucgaaaaacaguugggccaggucaugcugcucgugcugugcgucacacaggugcuuaugaugaggacuaccugggccuuaugugaggcacugacacucgcuaccggacccauaagcacuuugugggaaggcaauccagggcgcuuuuggaacacgacaauugccguuuccauggcgaauaucuuccggggaucauaucuggccggcgcaggucuacuguuuucuaucaugaagaacaccgcuaacacucgaagagggaccggaaauacaggcgagacucucggugagaaguggaaaaacaggcuuaaugcccugggcaagagugaguuccaaauuuacaaaaagucggggauacaggagguggaccgcaccuuggcaaaagaaggaaucaagcggggcgagacagaucaucacgcuguaagcagaggguccgccaaacugcguugguucguggagaggaaccucgucacgccugaaggaaagguuguggaccugggcugcgguagagggggauggucuuauuacuguggcgguuuaaagaaugucaaagaggugaagggccuuaccaaagggggacccggccaugaagaaccuauuccaaugucaacuuauggguggaaccugguacgccuccagagcggaguggauguauuuuucacacccccugaaaagugcgacacccuacugugugauaucggcgaguccaguccaaaucccacuguggaggccggucgaacauugagaguccugaaccucguggaaaauuggcuuaacaauaacacccaauuuugcauuaaaguccugaauccguacaugccuucugugaucgagaagauggaagcguugcagaggaaguacgggggagcucugguucggaacccacucagccgcaauucaacgcacgagauguauuggguauccaacgcaaguggcaacauagugagcucugucaauaugaucuccagaauguuaauuaacagguucaccaugcgacacaaaaaggccacauacgaacccgacguggaucugggcucagggacucggaauaucggaauugagagcgagaccccuaaccuugacaucauagguaaacguauugaaaagaucaaacaggagcaugaaacaucguggcacuaugaucaggaccauccauacaagacuugggcuuaucacggcucuuacgagaccaagcaaacagggagugccuccagcaugguuaauggaguggucagacugcuaaccaaacccugggacgugaucccgaugguaacucagauggcaaugacggauacaaccccuuuuggccagcagcgcguguucaaggaaaaaguugacacuaggacccaagagcccaaggaggguaccaaaaagcucaugaagauuacggccgaauggcuguggaaagaguuggggaagaaaaagaccccacggauguguacuagagaagaguuuacacgcaaagucaggucaaacgcugcgcugggagccauauucaccgaugagaauaaguggaaauccgcacgagaagcuguggaggacucuggcuuuugggaacucguggauaaggagcggaaccuucaccuggaaggcaagugcgagacuugugucuauaauaugauggggaaaagagagaagaaauuaggagaguucgguaaggccaaaggcagcagggcaaucugguacauguggcugggggcccgcuuuuuggaguucgaagcucucggauuucugaacgaggaccauugguucagucgugaaaauucccuaagcggcguugagggugaggggcuucacaagcugggauacauucuccgggaugugucuaagagagaaggcggcgccauguaugcggacgauacagcagggugggacaccaggaucacacuggaggauuugaaaaacgaagagaugguaacuaaucauauggaaggagagcacaagaaacuggccgaggcuauuuucaagcucaccuaccagaacaaagugguccgcgugcagcgaccuacgccccgggguaccguuauggacaucauaucaagaagggaccagcgcggcagugggcaaguggucacauauggacuuaauacuuuuaccaacauggaagcccagcugaucagacagauggagggcgaagguguguucaaguccauucaacaguuaacaguaacugaggagaucgcaguuaagaacuggcuggugcgggucgggagggaacguuugagccgaauggcuauuucuggagaugacugcguggugaaaccacucgaugaccgcuuugccucggcucugaccgcccuaaaugauaugggcaaggucagaaaagacauccagcagugggagcccucacggggcuggaacgauuggacgcaaguuccuuucugcagccaucacuuucacgaacuuauuaugaaggacgggagggugcugguagugccaugucgcaaucaggaugagcucauaggacgagcacggaucucccagggugcgggcuggagucugagggaaacagccugcuuggggaaaucuuacgcucagauguggaacuuaauguauuuccaucgacgugaccugagacucgccgcaaaugcuauuuguagcgccgucccgucccacugggugcccaccucacgcacuacauggaguauccaugcaacccacgaguggaugacuaccgaggauaugcuuacaguuuggaaccggguguggauccaagaaaauccuuggauggaggacaagacgccagucgaaucuugggaggaaauucccuaccugggaaagagggaggaucaguggugcggcagccuaauaggucugaccuccagagccacuugggcgaaaaacauccagacagcuauuaaucaggugcgcucacucaucgggaacgaggaauauaccgacuacaugccuagcaugaagcgguuuaggcgagaggaagaggaagccggaguauugugguga

SEQ ID NO: 14897 - RNA, 9876 nt, Artificial Sequence
  derived and/or modified CDS sequence (opt3) from DENV-2__KT187557__SS-prME
accgccggcaucauuauaaugaugauccccacagugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggagugguuacgcucuaccugggcgucauggugcaggcugacucugguuguguggucucauggaaaaacaaggagcuuaaaugcgggaguggaaucuucauuacagauaauguucacaccuggacugaacaguauaaguuucagcccgagagcccauccaagcuggccucugcaauccaaaaagcccacgaagagggcauuugugguaucaggucggugacacgguuggaaaaccucauguggaagcagauaacccccgagcugaaucauauuuuaagcgagaacgaagugaaacugacuaucaugaccggcgacauuaaggggaucaugcaggcuggaaaacgcucccuaagaccucagccaacagagcucaaguacucauggaaaacguggggcaaggccaagaugcugaguaccgaacuucacaaucauacuuucuugauagaugggccggagacagcagaaugccccaacaccaauagggcguggaacucucuggagguagaggacuauggauuuggcgucuucacaacuaauaucuggcucaaacugaaggaacgucaagauguguuuugugacagcaaauuaauguccgcugccauuaaggacaaccgggcaguucacgccgauauggguuacuggaucgagucagcucugaacgacaccuggaaaauugaaaaggccagcuucaucgaggugaagucuugccacuggccuaaaucccauacgcuuuggaguaauggggucuuggagagcgaaaugauaauuccaaagaacuucgcaggacccaugucucagcacaauuaucgaccuggcuaccauacacagaccgcugguccauggcaccucggcagacuggagauggauuuugacuucugugaagggacuaccgugguugugacagaggauugcggaaacaggggccccucccuacgcacuaccacagccucagggaaacugaucacggaauggugcugucggaguugcacccucccgccucugagauacaggggagaggacggcuguugguaugguauggagauccgcccacuuaaggaaaaagaggaaaauuugguaaacagccuggucacugcggggcauggacagauugauaauuuuucguuaggcgugcucgguauggcccuguuccuugaggaaaugcugcgaacacgggugggcaccaagcacgcuaucuugcucgucgcaguuuccuuugugacucugauuacagggaacaugucuuuccgugaccuaggaagaguaauggugauggucggcgccgcuaugaccgaugacauagggaugggagugacguaccuggcccuccuggcagcguuuaagguuaggcccacuuucgccgcuggccuuuugcugcgcaaauuaaccagcaaggagcucaugaugacaaccaucgguauugugcugcuuucacaaaguacuaugccugagacaauccuggaacuaaccgaugcccucgcacuggggaugauggucuugaaaauugugcggaauauggagaaguaucagcuggcuguuacaaucauggccauauuaugcgugcccaacgcagucauccuccagaaugccuggaaaguauccuguacuacccuggcugugguuucugugagcccacuucuguugacguccucacaacagaaggcggacuggauuccucucgcccugacaaucaagggacuaaaccccaccgcaauuuuucugacuacccuuagcagaacaaguaaaaagaggucuuggccacucaaugaagcuaucauggccgucggcaugguguccauacuggccagcucguugcugaaaaacgauauuccgaugacuggcccuuuaguagcugggggacuccugaccgugugcuacguccuuacgggucgaucagcagaccuggaguuggaacgcgccgcggacguucggugggaggagcaggcugaaaucucuggcaguucccccauccucagcauuacaauaucugaggaugggagcauguccaucaagaaugaagaggaggaacagacccugacuauucuaaucagaacaggacugcuugugauuucaggccucuucccagugaguauccccauaaccgccgcagccugguaucugugggaggucaaaaagcaaagggcugguguguugugggacguuccuagcccacccccuguagggaaagcagaauuagaggauggagccuaccguaucaagcagaagggcauucugggcuauucucagaucggggcgggaguguacaaagaagguacuuuucacacaauguggcaugucacccgcggcgcugugcucaugcacaaggggaaacggauugagccguccugggccgacguuaagaaagaucugaucucauacggaggcgguuggaagcuugagggggaauggaaggagggagaagaggugcagguccuggcauuggaaccaggcaaaaaccccagagccgugcaaacgaagccuggccuauucaaaacuaacaccgggacaauaggagcuguaagucuggacuuuagcccagguaccuccggcucucccauugucgauaagaaagggaaggugguuggacucuauggcaaugguguggucacaaggucggggacuuacgugagcgccaucgcacagaccgagaagucaaucgaggacaacccugaaauugaggaugacaucuuccgaaaaaagcggcugacgauaauggaucuucauccgggagcuggcaaaacaaagcgcuauuuacccgccauuguuagagaagcgaucaaaaggggccugcggacucucauuuuggccccaacccgaguggucgcagcugagauggaagaggcccugagagggcucccuauccgcuaccagacacccgcuauaagggcagagcacaccggacgugaaauuguggaccugaugugucaugccacuuucaccaugcggcuucuguccccaaucagaguaccuaauuauaacuugaucauuauggaugaggcccacuuuacagaccccgcuaguaucgcggcaagggguuacauuucuacgcgcguggaaaugggcgaggccgcugggauauucaugacugccaccccaccgggaagccgagacccuuuuccccaguccaaugcaccaaucauggaugaggaaagagagauucccgaacggucauggaacucuggccacgaguggguuacagacuucaaggguaagaccgucugguuugugccuagcaucaaagccgggaaugauaucgcugcgugccuaaggaagaacggaaaaaaggugauucaacugagucgcaaaacuuucgacuccgaauauauaaagacacguaccaaugauugggacuuugucguaacgacugauaucagcgagaugggcgccaacuucaaggcagagagagugauugacccacggagguguaugaaacccguuauccucacagauggcgaagagcgcgugauuuuagcugggccuaugccggucacccauucuucagccgcacagcgaagaggacggguggguaggaauccaaagaacgaaaaugaccaguacaucuacaugggcgagccccuggaaaacgaugaggacugcgcccacuggaaagaggcuaagaugcuucuggacaauauauccaccccugaagggaucauucccaguauguuugagccagaacgcgagaaaguugaugccaucgacggagaauauagacucaggggcgaggcgcggaagacuuucguggauuugaugcgucgcggugaccugccugucuggcucgcauaccgaguggccgcugaggggauuaacuaugccgauagaaggugguguuuugacggcguaaaaaacaaucaaauccuggaagagaacguggaaguugagauauggacaaaggagggagaacggaagaaacuuaagccccgcuggcuagaugcuagaauuuacagcgacccacuggcauugaaagaguucaaggaauucgccgcuggcaggaaaucguuaacccugaaucucaucacagagauggggcggcugccuacuuuuaugacgcagaaggcccgaaacgcacuugauaaucuggcgguccuccauaccgccgaagcuggagguagagccuauaaccacgcauugucugagcugccggagacacuagaaacucugcuccuucugaccuuauuggcugccgugacaggcgggauuuuccuguuucucauguccggaaagggcaucgguaaaaugacccuggggaugugcugcauaaucacugcaagcauucuucugugguacgcccagauccagccccacuggauugcugcgucaaucauacucgaguucuuuuugauugugcuguuaaucccagaaccugagaagcaacgcacgccccaggacaaucagcuaaccuaugucguuaucgccauucugacagugguagcagcuacuauggccaacgaaaugggcuuccucgagaaaaccaagaaagauuuuggacuuggcaguacaaccacucagcaaccagagucuaauauccuggacauagauuugaggccugccuccgcauggacacuguacgcuguggccacgaccuucauuacucccaugcuccggcauagcaucgaaaacucaagugucaaugugagccugacagcgauugcuaaccaggccaccguucuuauggggcucggaaaggguuggccgcuguccaagauggacaucggcgugccauugcuggcaauaggguguuacucucaggucaauccuaucaccuuaacagccgcucuacugcuccuuguagcacacuaugccauuaucggacccggccugcaggcgaaagcuacucgugaggcccaaaagagagcagccgcugguauuaugaaaaacccaacgguggacgggaucaccguuauugauuuggaccccaucccuuacgauccgaaguuugaaaaacagcugggccaggugaugcuccugguccuuugcgugacacaggucuuaaugaugaggacuaccugggcccugugugaggcacucacauuggcuaccggacccauaagcacucugugggaaggcaauccagggcgcuucuggaacacgacaauugccguguccauggcgaauaucuuucggggaucauaucuagccggcgcaggucugcucuucucuaucaugaagaacaccgcuaacacucgaagagggaccggaaauacaggcgagacucuuggugagaaguggaaaaacaggcugaaugccuugggcaagagugaauuucaaauuuacaaaaagucggggauacaggagguugaccgcacccuggcaaaagaaggaaucaagcggggcgagacagaucaucacgcugugagcagaggguccgccaaacuccguugguucguagagaggaaccuggugacgccugaaggaaaggucguugacuuaggcugcggucgggggggauggucuuauuacuguggcggucuuaagaaugugaaagaggucaagggccugaccaaagggggacccggccaugaagagccuauuccaaugucaacuuauggguggaaccucgugcgccuacagagcggaguagauguguucuuuacacccccugaaaagugcgacacccuguugugugauaucggcgaguccaguccaaaucccacuguugaggccggucgaacacugagagugcucaaccuugucgaaaauuggcugaacaauaacacccaauucugcauuaaaguguugaauccguacaugccuucugucaucgagaagauggaagcgcugcagaggaaguacgggggagcucucgugcggaacccauuaagccgcaauucaacgcacgagauguauuggguuuccaacgcaaguggcaacauaguaagcucugugaauaugaucuccagaaugcugauuaacagguuuaccaugcgacacaaaaaggccacauacgaacccgacgucgaucuuggcucagggacucggaauaucggaauugagagcgagaccccuaaccuggacaucauagguaaacguauugaaaagaucaaacaggagcaugaaacaucguggcacuaugaucaggaccauccauacaagacuugggcuuaucacggcucuuacgagaccaagcaaacagggagugccuccagcauggugaauggaguugugagacuacucaccaaacccugggacgucaucccgauggugacucagauggcaaugacggauacaaccccuuucggccagcagcgcguauuuaaggaaaaaguggacacuaggacccaagagcccaaggaggguacaaaaaagcugaugaagauuacggccgaaugguuguggaaagagcuggggaagaaaaagaccccacggauguguacuagagaagaguucacacgcaaaguuaggucaaacgcugcgcucggagccauauuuaccgaugagaauaaguggaaauccgcacgagaagcugucgaggacucuggcuucugggaacuuguggauaaggagcggaaccugcacuuagaaggcaagugcgagacuuguguguauaauaugauggggaaaagagagaagaaacugggagaauuugguaaggccaaaggcagcagggcaaucugguacaugugguugggggcccgcuuccucgaguuugaagcucugggauuccuaaacgaggaccauugguuuagucgugaaaauucccuuagcggcgucgagggugaggggcugcacaagcucggauacauucugcgggauguuucuaagaaagaaggcggcgccauguaugcggacgauacagcagggugggacaccagaaucacauuggaggaucugaagaacgaagagauggugacuaaucauauggaaggagagcacaaaaagcucgccgaggcuauuuucaaacuuaccuaccagaacaagguagugaggguccagcgcccuacgccccgagguaccgugauggacaucauaucacggagagaccagaggggcagugggcaaguugugacauauggacugaauacuuucaccaacauggaagcccaguuaauccgccagauggagggcgaaggugucuuuaaguccauucaacagcugacagugacugaggagaucgcaguaaaaaacugguugguuagaguggggcgggaaaggcucagccguauggcuauuucuggagaugacugcgucgugaagccacuggaugaccgauucgccucggcucuaaccgcccuuaaugauaugggcaaagugcgcaaggacauccagcagugggagcccucaagaggcuggaacgauuggacgcaagucccuuuuugcagccaucacuuccacgaacugauuaugaaagacgggcggguucucgugguaccauguaggaaucaggaugagcugauaggacgcgcaagaaucucccagggugcgggcuggaguuugcgggaaacagccugcuuagggaagucuuacgcucagauguggaaccugauguauuuucauaggcgagaccuccgucuugccgcaaaugcuauuuguagcgccgugccgucccacuggguccccaccucaagaacuacauggaguauccaugcaacccacgaguggaugacuaccgaggauaugcugacaguguggaaccgcguuuggauccaagaaaauccuuggauggaggacaagacgccaguggaaucuugggaggaaauucccuaccuaggaaaacgggaggaucaguggugcggcagccugauaggucucaccuccagggccacuugggcgaagaacauccagacagcuauuaaucaggucagaucauugaucgggaacgaggaauauaccgacuacaugccuagcaugaaacgcuuccggagggaggaagaggaagccggagugcugugguga

SEQ ID NO: 14898 - RNA, 9876 nt, Artificial Sequence
  derived and/or modified CDS sequence (opt3) from DENV-2__JQ045670__SS-prME
agcgccggaaugaucauuaugcugauacccaccgugauggcuuuccaccucacaacuagaaacggggaaccucauaugaucgucggcauucaggaaaaggguaaaucccuucuguuuaagacggaggacggcguuaauaugugcaccuugauggcaauggauuuaggggaacugugugaggacacaaucacuuacaaaugcccacuucucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccgcuauggccgaugacaucgggaugggagucacuuaucucgcacugcuugcggccuucaaggugcgacccacauuugcugccggcuugcuguuacggaagcucaccuccaaagagcugaugaugacgacuauugguaucguucuucugucucaaagcaccauaccugaaacagugcuagagcucaccgaugcacuggcuuuggggaugaugguccugaagaucgugcguaauauggaaaaauaccaguuagccguuacuauuauggcaauccucugcgugcccaacgccgucauucugcagaaugcuuggaagguaucauguacaauccuugcggugguuaguguguccccacuguugcucaccucuagccagcagaaaacugacuggauaccucuggcccuaacuauuaagggacugaaccccaccgcaaucuuccuuacgacacucuccagaaccaauaaaaagaggucauggccacugaacgaggcuaucauggccgucggcauggugagcauuuuggccaguucucuguuaaagaaugacauaccgaugacuggcccucucguagcugggggacugcuuaccgugugcuauguccugacaggucgcuccgcagauuuggaacucgagcgggccacugacguuaaaugggaggaucaagcggaaaucagcggcucgucacccauucugucuaucaccauuagugaggacggguccaugagcaucaagaacgaagaggaggaacagacgcuaacaauacugaucagaaccggacuucucgugauuucuggccuguuuccaaucagcauucccaucacugcugccgcaugguacuugugggaggugaaaaagcagagggccggugucuuaugggaugugccuuccccacccccuauggggaaagcugaacuggaggacggagcauaucgaauaaagcaaaagggcauucucggcuacucacagaucggggccggaguuuacaaagaagguacauuccacaccauguggcauguaacucgcggcgcggugcugaugcacaaggggaaacggaucgagccgaguugggcugaugucaagaaagaccuuauuagcuauggaggcgguuggaagcuggagggggaauggaaggagggagaagaggugcagguuuuggcccuagaaccaggcaaaaaucccagagcagugcagacaaagccuggccuguuuaaaaccaacacggggacuaucggagccgucucucucgauuucuccccagguaccucaggcagucccauaauugacaagaaagggaaggugguaggacuguacggcaacggugucgugacaaggagcggggcuuauguuuccgccaucgcacaaaccgagaagucuauugaggauaauccugaaaucgaggacgauauauuucguaaacgccggcuuacaauuauggacuuacacccgggagcuggcaagacuaaaagauaccugcccgccaucgugagggaagcgaucaagcgaggccuccggaccuugauucuggccccaacgcgcgucguggcagcugagauggaagaggcccucagagggcugccuaucagguaucagacacccgcuauucgggcagagcauacuggacgagaaauaguugaccuuaugugucacgccaccuucacaaugagacuguugucgccagugcgcgucccuaacuacaaucuaaucauuauggaugaggcccauuucaccgaccccgcuagcaucgcggcaagggguuauaucucaacucguguggaaaugggcgaggccgcugggauuuuuaugaccgccacaccaccgggaucccgggauccuuucccccagaguaacgcaccaauaauggacgaggaaagagagauccccgaaaggucuuggaauagcggccacgaguggguaacggauuuuaaagguaagacugugugguucguuccuuccauuaaggccgggaacgacaucgcugcgugccugcgcaaaaauggaaagaaagucauucaacucucacgaaagaccuuugauucugaauacgugaaaacaagaaccaacgacugggauuucguggucacuacagacaucagcgagaugggcgccaauuuuaaggcagagcggguaauagauccaaggcgcuguaugaaacccgugaucuuaaccgacggcgaagaacguguuauucuggcugggccuaugccggugacgcauaguuccgccgcacagagacggggaaggaucggucgcaacccaaagaaugaaaacgaccaguacauuuauaugggcgagccccuugaaaaugaugaggacugcgcccacuggaaggaggcuaaaaugcugcucgauaacaucaauacuccugaagggauaauucccagcauguucgagccagaacgagagaaggucgacgccaucgauggagaauacagauugcggggcgaggcgaggaaaacauuuguggaccugaugcgcagaggugaucucccuguuuggcuggcauauaagguggccgcugaggggauuaacuacgccgacaggcggugguguuucgauggcaucaaaaacaaucagauacuugaagagaacgucgaaguggagaucuggaccaaggagggagaacguaagaaacuaaagccccgcuggcuggacgcucgaauuuauucugauccauuggcauuaaaagaguuuaaggaguucgccgcuggcagaaaaucacugacccucaaucugaucacugagauggggaggcuuccuacauucaugacccaaaagacacgggacgcccuggauaaccucgcaguauugcacacugcggaagccggaggucgcgcuuacaaucaugcccuguccgagcuaccggagacgcuggaaacccuccuucuguuaacauugcuggcaacugugaccggcgggauuuuucucuuccugaugaguggaagaggcaucgguaagaugacacuugggaugugcugcauaauuaccgcuagcauccugcucugguaugcccagauccagccccacuggauugcagccucgaucauauuggaguuuuuccugauuguuuuacuaaucccagaaccugagaaacagaggacuccccaagacaaccagcugacguacgucgugauugcuauccucaccguggucgcggccacaauggcaaaugaaaugggcuuucuugagaagacuaaaaaggacuucggacugggcucuauagcuacccagcagccagaguccaacaucuuggauauugaccugcggccugccagcgccuggacacucuacgcaguugcuaccacuuuugugacacccaugcugcgacauucaaucgaaaauaguucuguaaacgugucccuuacggccauugcgaaucaagcuaccguccucauggggcugggaaaagguuggccguugagcaagauggauaucggcgugccacuguuagccauuggguguuauucacagguuaacccuaucacucuaacagcagcccugcuccuucugguggcucacuacgcaauaauuggacccggcuugcaggccaaggcgaccagagaggcucagaaacgcgccgcagccgguaucaugaagaauccaaccgucgacgggaucacaguaauugaucuggaccccauaccuuaugauccgaaauucgaaaagcaacucggccaggugaugcugcuuaucuuaugcguuacucaggugcugaugaugaggacgaccugggcucucugugaggccuugacacuggcaacuggacccauuaguacccuaugggaaggcaacccagggcgguuuuggaauacaaccaucgcugucagcauggccaacauuuuccguggauccuaccuggcgggcgccggucuccuauuuucuaucaugaaaaauacuacgaacacaagaagggggaccggaaacauaggcgagacucugggugagaaguggaaaagccgcuugaaugcacugggcaaguccgaguuccaaaccuauaagaaaucagggauccaggagguggaccggacacucgcuaaggaaggaauuaaacgaggcgagacugaucaccaugccgucucuagagggagugcaaagcugaggugguuuguggagcgcaacuuaguuaccccugaaggaaaagugguagaccuuggcugcgguagagggggauggucguacuauuguggcggucugaagaaugugagagaggucaagggccucacaaaagggggacccggccacgaagaaccuaucccaaugagcacguacggguggaaccuaguucgucugcaguccggaguggaugucuucuucauucccccugaaaagugcgacaccuugcugugugauaucggcgagucuucaccaaaucccacuguggaggcugguaggacacuccggguacuuaaccugguggaaaauugguugaacaauaacacccaguuuugcauaaaaguucugaauccguacaugccuagcgugauugagaagauggaagcccuccaacgcaaauaugggggagccuuaguccgaaacgaccuguccagaaauaguacucaugagauguacugggugucuaacgcgagcggcaauaucgucucauccgugaacaugaucaguaggaugcuuauuaaccgguucacaaugcgccacaagaaggcuaccuaugaaccagacguugaucugggcagcgggacgagaaauauaggaaucgagucugagauucccaaccuagacaucauugguaaaaggaucgaaaagauaaaacaggagcaugaaaccuccuggcacuacgaucaggaccacccuuauaagacaugggcauaccauggcucauaugagacuaaacagaccgggagcgccucgucuaugguaaauggagugguccgacuccugacaaagccaugggauguguugcccacuguuacccaaauggcuaugacagacaccacuccguuuggccagcagcggguguucaaggaaaaagucgauacgcguacacaggagccuaaggaggguaccaaaaagcugaugaaaaucacugccgaauggcucuggaaggagcuugggaaaaagaagacccccagaauguguacacgcgaagaguuuacgaggaaagugcggaguaacgcagcccugggagcuauuuucaccgacgagaauaaguggaaauccgcgagagaagccguagaggauagccgcuuuugggaauuaguggacaaggagaggaaccugcacuuggaaggcaaaugcgagacuuguguuuacaauaugaugggcaagcgagagaagaaacucggggaguucggaaaggcaaaagguucacgggcuaucugguacauguggcugggcgccagauuucuagaguucgaagcacuuggguuucugaacgaggaucauugguucuccagggaaaauucucucagcggagucgagggcgagggucugcacaaguugggguauauucugcgcgacgugaguaaaaaggaaggaggcgccauguacgcugacgauacagccggcugggacacccguaucacucucgaggaucuuaagaacgaagagauggugacaaaucacauggaaggggagcauaaaaagcuggcggaggcaauuuuuaaauuaaccuaucaaaacaaggucguucgggugcagagaccaacaccuaggggaacuguaauggacauaaucucccgccgagaucagcgggguagcggccaaguggggaccuacggacugaauacguucaccaacauggaagcccaguugauuagacagauggagggcgaaggugucuucaaaaauauccagcaccucacagugacugaggagguugcugugcaaaacuggcuggccagggucgggcgcgaaagacuaucucggauggcaaucucaggagacgauugcgugguaaagccccuugacgauagguuugcuaacgcccugaccgcucucaaugacaugggcaagauucguaaagauauacagcagugggagccaaguaagggcuggaacgacuggacacagguucccuucugcucccaucacuuucaugaacugaucaugaaagaugggcgaguguuggucgugccuugucgcaaucaagacgaguuaauuggacgggcccggaucagccagggugcaggcuggucucugagggaaacugcgugccucgggaagucguaugcccagauguggucacuuauguacuuccaccgcagagaccugcggcuagcugccaacgcaauuuguagcgcugugccaucccacugggucccgaccaguaggacgacauggucuauccaugccaaacacgaguggaugaccacugaggauaugcugacaguuuggaaucgaguguggauacgugaaaaccccuggauggaggacaagaccccuguagaaagcugggaggaaaucccauaucucggaaagagagaggaucaguggugcggcuccuugauuggucugacuucacgcgcaaccugggccaaaaauauccaagcggcuauuaaccaggugcggagucuuaucgggaaugaggaauacacagacuacaugcccucuaugaagagguuuagacgcgaggaagaggaagccggaguccugugguga

SEQ ID NO: 14899 - RNA, 9876 nt, Artificial Sequence
  derived and/or modified CDS sequence (opt3) from DENV-2__JQ045686__SS-prME
agcgccggcaugaucauuaugcugauacccaccgugauggcuuuccaccucacaacuagaaacggggagccucauaugaucgucggaauucaggaaaaggguaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgugauuuuggcauacacaaucggcaccacgcacuuucagcggguucucauuuucauccugcugacugccguggcuccaucuaugacaaugcgcugcauagggauuucgaacagagauuuugucgaaggagugucagguggcagcuggguagacaucguucucgagcacgggaguugugugaccacuauggcaaagaauaagcccacauuagauuucgaacugauuaaaaccgaggccaagcagccugcuacgcuuaggaaauauugcaucgaagccaaguugaccaacacaacuaccgagucccgguguccaacacaaggagagcccucucugaaagaagagcaggacaagcgcuuugucugcaagcauagcaugguggaucgaggcugggguaauggguguggacuauucggcaaaggcgggaucgugacuugcgcgauguuuaccugcaagaaaaacauggaaggaaagauuguccagccugagaaucucgaauacacaauaguugugaccccacacuccggugaggagcaugcaguaggcaacgacacugggaaacacggacaggaaaucaaggugacgccgcaaucaaguauuacagaggccgaacugaccggcuaugguacugucaccauggaguguagccccagaacagggcuugauuucaaugaaauggugcuguugcagauggagaacaaagcuuggcucguucacaggcagugguuucuggacuuaccucugccauggcuccccggcgccgauaagcaggagucuaauuggauccaaaaggaaacccuugugacuuucaaaaacccucaugcaaagaaacaggacgucgugguacugggaucccaggagggcgcuaugcacacagccuugacgggggcgaccgaaauacaaaugucaagcggaaaucuacuguuuacuggucaucucaagugccggcugcguauggacaaacuucagcugaagggcaugaguuacucuauguguacagggaaguucaaaguugugaaggagauugccgagacccagcacggaacaaucgucauccgcgugcaguaugaaggcgaugguuccccaugcaaaauucccuucgagaucauggacuuggaaaagagauacguccucgggaggcugauuacugugaacccgauaguuaccgagaaagauagcccugugaacaucgaagcagagcccccauuuggcgacucguacauuaucaucggaguagagccuggccaauuaaagcugaauugguucaagaaagggucuuccauuggacagauguuugaaacgaccaugcggggugcuaagcgaauggccauacuaggcgauacagcuugggacuucgggucacucggaggcgucuuuacuaguaucgguaaagcccugcaucagguguucggggcaauuuauggcgccgcuuuuagcggaguuuccuggaccaugaagauccuuauuggcgugaucauaacauggaucgggaugaacucucgcagcacuucauugagugucucccuggugcucguaggaauugugacccuguaccuuggcguuaugguccaggcggauagcgguuguguggugucuuggaaaaauaaggagcugaagugcgggucaggaaucuucauuacggacaacguccacacauggaccgaacaauauaaauuucagcccgagaguccaagcaaguuggcauccgccauccagaaagcucaggaagagggcauaugugguauuagaucuguuacuaggcucgagaaucugauguggaagcaaaucacacccgaauuaaaccacauucuggccgagaaugaagugaaacuaaccaucauaacuggcgauaucaaggggauuaugcaggcaggaaaacggucgcuccgcccucagccaaccgagcugaaguacagcuggaagacauggggcaaagccaagaugcuuuccacggaaucauauaaccagaccuucuugaucgacgggccggagacugcugagugccccaauacaaacagagccuggaauagucuggaaguggaggauuacggauuuggcguauucaccacaaacauuuggcucaaacugaaggaaaaacaagacgcauuuugugacucuaaguuaaugagcgcggcuaucaaggauaauagggccguccaugcagacauggguuauuggauagaguccgcccugaacgauacuuggaaaauugagaaggcuucauucaucgaagugaaaaauugccacuggccuaagagccauacccuuuggucuaacgggguuuuggaguccgaaaugaucauuccaaaaaaccucgccggacccgugagucagcacaauuaccguccuggcuaccacacgcagaucgcagguccauggcaucugggcaagcuagagauggacuucaacuuuugugaugggacaaccgucauugugacugaagacugcggaaaucggggccccagccugcgaaccacaacugcuucugggaagcucauaaccgaguggugcuguagauccugcacacugccgccucuuagguaucgcggagaggauggcuguugguacgguauggaaauccggccauugaaagagaaggaagagaaccugguuaauucauuagugacggccgggcacggacaaguagacaacuucagucucggcguccuggguauggcgcuuuuucuggaagagauguugagaaccagggugggcacuaaacaugccauucuccugguggcugucagcuucguuacacuaaucaccgggaauaugucguuuaaggaucugggacgcgugguagugauggucggcgcaacuaugacagacgauauugggaugggagugaccuaucucgcccugcuugcugccuucaaaguucgacccacguuugcagcgggcuugcuguuacggaagcucacuuccaaggagcugaugaugaccacaaucgguauagugcuucugucucagagcaccaucccugaaacuguccuagagcucacagacgcccuggcuuuggggaugauggugcugaaaauuguucguaacauggaaaaguaccaguuagccgugaccaucauggcaauucucugcguccccaaugcuguaauccugcagaacgccuggaaagugucauguacaauacuugcaguugugagugucuccccacuguugcucacuucuagccaacagaagaccgauuggauuccucuggcccuaacgaucaaaggacugaaucccacagcuaucuuccuuaccacucucuccagaaccaacaagaaaaggucauggccacugaaugaggcgauuauggccgugggcaugguaagcauauuggcaaguucucuguuaaagaacgacaucccgaugacaggcccucucguggcugggggacugcuuacugucugcuauguucugaccggucgcuccgccgacuuggaacucgagcgggccacggaugugaagugggaggaccaggcugaaauuagcggcucgucacccauccugucuauuacaaucagugaggauggguccaugagcauaaaaaaugaagaggaggaacagacccuaacuauccugauuagaacaggacuucucgugaucucuggccuguuuccaauuagcauccccauaaccgcagccgcgugguacuugugggaggucaagaaacaaagggcugguguguuaugggacguuccuuccccacccccuauggggaaggccgaacuggaggauggagcauaucgaauuaaacagaagggcauccucggcuacucacagaucggggccggaguauacaaggaagguacuuuccacacaauguggcaugugacccgcggcgcuguccugaugcacaaagggaagcggauugagccgaguugggcagacgugaaaaaggaucuuaucagcuauggaggcgguuggaaacuggagggggaauggaaggagggagaagagguucagguguuggcccuagaaccaggcaagaaccccagagcgguccaaacgaaaccuggccuguuuaagacuaacaccgggacaauaggagcugugucucucgacuucuccccagguaccucaggcagucccauuaucgauaaaaaggggaaaguagucggacuguacggcaauggugugguuacaaggagcggggccuauguguccgcaauugcccagacugagaagucuaucgaggacaacccugaaauagaggaugacauuuuucguaagcgccggcuuaccaucauggauuuacacccgggagcuggcaaaacgaagagauaccugcccgccaucgucagggaagcaauuaaacgaggccuccggacauugauccuggcuccaacucgcgugguugccgcggagauggaagaggcccucagagggcugccuauuagguaucagacccccgcaauacgggcugagcauacaggacgagaaaucguggaccuuaugugucacgccaccuucacuaugagacuguugucgccaguccgcgugccuaauuacaaccuaauuaucauggacgaggcucauuucaccgaucccgcaagcaucgccgccagggguuauauuucaacacguguagaaaugggcgaggcugcggggauauuuaugacggcaacuccaccgggaucccgggacccuuucccccaaaguaaugccccaaucauugaugaggaaagagagauccccgaaaggucuuggaacagcggccacgagugggugaccgacuuuaaggguaaaacaguuugguucgucccuuccauuaaggcugggaaugauaucgccgcaugccugcgcaagaacggaaaaaaggugauacagcucucacgaaaaaccuuugacucugaauacgugaagacuagaacaaaugauugggacuucgucguaaccacggauaucagcgagaugggcgccaacuuuaaagcugagcgggugauugacccaaggcgcuguaugaagcccguuaucuuaacugauggcgaagagcgugugauucuggcggggccuaugccggucacacauaguuccgccgcacagagacggggaaggaucggucgcaauccaaaaaacgaaaaugaccaguacauauauaugggcgagccccuugaaaacgacgaggauugcgcucacuggaaggaggccaagaugcugcucgacaauauuaacaccccugaagggaucauucccagcauguucgagccagaacgagagaaaguggaugcaaucguuggagaauacagauugcggggcgaggccaggaagaccuuuguggaccugaugcgcagaggugaucucccugucuggcuggcuuauaaaguggccgcggaggggauaaacuacgcagacaggcggugguguuucgauggcaucaagaauaaccaaauucuugaagagaauauggaaguagagaucuggacuaaagagggagaacguaagaagcuaaaaccccgcuggcuggacgcccgaauuuauucugauccauuggcuuuaaaggaguuuaaagaauucgccgcuggcagaaagucacugacacucaaccugaucaccgagauggggaggcuuccuacauucaugacucagaaaacgcgggacgcacuggauaaucucgccguguugcacaccgcugaagccggaggucgcgcauacaaccaugcgcuguccgagcuaccggagacacuggaaacucuccuucuguuaaccuugcuggccacaguuaccggcgggauauuucucuuccugaugaguggaagaggcauugguaagaugacucuugggaugugcugcaucaucacggcuagcauucugcucugguaugcccagauccagccccacuggauagcagcuucgauuaucuuggaguuuuuccugauugucuuacuaaucccagaaccugagaagcaaaggaccccccaggacaaucagcugacauacguggugauagccauccucacugucguugcagccaccauggcuaacgaaaugggcuuucuugagaaaacaaagaaagaucugggauugggcucuauugcgacccagcaaccagaguccaauauccuggacauugaccuccggccugccagcgcauggacucuguacgcuguggccacaacguucguaacccccaugcuucgacauucaaucgaaaacaguucugugaaugucucccucacugccauugcaaaccaggcuacagugcugaugggguugggaaaggguuggccgcugagcaaaauggauaucggcguuccauuacuagccauaggguguuauucacaggugaauccuauuacccugaccgcggcucuccuucuguuggucgcccacuacgcaaucaucggacccggccugcaggccaaggcuacaagagaggcacaaaagcgcgccgcggcugguauuaugaaaaacccaacuguagacgggauaacggugaucgaucucgaccccauuccuuaugauccgaaguuugaaaaacagcugggccagguuaugcuuuuagugcugugcgucacccaagugcucaugaugaggacaacuugggccuugugugaggcacugacccuagccacaggacccaucaguacccugugggaaggcaauccagggcgguucuggaacacuacgauugcugucagcauggccaauaucuuucguggauccuaccucgcaggcgcuggucuucuguucucuauaaugaagaacacaaccaacacuagaagggggaccggaaauaugggcgagacauugggugagaaauggaagagccgccugaacgcccucggcaaauccgaauuucagaucuauaagaagucagggauucaggagguggaccggacucuggcgaaagaaggaaucaagcgaggcgagaccgaucaccaugccguuucuagagggagugcaaaauuaaggugguucguggagcgcaauaugguaacaccugaaggaaagguggucgaccuuggcugcggucgggggggauggucguacuauuguggcggucugaaaaacguuagagaggugaagggccucacgaaggggggacccggccacgaagagccuauuccaaugagcaccuacggguggaaucuaguccgucugcaguccggaguggauguauuuuucauccccccugaaaaaugcgacacuuugcugugugauauaggcgagucuucaccaaaccccacaguggaggcugguaggacccuccggguucuuaaucugguggaaaacugguugaauaacaauacucaauucugcauuaagguccugaacccguacaugccuagcgugaucgagaaaauggaagcccuccagcgcaaguaugggggagcauuaguccgaaauccacuguccagaaacaguacacaugagauguacugggugucuaaugcuagcggcaacaucguuucauccguaaacaugauuaguaggaugcuuauaaaucgguuuaccaugcgccacaaaaaggccacguaugaacccgacguggaucugggcagcgggaccagaaacaucggaauugagucugagaucccuaaucuagacauuaucgguaagaggauagaaaaaaucaagcaggagcaugaaacauccuggcacuacgaccaggaucacccauauaaaacuugggccuaccauggcucauaugagaccaagcaaacagggagcgcgucgucuauggucaacggagugguucgacuccugacuaaacccugggacguguugccgaccgucacacagauggcuaugaccgauacuacgccuuucggccagcagcggguguuuaaggaaaagguagacacacguacccaagagcccaaagaggguacuaagaaacugaugaagauuaccgcagaauggcucuggaaagagcuugggaagaaaaagacaccaagaauguguacgcgcgaagaguucaccaggaaggugcggaguaaugccgcucugggagccaucuuuacugaugagaacaaauggaaguccgcaagagaagccguugaggacagccgcuucugggaauuagucgauaaagagaggaaucugcacuuggaaggcaagugcgagacauguguguacaacaugaugggcaaacgagagaagaagcucggggaauuuggaaaagcuaaggguucacgggcgauuugguacauguggcugggcgccagauuccuagaguuugaagcacuuggguuccugaaugaggaccauugguuuuccagggaaaacucucucagcggaguggagggcgagggucugcacaaauugggguauauccugcgcgaugucaguaagaaagaaggaggcgcuauguacgccgacgauaccgcaggcugggacacucguguuacacucgaggaccuuaagaaugaagagauggugaccaaccacauggaaggggagcauaagaaacuggccgaggcuauuuucaaguuaacauaucagaauaaaguagugcggguccagagaccuacucccaggggaaccgugauggauauaaucucccgccgagaccaacgggguagcggccagguugggacguacggacugaacaccuuuacaaauauggaagcccaguugauuagacagauggagggcgaagguguguucaagaacauccaacaccucacugucaccgaggagguggcgguaaaaaacuggcuggcaaggguugggcgcgaaagacuaucucggauggccaucucaggagaugacugcguggucaagccacuugaugacagguucgcuaaugcccugacagcacucaacgauaugggcaagauucguaaagacauacagcagugggagcccagucgaggcuggaaugauuggacucaggugccuuuuugcucccaucacuuccaugaacugaucaugaaggacgggcgcguguuggucguuccauguagaaaccaagaugaguuaauuggacgggcuaggaucagccagggugccggcuggucucugcgcgaaaccgcuugccucgggaaaucguaugcccagauguggucacuuauguacuuucacagacgggaccugaggcuagcagcgaaugccauuuguagcgcugugccgucccacuggguacccacgagucgaacaaccuggucuauccaugccaagcacgaguggaugacuacagaggauaugcugaccguguggaaccgugucuggauaagagaaaauccuuggauggaggacaaaacuccaguggaaagcugggaggaaauccccuaucucggaaagcgcgaggaccaguggugcggcuccuugauuggucugaccucacgggcaacaugggcuaagaacauccaagccgcaauuaaucagguuaggagucuuaucgggaacgaggaauacacggauuacaugccuucuaugaaaagauuccgccgggaggaagaggaagccggagugcugugguga

SEQ ID NO: 14900 - RNA, 9876 nt, Artificial Sequence
  derived and/or modified CDS sequence (opt3) from DENV-2__KU094070__SS-prME
accgccggcaugaucauuaugcugauacccacagugauggcuuuccaccucacuacgagaaacggggagccucauaugaucgucagcaggcaggaaaagggaaaaucccuucuguuuaagaccgaggacgguguuaauaugugcacauugauggcaauggauuuaggcgaauggcuggaggacaaaauuacuuacaaguguccacuacuccggcaaaacgaaccggaggauaucgacugcugguguaauucuaccucaacaugggugaccuaugggacuugcacaaccacgggagagcaccgccgagaaaaacguaguguagcccuggugccccaugucggcaugggucuugagacuagaaccgaaacauggaugagcuccgagggggcguggaagcacgcucagaggauugagacuuggauccugcggcauccuggauucaccauaauggccgcaaucuuggccuacacaauuggcaccacgcacuuucagcgcgcucucaucuucauucugcugacugcaguggccccaucuaugacaaugagauguaucggcauaucgaacagggauuuuguugaaggggugucaggagguagcugggucgacauugugcucgagcacggcaguugcguaaccacuauggcuaagaauaaacccacauuagauuucgaacugaucaagaccgaggccaaacagccugcgacgcuucggaaguauuguauugaagcaaaauugaccaacacaacuaccgagucccgcugcccaacacaaggggagcccucucugaaugaagagcaggacaagcgauuuguuuguaagcauagcaugguggauagaggauggggcaacgguugcgggcuauucggaaaaggcuccaucgucacuugugccauguuuaccugcaagaaaaucaugaagggcaaaguggugcagccugaaaaucucgaguacacaauugucauaaccccacacucaggggaagagcaugcuguuggaaacgacacugguaagcacggcaaagagaucaagauuacgccgcagaguagcaucacagaagccgagcugaccggguauggaacugugaccauggaaugcucucccaggacaggccuugauuucaaugagaugguacuguugcaaauggaaaacaaggcauggcucgugcaccggcagugguuucuggacuuaccucugccauggcuccccggugcugauacccagggguccaauuggauacagaaagagacucuugucacauucaagaacccucaugccaaaaagcaagacgugguugugcugggcucacaggagggagcgaugcacacggccuugaccggcgcaacugaaauucagaugagcaguggguaccuacuguuuacaggacaucucaaaugucgucugcgcauggacaagcuucaacugaaggguaugucuuauuccaugugcaccggcaaauucaaggucgugaaagagaucgcugaaacacagcacgggacuaucguaauuagaguucaguacgagggagauggcagcccauguaagauccccuucgagauuauggacuuggaaaaaaggcaugugcucggucggcugauaaccgucaauccgaucgugacggagaaggauucgccugucaacauugaagccgagcccccauuuggggacucuuacaucaucauuggcguggaaccuggacaguuaaagcugaacugguucaaaaagggcuccucaauagggcaaauguuugagaccacaaugcgaggagcuaaacgcauggccauccuaggugauacugcaugggacuucggcagucucgggggaguuuuuaccagcauuggcaaggcccugcaccagguguucggugcuaucuauggggcggcauuuuccggcguaucuuggacaaugaaaauucuuacuggagucaucauaaccuggaucggcaugaauagcagaucaacgaguuuguccgugagccugguucucgugggggccgucacacuguaccuuggagugaugguacaggcugauucuggcugcgugguuucauggaagaacaaggagcugaaaugugguagugggauuuucaucaccgacaauguccacacuuggacagaacaguauaaguuucaacccgagagcccauccaaauuggccucugcaauucagaaggcccaugaagagggaaucugcggcauaaggucggugacccggcucgaaaaccugauguggaaacagauuacucccgaguuaaaucacauccugagcgagaacgaagugaagcuaaccauuaugacaggugauaucaaaggcauaaugcaggcugggaagcgcucccucagaccucaaccaacggagcugaaguacucauggaaaaccuggggaaaggccaaaaugcuuaguacugaaucucauaaucagacauucuugaucgacggcccggagaccgcagaaugucccaacacaaauagggcguggaacagccuggaggucgaggauuauggguuuggaguuuucacuaccaauauuuggcucaagcugcgugaagagcaggacguguuuugcgacuccaaauuaaugucagcugccaucaaggauaaccgggcagugcacgccgacaugggcuacuggauugaaagcgcucugaaugauacguggaagaucgagaaagccucuuucauagagguaaaguccugucacuggccuaaaagucauacacuuuggagcaacggugucuuggaaucugagaugauuaucccaaagaauuucgcagggcccgugucccagcacaacuaucgaccuggauaccauacccaaacugcuggcccauggcaccucgguaaacuggaaauggacuuugauuucugcgagggcaccacaguuguggucacugaagacugugggaacagaggacccucacuaaggaccacaacggccaguggcaagcugaucaccgaguggugcugccgcagcuguacucucccgccucugcgguacagaggggaggauggaugcugguauggcauggaaauuaggccacuuaaggagaaagaagagaauuuggugaacucgcugguuacagcgggucaugggcagaucgacaauuuuuccuuaggagugcucggcauggcccuguuccuugaagagaugcugcgcacccgaguagguacuaagcacgcuauuuugcucgucgcagugucuuuugugacacugauaaccggcaacaugagcuuccgggaucuagggcgugucaugguuauggugggagccacgaugacugacgauaucggcauggggguaaccuaccuggcucuccuggccgcauuuaaagugagacccacauucgcggccggacuuuugcugaggaaguuaaccucaaaagagcucaugaugacuacaauuggcaucguccugcuuagucaguccaccauuccugaaacaauccuggagcuaacugacgcucucgcccuggguaugaugguguugaagaugguucgcaagauggaaaaauaucaacuggcagugaccauaauggcuaucuuauguguccccaaugccgugauucuccagaacgcauggaagguuucuugcacgauccuggccguggucagcguauccccacuuuuucugacaucaagccagcagaaagcugauuggauuccuuuggcgcucaccaucaaggggcugaaucccacugccauauuccuaaccacacugagucggacuaacaaaaagagaucuuggccacuuaaugaggcaauuauggcugugggaaugguuuccauccucgccagcucgcuguugaaaaacgacaucccgaugaccggcccucugguggccggcggguuacucacggucuguuacgugcugacaggaaggucagcugaccuugaacuggagcgagcagccgauguaaagugggaggaccaagcggaaauuucugguaguucccccauauugagcaucaccauuucugaggauggcagcauguccaucaagaaugaagaggaggaacagacucucacaauucugauccgcaccgggcuacuggugauaucaggacuuuuuccagucaguauccccauuacugcugccgcaugguaucucugggagguuaaaaagcagcgggccggcgugcugugggacgugccuagcccacccccugucgguaaagcugaauuggaggauggggcauacagaaucaagcagaaaggaauuuuaggcuauucucaaaucggcgccgggguguacaaggaaggaacauuccacaccauguggcauguuacgaggggugcgguacugaugcacaagggcaaacguauagagccguccugggcugacgugaagaaagaucucauuucauacgggggaggcuggaagcuggagggugaauggaaagagggggaagagguccaggugcuugcccuggaaccaggaaagaacccccgcgcaguucagacuaagccuggcuuguuuaaaaccaaugccggcacaaucggggcugugagucuagacuucagcccaggaaccuccgguucucccaucauugauaagaaaggcaaggucguggggcuguauggaaacggcguagucacacggucgggugccuacgugagcgcaaucgcucagacugagaaaucaauagaggacaauccugaaauugaggaugacaucuucagaaagaggaagcucaccauuauggaucugcauccgggggccggaaaaacgaagcgauaucuucccgcgaucguucgggaagccauaaaacgcggcuuaagaacacugauucucgcaccaacuaggguggucgcugccgagauggaagaggcuuugcggggccugccuauccgauaccaaacccccgcaaucagagccgagcacacagggcgcgaaauuguggaccucaugugccaugccaccuuuacuaugaggcugcuuuccccaguucgugugccuaacuauaaccugaucauuauggacgaggcucacuucaccgaucccgcgaguauagcagcccggggauacaucucuacaagagucgaaaugggugaggcugccggcauuuuuaugacggcaacuccaccggggagcagggacccuuucccccaguccaaugccccaaucauggaugaggaacgcgagauccccgaacgaucauggucuagcggacacgagugggugaccgacuuuaagggcaaaacaguaugguucgugccuaguauuaaggcugguaacgauauagcggccuguuugagaaagaaugggaaaaagguuauccagcuaucccggaaaaccuuugacagcgaauaugucaagacuaggacaaacgauugggacuucguggugaccacggauauuucugagaugggagcaaauuuuaaagcugagcgcgucaucgacccacguagaugcaugaagcccguaauucugacugauggcgaagagcgggugacacucgccggcccuaugccgguuacccauucauccgcagcccaaaggcgcgggcgaaucggaagaaacccaaaaaaugaaaacgaccaguacauauacaugggugagcccuuagaaaaugacgaggauugugcucacuggaaggaggccaagaugcugcuugacaacaucaauaccccugaaggcauuauccccaguauguucgagccagaacgggagaaaguggaugcgauugacggggaauauaggcugcgcggagaggcaagaaagacuuuugucgaucucaugaggcggggcgacuugccuguguggcuggccuaccguguugcugccgaggguaucaacuaugcugaucgccgauggugcuucgacgggauaaaaaauaaccagauucucgaagagaauguggaagucgagaucuggacaaaggagggcgaaagaaaaaagcugaagcccagguggcuugaugcacggauuuacagcgacccacuagcccugaaagaguucaaggaauuugcugccggacgcaaaucguugaccuuaaaccugaucacagagaugggcagacucccuacuuucaugacgcagaaggcaagggaugcgcuggacaaccuugccgugcugcauaccgcugaagccgggggacgggcauauaaucacgcucucucugaguugccggagacacuggaaacucuacugcuccuuacccuguuagccacaguaaccgguggcauauuuuuguuccugauguccgggcgaggaaucggcaaaaugacucucgguauguguugcauuaucacggcaagcauucugcuuugguacgcccaaauccagccccacuggauagcugcgucaauuauccuggaguuuuuccucaucguguugcugauuccagaaccugagaagcagagaaccccccaggauaaccaauuaacauauguugucaucgccauacuaacugugguggcagcuaccauggccaaugaaaugggguuucuggagaagacaaaaaaggaccucggccuuggaaguauuaccacucagcagccagagucuaacauccuggacauugauuugcgcccugccuccgcauggacacuguacgcugucgccacgaccuucguuacucccaugcucaggcauagcaucgaaaauucaagugugaacguaagccugacagcgauagcuaaucaggccaccgugcuuaugggccucgggaaaggauggccgcuguccaagauggacaucggugucccauugcuggcaauuggcugcuacucucaagugaacccuaucaccuuaacagccgcucuauuucugcucguugcacacuaugccauuaucgggcccggacuucaggcgaaagcuacucgggaggcccagaagcgugcagccgcuggcauuaugaagaauccaacgguggaugguaucaccgucauagaccuggaucccauuccuuacgacccgaaauucgaaaagcaguuggggcaaguaaugcugcucgugcuguguguuacacaggugcuuaugaugagaacuaccugggccuuaugcgaggcacugacacucgcuaccggccccaucagcacuuugugggaaggaaacccaggcagguuuuggaauacgacaaucgccgucuccauggcgaacauuuuccgcgggucauaucuggccggagcaggccuacuguuuucuauaaugaaaaauaccacuaacacccggcgagguacagggaauaucggagagacucucggcgagaaguggaaaaguagacuuaacgcucuggguaagucggaauuccagauuuacaaaaagagcggcauccaagagguggauaggaccuuggccaaggaagggauuaaacgcggagagacagaccaucacgcagucucccggggcucugcuaagcugagaugguucguggagcguaaucucguuacgccugaagggaaagugguagaucugggauguggcagggguggguggucauauuacugcggaggcuuaaagaacgugcgggaggucaaaggucuuaccaagggcgggcccggacaugaagagccuaucccaaugagcacuuauggcuggaaccugguucgccuccaguccgggguggacgucuuuuucacacccccugaaaagugugauacccuacugugcgacauaggagagaguucuccaaaucccacuguggaggccggccgaacauugagaguacugaaccucguggaaaauuggcuuaacaauaacacccaguuuuguaucaaaguucugaauccguacaugccuagcgugauugagaagauggaagccuugcagaggaaauacgguggggcgcugguccggaacccacucucacgcaauuccacgcacgagauguauugggugaguaacgcuagcggaaauaucgucucuuccgugaacaugauuucaagaauguuaaucaauagguucaccaugcgacacaagaaagcaacauacgaacccgauguugaccugggcagcggcacucggaacauagggauugagucggagaucccuaaucuugacaucauuggaaagcguauagaaaagaucaaacaagagcaugaaaccucuuggcacuaugaucaggaccauccauacaagacaugggccuaucacgguaguuacgagacuaaacagaccggcuccgcuagcucaaugguaaacgggguggucagacugcuaacaaagcccugggaugugguuccgauggugacccagauggccaugacugacacgacaccuuuuggacaacagcgcgucuucaaagaaaagguggauaccaggacucaggagcccaaggagggcaccaaaaagcucaugaaaauuacagcagaauggcuguggaaggaguuggguaaaaagaaaacgccacggaugugcaccagagaagaguuuacucgcaagguaagguccaacgccgcucugggggcgaucuucacagacgagaauaaguggaaaucugcccgagaagcaguggaggauagccgguuuugggaacucguugacaaggagagaaaccuucaccuggaaggaaaaugugagaccugcgucuauaauaugaugggcaagagggagaaaaaguuaggcgaauucgggaaggcuaaaggaagucgcgccauuugguacauguggcugggugcacguuuuuuggaguucgaagcccucggcuuucugaacgaggaucauugguucucccgggaaaauagccuaucugggguggagggagagggccuucacaagcuggguuacauccucagagacgugucaaaaaaggaagggggagcuauguaugccgaugacacugcgggcugggacacaaggauaacccuggaggauuugaaaaacgaagagauggucacaaaucauauggaaggcgagcacaagaagcuggcagaggccaucuucaaacucacuuaccagaacaagguugugcgcguacaacgaccuaccccccgggggacggugauggacauuaucaguagaagggaucagcgcggauccggucaggucggcaccuaugggcuuaauacauuuacuaacauggaagcucaacugauuagacagauggagggagaaggcguguucaaaagcauccagcauuuaaccguuacagaggagauugccgugcagaauuggcuggcacgggucgguagggaacguuugucucgaauggcuauaucgggggacgauugugugguaaagccacucgacgaucgcuuugccucagcucugacugcccuaaacgacaugggaaaaguuagaaaggauauccaacagugggagcccagccggggcuggaaugacuggacccaggugccuuucugcucccaccacuuucaugaacuuauuaugaaggauggcaggguccugguggugccaugccgcaaccaggacgagcucaucgggagagcacggaucagucaaggagcggguuggucucugagggaaacggccuguuugggcaaaagcuacgcucagaugugguccuuaauguauuuccaccgacgugaucugagacucgccgcaaaugcuauuugcucagccgucccgagucauuggguucccacaucucgcaccacuuggagcauacacgcaaagcacgaguggaugacaaccgaggacaugcuuacuguguggaaccggguauggauccaggaaaacccuuggauggaggacaaaaccccaguggaauccugggaggaaauucccuaccuggggaagagggaggaucagugguguggaucacuaaucggccugacaagcagagucacgugggguaaaaauauucaaaccgccaucaaccaggugcgcucucucauagggaaugaggaauauacugacuacaugccuuccaugaagcgguuuaggcgagaggaagaggaagcgggaguuuugugguga

SEQ ID NO: 14901 - RNA, 9876 nt, Artificial Sequence
  derived and/or modified CDS sequence (opt3) from DENV-2__FM210215__SS-prME
agcgcaggcaugaucgugaugcugauuccaaccgucauggcuuuccaccucacuacuagaaacggggagccucauaugauaguuggaauccaggaaaaggguaaaucccuucuguuuaagacggaggacggcgugaauaugugcaccuugauggcaauggauuuaggggaacugugugaggacacaauuacuuacaaaugcccacugcucaggcaaaacgaaccggaggauaucgacuguuggugcaauucuaccucaacauggguaaccuauggaacuuguacaaccacgggcgagcaccggcgcgaaaagcgaaguguggcccuggucccccauguggguauggggcuugagacucguaccgaaacauggaugagcuccgagggagcguggaaacacgcucagagaauugagacuuggauccugaggcauccuggcuucaccauaauggccgcaaucuuggccuacacaauuggcaccacgcacuuucagcggguucucaucuucauucugcugacugcuguggcaccaucuaugacaaugcgcugcaucgggauaucgaacagagauuuugucgaaggagugucagguggcagcuggguagacauuguucucgagcacgggaguugugugaccacuauggccaagaauaagcccacauuagauuucgaacugaucaaaaccgaggcuaagcagccugccacgcuuaggaaauauugcauugaagcgaaguugaccaacacaacuaccgagucccgguguccaacacaaggagagcccucucugaaagaagaacaagacaagcgcuuugucugcaagcauagcaugguggaucgaggcugggguaauggguguggacuauucggcaaaggcgggaucgugacuugcgcaauguuuaccugcaagaaaaacauggaaggaaagaucguccagccugagaaucucgaauacacaauuguugugaccccacacuccggugaggagcaugccguaggcaacgacacugggaaacacggaaaggaaauaaaagugacgccgcagucaaguaucacagaggcugaacugaccggcuaugguacugucaccauggaguguagccccagaacagggcuugauuucaaugaaauggugcuguugcaaauggagaacaaggccuggcucguucacaggcagugguuucuggacuuaccucugccauggcuccccggcgcagauaagcaggagucuaauuggauucagaaagaaacccuugugacuuucaagaacccucaugcuaaaaagcaagacgucgugguacugggaucccaggagggcgccaugcacacagcguugacgggggccaccgaaauccagaugucaagcggaaaucuacuguuuacuggucaucucaaaugccggcugcguauggacaaacuucaacugaagggcaugaguuacucuauguguacagggaaauucaagguugugaaagagauagcagagacccagcacggaacaauugucauccgcgugcaguaugaaggcgaugguuccccaugcaagauccccuucgagauuauggacuuggagaagagguacguccucgggaggcugaucacugugaacccgauuguuaccgagaaggauagcccugugaacauagaagcugagcccccauuuggcgacucguacaucauuaucggaguagagccuggccaguuaaagcugaauugguucaaaaaggggucuuccaucggacaaauguuugaaacgaccaugcggggugccaaacgaauggcuauucuaggcgauacagccugggacuucgggucacucggaggcgucuuuacaaguauagguaaggcacugcaucagguguucggggccaucuauggcgcugcguuuagcggaguuuccuggaccaugaaaauucuuaucggcgugauuaucacauggauagggaugaacucucgcagcacuucauugagugucucccuggugcucguaggaaucgugacccuguaccuuggcguuaugguccaggcagauagcgguuguguggugucuuggaagaauaaggagcugaaaugcgggucaggaauuuucaucacggacaacguccacacauggaccgaacaguauaaguuucaacccgagaguccaagcaaauuggccuccgcuauucagaaggcccaggaagagggcaucugugguauaagaucuguuacuaggcucgagaaucugauguggaaacagauuacacccgaauuaaaccacauccuggcagagaaugaagugaagcuaaccauuaugacuggcgauaucaaagggauaaugcaagccggaaagcggucgcuccgcccucagccaaccgagcugaaguacagcuggaaaacauggggcaaggcuaaaaugcuuuccacggaaucauauaaccagaccuucuugaucgacgggccggagacugccgagugccccaauacaaacagagcauggaauagucuggaaguggaggauuacggauuuggcguauucaccacaaacauuuggcucaagcugaaagaaaagcaggacgcguuuugugacucuaaguuaaugagcgcugccaucaaagauaauagggcaguccaugccgacauggguuauuggauugaguccgcucugaacgauacuuggaagaucgagaaagccucauucauagaagugaagaauugccacuggccuaaaagccauacccuuuggucuaacgggguuuuggaguccgaaaugauuaucccaaagaaccucgcaggacccgugagucaacacaauuaccguccuggcuaccacacgcagaucgcugguccauggcaucugggcaagcuagagauggacuucgauuuuugugacgggacaaccgucauugugacugaagauugcggaaaccggggccccagccugcgaaccacaacugccucugggaaacucaucaccgaguggugcuguagauccugcacacugccgccucuuagguaucgcggagaggacggcuguugguacgguauggaaauucggccauugaaggagaaagaagagaaucugguuaacucauuagugacggcggggcacggacagguagauaauuucagucucggcguccuggguauggcccuuuuucuggaagagauguugagaaccagggugggcacuaagcaugcuauacuccugguggcagucagcuucguuacacuaaucaccgggaacaugucguuuaaagaccugggacgcgugguagugauggucggcgccacuauggcugaugacauugggaugggagugacauaucucgcccugcuugcagcguucaagguucgacccaccuuugccgcuggcuugcuguuacggaagcucacguccaaagagcugaugaugacuaccaucgguauugugcuucugucucaaagcacaaucccugaaaccguccuagagcucacugaugcccuggcauuggggaugauggugcugaagauaguucguaauauggaaaaauaccaguuagcugugacaaucauggccauucucugcguccccaacgcaguagugcugcagaaugccuggaagguuucauguaccauccuugcuguggucaguguguccccacuguugcucacaucuagccagcagaagacugacuggauuccucuggcgcuaaccaucaagggacugaaccccacggccauauuccuuacaacccucuccagaacuaauaaaaagaggucauggccacugaacgaggcaauuauggcuguaggcauggugagcaucuuggccaguucucuguuaaagaaugacaucccgaugaccggcccucucgucgccgggggacugcuuacaguuugcuaugugcugacuggucgcuccgcugauuuggaacucgagaaagcaaccgacgugaagugggaggaucaggccgaaauuagcggcucgucacccauacugucuaucacgauuagugaggacggguccaugagcaucaaaaacgaagaggaggaacagacacuaaccauucugauccggacuggacuucucgucauaucuggccuguuuccaaucagcauucccaucacagcggcugccugguacuugugggaggugaagaaacagagagccgguguuuuaugggauguaccuuccccacccccuauggggaaggccgaacuggaggacggagcuuauaggauuaagcaaaaaggcauccucggcuacucacagauaggggcaggaguguacaaggaagguaccuuccacacuauguggcaugucacacgaggcgccgugcugaugcacaaagggaagcgcauugagccgaguugggcggauguuaaaaaggaccuuaucagcuauggaggcgguuggaagcuggagggggaauggaaagagggagaagaggugcaggucuuggcucuagaaccaggcaagaauccccgggccgugcagaccaaaccuggccuguuuaagacgaacacugggaccaucggagcaguaucucucgauuucuccccagguacaucaggcagucccauuaucgacaaaaaggggaaggucgugggacuguacggcaacgguguugugaccagaagcggggccuaugucuccgcuauagcccaaacagagaaaucuauugaggauaauccugaaaucgaggacgauauuuuuaggaagcgucgccuuacuaucauggacuuacacccgggagcaggcaaaaccaagcgguaccugcccgcuauagugagagaagccauuaaaaggggccuccgaacguugauccuggcgccaacacggguuguggccgcagagauggaagaggcucuccgcgggcugccuaucagauaucagacucccgccauuaaggcugagcauaccggaagggaaaucgucgaccuuaugugucacgcaacauucaccaugcggcuguugucgccagugcgaguaccuaacuacaaucuaauuauaauggaugaggcccauuucacugaccccgccagcaucgcugcgagagguuauauuucaacccgcguggaaaugggcgaggcagccgggaucuuuaugacagcuacgccaccgggauccagggauccuuucccccagaguaacgccccaaucauugacgaggaacgugagauacccgaacggucuuggaauagcggccacgaguggguuacugauuuuaaggguaaaaccgucugguucgugccuuccaucaaggcagggaacgacauugccgcuugccugaggaaaaauggaaagaaagugauccaacucucaaggaagacauuugauucugaauacgucaaaacccgcacuaacgacugggauuucguagugacaaccgacauuagcgagaugggcgcgaauuuuaaggccgagcgaguuaucgauccaagacgguguaugaagcccgugauauuaacggacggcgaagagagggucauccuggcagggccuaugccggugacucauaguuccgcugcccagcgccguggaagaauuggucggaaccccaaaaaugaaaacgaccaguacaucuauaugggcgagccccuugaaaaugaugaggacugcgcacacuggaaggaggccaaaaugcugcucgauaacauuaauacaccugaagggaucauacccagcauguucgagccagaaagggagaagguugacgcuauugauggagaauaccgcuugcgaggcgaggccagaaaaaccuuuguggaccugaugcggaggggugaucucccugucuggcuggcguauaagguggcagccgaggggaucaacuacgcugaccgcagaugguguuucgauggcauuaagaacaaucagauccuugaagagaacguagaaguggagauauggaccaaagagggagaaaggaagaaacuaaagccccgguggcuggacgcccguaucuauucugauccauuggcuuuaaaagaguuuaaggaguucgcagccggccgcaagucacugacucucaaucugauuacagagauggggcgacuuccuaccuucaugacacagaaaacuagagacgcucuggauaaccucgccguuuugcacacggcagaagcgggagguagggccuacaaucaugcucuguccgagcuaccggagacccuggaaacacuccuucuguuaacuuugcuggccaccgucacaggcgggaucuuucucuuccugaugaguggacggggcauugguaagaugacccuugggaugugcugcaucauaacugcaagcauucugcucugguaugcucagauccagccccacuggaucgccgcaucgauuaucuuggaguuuuuccugauaguguuacuaauuccagaaccugagaaacagcgcacgccccaagacaaccagcugaccuacguggucaucgccauucucacaguuguggcugcgacuauggccaaugaaaugggcuuucuugagaagaccaaaaaggaccugggauugggcucuaucgcaacacagcagccagaguccaacauacuggauaucgaccucagaccugcuagcgccuggacccuguacgccguagcaacuacauucgugacgcccaugcuuaggcauucaauugaaaauaguucugucaacgugucccucaccgcuaucgccaaucaagcgacuguucugaugggguugggaaaggguuggccgcugagcaaaauggauauuggcgugccauuacuagcuaucggguguuauucacaggucaacccuauuacacugaccgccgcacuccuucuguugguagcccacuacgcuaucauaggacccggccugcaggcaaaggccacccgggaggcgcagaaacgagcugccgcagguauuaugaagaauccaacaguggacgggaucacuguuaucgaucucgaccccauuccuuaugauccgaaauuugaaaagcaacugggccaggugaugcuuuuaauacugugcgucacgcaagugcucaugaugagaaccacaugggccuugugugaggcucugacucuagccaccggacccaucaguacacugugggaaggcaacccagggcgcuucuggaauaccacuauugcagucagcauggcuaacaucuuuaggggauccuaccucgccggcgcgggucuucuguucucuauuaugaaaaauacgacaaacacccggcgugggacuggaaacaucggcgagaccuugggugagaaguggaaaagcagacuaaauucccucggcaaaucagaauuucaaauauauaagaaaucugggauccaggagguggacaggacacuggccaaggaaggaauuaaacgcggcgagacugaucaccaugcaguuagucgggggucggcuaaguuacgaugguucguggagagaaacaugguaaccccugaaggaaagguggucgaccuuggcugcgguagaggcggguggagcuacuauugugggggucugaaauccguucgcgaggugaagggccucacaaaagggggacccggccacgaagaaccuaucccaaugucuacguacggguggaaucuaguccggcugcagucaggaguggauguauuuuucauucccccugaaaagugcgacaccuugcugugugauaucggcgagagcuccccaaaccccacuguggaggccgguagaacacuccguguucuuaaucugguggaaaacugguugaauaacaauacccaguucugcauaaaaguccugaacccguacaugccuagugugauugagaagauggaagcacuccaaaggaaguaugggggagcuuuaguccggaauccacugucucgcaacagcacucaugagauguacugggugucaaaugccuccggcaacaucguuaguagcguaaauaugaucucucgaaugcuuauuaacagauuuacaaugaggcacaaaaaggccaccuaugaacccgacguggaccugggcuccgggacgcggaacauaggaaucgagucagagauuccuaaucuagauaucauugguaaacgcaucgaaaagauaaaacaggagcaugaaaccagcuggcacuacgaccaggaucacccauauaagacaugggcguaccauggcucguaugagacuaagcagaccgggucugcuaguuccauggucaacggagugguuagacuccugacaaaacccugggacguguugccgacugucacccaaauggcaaugacagauaccacuccuuucggccagcagaggguguuuaaggaaaaaguagacacgcgaacacaggagcccaaggaggguaccaaaaagcugaugaaaaucacugccgaauggcucuggaaggagcuugggaagaaaaagaccccacggauguguacacgugaagaguucacgagaaaagugcgcagcaaugcugcccugggagcaauuuuuaccgaugagaacaaguggaaaucagccagggaagcuguugaggacucccgguucugggaauuagucgauaaggagagaaaucugcacuuggaaggcaagugcgagacuuguguguacaacaugaugggcaaacgcgagaagaaacucggggaauuuggaaaggcgaaagguucuagggccaucugguacauguggcugggcgcacgauuccuagaguuugaagcucuuggguuccugaaugaggaccauugguuuagccgggaaaacagucucuccggaguggagggcgagggucugcacaaguugggguauauucugagagaugucagcaagaaagaaggaggcgccauguacgcagacgacacagccggcugggauaccaggaucacucucgaggaccuuaagaaugaagagaugguuacaaaccacauggaaggggagcauaaaaagcuggcugaggccauuuucaaauuaaccuaucaaaauaaggugguacgcgugcagcguccuacaccccggggaacugucauggauauaaucucuagaagggaccagcgcgguucaggccaaguggggaccuacggacugaacacguuuaccaauauggaagcgcaguugauucgacagauggagggcgaagguguuuucaagaacauccagcaccucacagugacugaggaggucgcagugcaaaauuggcuggcccggguagggagagaaaggcuaagucgcauggcuaucuccggagaugacugcguugugaaaccacuugaugacagauucgccaacgcacugaccgcucucaacgauaugggcaagauucggaaagacauacagcagugggagcccagcaagggcuggaaugauuggacacaggucccuuuuugcucucaucacuuccaugaacugaucaugaaagacgggaggguguugguggucccaugucguaaccaagaugaguuaauuggacgagcccgcaucucgcagggugcuggcuggucacugagagaaacugccugccucggaaagagcuaugcacagauguggucccuuauguacuuucaccggagggaccugcgccuagcggccaaugcuauuuguagugccguuccgucucacugggugcccaccagcagaacgacaugguccauccaugcaaagcacgaguggaugaccacugaggacaugcugacaguauggaaccggguguggauaagggaaaauccuuggauggaggauaaaaccccagucgaaucaugggaggaaauccccuaucucggaaagcgagaggaccaguggugcggcaguuugauuggucugacuucucgugcuaccugggccaaaaacauccaagcagccauuaaucaggugagaagccuuaucgggaacgaggaauacacagauuacaugccuuccaugaagcgcuuccggagggaggaagaggaagcgggaguucugugguga

SEQ ID NO: 14902 - RNA, 9876 nt, Artificial Sequence
  derived and/or modified CDS sequence (opt3) from DENV-2__FM210216__SS-prME
agcgccggcaugauaauuaugcugauacccaccgugauggcuuuccaccucaccacuagaaacggggagccucauaugaucgucgguauucaagaaaagggaaaaucccuucuguuuaagacggaggacggcguuaauaugugcaccuugauggcaauggauuuaggggaacugugugaggacacaaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacuacagagugccccaauaccaacagagccuggaauagucuggaaguggaggauuacggauuuggcguguucacaacuaacaucuggcucaagcugaaagaaaagcaggacgcauuuugugacucuaaguuaaugagcgcggcuauuaaagauaauagggccguacaugcagacauggguuauuggaucgaguccgcccugaacgauaccuggaagauagagaaggcuucauucauugaagucaagaauugccacuggccuaaaagccauacgcuuuggucuaacgggguguuggaguccgaaaugaucaucccaaagaaccucgccggacccguuagucaacacaauuaccguccuggcuaccacacacagauugcagguccauggcaucugggcaagcuagagauggacuucgauuuuugugacgggaccacugugaucgucaccgaagauugcggaaaccggggccccagccugcgaacaacuaccgcuucugggaaacucauuacagaguggugcuguagauccugcacgcugccgccucuuagguaucgcggagaggacggcuguugguacgguauggaaauacggccauugaaggagaaagaagagaaucuggugaacucauuaguuaccgccgggcacggacagguggauaauuucagucucggcguacuggguauggcgcuuuuucuggaagagauguugagaacuagggucggcacaaagcaugccauccuccugguggcugugagcuucgucacccuaauuacugggaacaugucguuuaaagaccugggacgcguugugguaauggugggcgcaacaauggccgaugacaucgggaugggagucaccuaucucgcucugcuugccgcauucaaggugcgacccacguuugcggccggcuugcuguuacggaagcucacuuccaaagagcugaugaugaccacaauugguaucguucuucugucucaaagcaccauaccugaaacugugcuagagcucacagaugcucuggccuuggggaugaugguccugaagaucgugcguaauauggaaaaauaccaguuagcaguuaccauuauggcuauccucugcgugcccaacgccgucauucugcagaaugcauggaagguaucauguacaauccuugccgugguuaguguguccccacuguugcucacuucuagccagcagaaaaccgacuggauaccucuggcucuaacgauuaagggacugaaccccacagcgaucuuccuuaccacucucuccagaaccaauaaaaagaggucauggccacugaacgaggccaucauggcagucggcauggugagcauuuuggcuaguucucuguuaaagaaugacauaccgaugacaggcccucucguagccgggggacugcuuacugugugcuauguccugaccggucgcuccgccgauuuggaacucgagcgggcuacggacguuaaaugggaggaucaggcagaaaucagcggcucgucacccauucugucuaucacaauuagugaggacggguccaugagcaucaagaacgaagaggaggaacagacccuaacuauacugaucagaacaggacuucucgugauuucuggccuguuuccaaucagcauucccaucaccgccgcggcuugguacuugugggaggugaaaaagcagagggccggugucuuaugggaugugccuuccccacccccuauggggaaagcagaacuggaggacggagccuaucgaauaaagcaaaagggcauucucggcuacucacagaucggggcuggaguuuacaaagaagguacuuuccacacaauguggcauguaacccgcggcgcagugcugaugcacaaggggaaacggaucgagccgaguugggccgaugucaagaaagaccuuauuagcuauggaggcgguuggaagcuggagggggaauggaaggagggagaagaggugcagguuuuggcgcuagaaccaggcaaaaaucccagagcugugcagacgaagccuggccuguuuaaaacuaacaccgggacaaucggagccgucucucucgauuucuccccagguaccucaggcagucccauaauugacaagaaagggaaggugguaggacuguacggcaacggugucgugacaaggagcggggcauauguuuccgccaucgcucaaacugagaagucuauugaggauaauccugaaaucgaggacgauauauuucguaaacgccggcuuaccauuauggacuuacacccgggagccggcaagacgaaaagauaccugcccgcaaucgugagggaagcuaucaagcgaggccuccggacauugauucuggccccaacucgcgucguggcggccgagauggaagaggcacucagagggcugccuaucagguaucagacccccgcuauucgggccgagcauacaggacgagaaauaguugaccuuaugugucacgcuaccuucacuaugagacuguugucgccagugcgcgucccuaacuacaaucuaaucauuauggaugaggcacauuucaccgaccccgccagcaucgccgcuagggguuauaucucaacacguguggaaaugggcgaggcggcagggauuuuuaugacggccacuccaccgggaucccgggauccuuucccccagaguaacgcuccaauaaucgacgaggaaagagagauucccgaaaggucuuggaauagcggccacgaguggguaaccgauuuuaaagguaagacagugugguucguuccuuccaucaaggccgggaacgacauugcagccugccugcgcaaaaauggaaagaaagucauccaacucucacgaaagaccuuugauucugaauacgugaaaacuagaacaaacgacugggauuucguggucaccacggacauaagcgagaugggcgcuaauuuuaaggcggagcggguaaucgauccaaggcgcuguaugaaacccgugauuuuaacugacggcgaagaacguguuauccuggccgggccuaugccggugacacauaguuccgcagcucagagacggggaaggauuggucgcaacccaaagaaugaaaacgaccaguacaucuauaugggcgagccccuugaaaaugaugaggacugcgcccacuggaaggaggcaaaaaugcugcucgauaacauaaauaccccugaagggauuauccccagcauguucgagccagaacgagagaaggucgacgccauugauggagaauacagauugcggggcgaggcuaggaaaaccuuuguggaccugaugcgcagaggugaucucccuguuuggcuggccuauaagguggcggcagaggggaucaacuacgccgacaggcggugguguuucgauggcaucaaaaacaaucagauccuugaagagaacgucgaaguggagauuuggacuaaggagggagaacguaagaaacuaaagccccgcuggcuggacgcucgaaucuauucugauccauuggccuuaaaagaguuuaaggaguucgcugcaggcagaaaaucacugacacucaaucugauuaccgagauggggaggcuuccuacauucaugacucaaaagacgcgggacgcccuggauaaccucgcuguauugcacaccgccgaagcaggaggucgcgcguacaaucaugcccuguccgagcuaccggagacacuggaaacucuccuucuguuaaccuugcuggcuacagugaccggcgggaucuuucucuuccugaugaguggaagaggcauagguaagaugacucuugggaugugcugcauuaucacggccagcauccugcucugguaugcacagauucagccccacuggaucgcugccucgauaauuuuggaguuuuuccugaucguuuuacuaauuccagaaccugagaaacagaggacaccccaagacaaccagcugacauacgucgugaucgcaauacucacuguggucgccgcuaccauggcgaaugaaaugggcuuucuugagaagacuaagaaagaccugggauugggcucuaucgccacccagcagccagaguccaacauucuggauaucgaccuccggccugcaagcgcuuggacucuguacgccguugccacaacguucgugacccccaugcuucgacauucaauugaaaauaguucuguaaacgugucccucacugcaaucgcuaaucaagccacaguccugaugggguugggaaaagguuggccgcugagcaaaauggauauuggcgugccauuacuagcgaucggguguuauucacagguuaacccuauaacccugaccgcugcccuccuucuguugguggcacacuacgccauuaucggacccggccugcaggcuaaggcaacaagagaggcccagaaacgcgcggcugccgguaucaugaagaauccaacugucgacgggauuacgguaauagaucucgaccccaucccuuaugauccgaaauuugaaaagcaacugggccaggugaugcuuuuaauucugugcguuacccaggugcucaugaugaggacaacuugggcauugugugaggcccugacccuagcuacaggacccaucaguacccugugggaaggcaacccagggcgguucuggaauacuacgauugccgucagcauggcaaacaucuuucguggauccuaccucgcuggcgccggucuucuguucucuauaaugaaaaauacaaccaacacuagaagggggaccggaaacaucggcgagacauugggugagaaguggaaaagccgccugaaugcgcucggcaaguccgaauuucaaauuuauaagaaaucagggauccaggagguggaccggacucuggccaaggaaggaauuaaacgaggcgagaccgaucaccaugcagucucuagagggagugcuaaguuaaggugguucguggagcgcaacaugguuacaccugaaggaaaagugguagaccuuggcugcgguagagggggauggucguacuauuguggcggucugaagaaugugagagaggucaagggccucacgaaagggggacccggccacgaggaaccuaucccaaugagcaccuacggguggaaccuaguucgucugcaguccggaguggaugucuuuuucauacccccugaaaagugcgacacuuugcugugugauauuggcgagucuucaccaaaucccacaguggaggccgguaggacccuccggguacuuaaccugguggaaaauugguugaacaauaacacucaguucugcaucaaaguucugaauccguacaugccuagcgugaucgagaagauggaagcacuccaacgcaaauaugggggagcuuuaguccgaaacccacuguccagaaauaguacacaugagauguacugggugucuaacgccagcggcaauauugucucauccgugaacaugauaaguaggaugcuuaucaaccgguuuaccaugcgccacaagaaggccacguaugaacccgacguugaccugggcagcgggaccagaaauauuggaaucgagucugagauuccuaaccuagauaucauagguaaaaggaucgaaaagauuaaacaggagcaugaaacauccuggcacuacgaccaggaucacccauauaagacuugggcguaccauggcucauaugagaccaaacagacagggagcgcuucgucuaugguaaauggagugguccgacuccugacuaagcccugggacguguugccgaccguuacacaaauggcaaugaccgauacuacgccuuucggccagcagcggguguuuaaggaaaaagucgacacacguacccaggagcccaaggaggguacuaaaaagcugaugaaaaucaccgccgaauggcucuggaaggagcuugggaaaaagaagacaccaagaauguguacgcgcgaagaguucaccaggaaagugcggaguaacgcugcccugggagcaauuuuuacugaugagaauaaguggaaauccgccagagaagcuguagaggacagccgcuucugggaauuaguggauaaggagaggaaccugcacuuggaaggcaaaugcgagacauguguuuacaauaugaugggcaagcgagagaagaaacucggggaauuuggaaaggcgaaagguucacgggccaucugguacauguggcugggcgcaagauuccuagaguuugaagcucuuggguuccugaacgaggaccauugguuuuccagggaaaauucucucagcggagucgagggcgagggucugcacaaguugggguauauucugcgcgaugugaguaaaaaggaaggaggcgccauguacgcagacgacaccgccggcugggauacucguauaacacucgaggaccuuaagaacgaagagauggugaccaaucacauggaaggggagcauaaaaagcuggcugaggccaucuucaaauuaacauaucaaaacaaggucguucgggugcagagaccuacucccaggggaaccguaauggauauuaucucccgccgagaccagcgggguagcggccaaguggggacguacggacugaauaccuuuacaaacauggaagcgcaguugaucagacagauggagggcgaaggugucuucaaaaauauucagcaccucacugugaccgaggagguugcagugcaaaacuggcuggccagggucgggcgcgaaagacuaucucggauggcuauaucaggagaugacugcgugguaaagccacuugaugacagguucgccaacgcacugacagcucucaaugauaugggcaagauccguaaagacauucagcagugggagcccaguaagggcuggaacgauuggacucagguuccuuuuugcucccaucacuuccaugaacugaucaugaaagacgggcgaguguuggucgugccaugucgcaaucaagaugaguuaauuggacgggcccggaucagccagggugcuggcuggucucugagggaaaccgccugccucgggaagucguaugcacagauguggucacuuauguacuuucaccgcagagaccugcggcuagcggccaacgcuauauguagcgccgugccgucccacuggguccccacgaguaggacaaccuggucuauccaugcaaaacacgaguggaugacuacagaggacaugcugaccguuuggaaucgaguguggauucgugaaaacccuuggauggaggauaagacuccaguagaaagcugggaggaaauccccuaucucggaaagagagaggaccaguggugcggcuccuugauuggucugaccucacgcgcuacaugggccaaaaauauccaagcagccauaaaccaggugcggagucuuauugggaaugaggaauacacggauuacaugccuucuaugaagagguucagacgcgaggaagaggaagcgggaguccugugguga

SEQ ID NO: 14903 - RNA, 9876 nt, Artificial Sequence
  derived and/or modified CDS sequence (opt3) from DENV-2__FM210217__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgaucaccgccgagagaagcguucaguagcgcuggugccccaugucgguauggggcuugaaaccagaacagagacuuggaugaguagcgaaggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggacuuuguggagggagucucggguggcucauggguggauauuguacucgaacacgggagcuguguuaccacuauggcgaagaauaagcccacauuagacuucgagcugaucaaaaccgaagcaaagcagccugccacgcuucggaaauauugcauugaggcuaaguugaccaacacaacuaccgaaagucgcuguccaacacaaggagagcccucccugaaugaggaacaggauaaacgauuugugugcaagcauucuauggucgacagaggcugggguaacggguguggacuauucggcaagggcgggaucgugacuugcgccauguuuaccugcaaaaagaauauggagggaaaaaucgugcagccugaaaaccucgaguacacaauugucauaaccccacacagcggugaagagcaugcaguuggcaaugauacugggaagcacggaaaagagaucaagauuacgccgcagucccccaucacagaagcugagcugaccggcuaugguacugugaccauggaauguucaccuaggacagggcuugacuucaacgagaugguacuguugcaaauggaagauaaagccuggcucgugcaccggcagugguuucuggacuuaccacugcccuggcucccuggcgcggacacccagggaaguaauuggauacagaaggagacucuugucacauucaagaacccacaugccaaaaagcaagaugugguugugcugggcagccaggagggggcaaugcacacggcuuugaccggagccacugaaauucagaugucuuccgguaaucuacuguuuacaggccaucucaaaugccgucugcgcauggacaagcuucaacugaaagggaugucauacagcauguguaccggaaaguucaagaucgucaaagagaucgcugaaacacagcacggcacuauugugaucagaguacaguaugagggugaugggagucccugcaagauuccguucgagauaauggacuuggaaaaaaggcauguucucggccggcugaucaccgugaacccuauugucacggagaaggauucucccgugaacaucgaagccgagccaccuuuuggagacuccuacaucauuauaggcgucgaacccgggcaguuaaaacugaauugguucaagaagggaagcucgaucggucaaauguuugagaccacaaugcgaggcgcaaaacgcauggccauucuaggggauacugcuugggacuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagauagugggugugugguauccuggaagaauaaagagcugaagugcggaagcggcaucuucauaacagacaacgugcacaccuggacugaacaguacaaguuucaaccagagucucccucaaaauuggccagugcuauucagaaggcccaugaagaggguaucuguggcauuaggagcguuacacggcucgaaaaucugauguggaaacagaucaccccugaguuaaaccacauacuguccgagaaugaagucaagcuaacuaucaugaccggggauauuaaaggaaucaugcaggcaggcaagcgcucucucagaccacaaccgacagagcugaaauauucguggaagacgugggggaaggcgaaaaugcuuagcaccgaaucccauaaccagacuuucuugauugacggacccgagacagcugaaugcccuaauaccaacagggccuggaauucacuggagguggaggacuacggcuuugguguguucacaacuaacaucuggcucaagcugcgugaaaaacaggaugucuuuugugacaguaaguuaaugucugcagccauaaaagauaaucgggcuguucacgccgacaugggguauuggauugagagcgcacugaacgauaccuggaagauggaaaaggcuuccuucaucgaggugaaaucaugccacuggccaaagagccauacgcuuuggucuaauggaguguuggaguccgaaaugaucauucccaaaaguuucgccggcccuguaagccagcacaacuaccgaccagguuauuacacacaaaccgcgggccccuggcaucucgggaagcuggagauggacuuugauuucugugaaggaacuaccgucgugguuacagaggacugcggcaacagagggccgucucuaaggacuaccacagccuccggaaaacugaucacggaauggugcugucgcucaugcacccucccuccacugcgguacagaggcgaggaugguuguugguaugggauggagauuaggccccuuaaggaaaaggaggaaaauuuggugaacagucuggucacugcuggacacggccagauagacaauuuuagcuuaggugugcucggcauggcacuguuccuugaggaaaugcugcgcacacgaguugggaccaaacaugccaucuugcucguggcuguaucguuugucacucugauuacaggaaacauguccuuccgggaucuaggccgugugauggugauggucggggccgcaaugaccgacgauaucggaauuggcguuacguaccuggcgcuccuggccgcuuuuaaggugagaccuacuuucgccgcaggucuuuugcugaggaaauuaaccucuaaggagcucaugauggcuacaaucgggauagcccugcuuagccagucaaccauccccgagacuauucuggaacuaacagacgcacucgcccugggaaugaugguauugaaaaucgugcgcaauauggagaaguaucaacuggcugucaccauuauggcgaucaguugcgugccaaacgccguuauauuacagaaugcauggaagguguccuguacaauucucgcuacugucucugugagcccucugcuucugaccuccucacagcagaaagccgacuggauccccuuggcccucacgaucaagggccugaacccaacagcuauuuuucuaaccacucugagccggaccaguaaaaagagaucuuggccgcuuaaugaagcaauaauggccguuggcaugguguccauccucgcgagcucgcuguugaaaaacgauauuccuaugacagggccccuggucgcuggagguuuacucacuguaugcuacgugcugaccggcaggucagccgaccuugagcuggaacgagcaacggauguuaagugggaggaccaagccgagaucucugggaguuccccaauuuugagcaucacaauagcugaagauggaucuaugagcaucaaaaaugaggaagaggagcagacccucacuauucugauccgcacaggccuacuggugauuuccggucuuuuccccgucucaaucccuauaaccgcagccgcgugguaucucugggaagugaagaagcagcgggcugggguacugugggacgugccaagucccccuccggucggaaaagccgaguuggaagauggcgcauacagaauuaagcagaaaggcaucuuaggguauagccaaaucggagccgguguuuacaaggagggcacuuuucacacaauguggcacgugaccaggggggcugugcugaugcaucguggaaaacgcauugaaccaucuugggccgacgucaagaaggaucucaucuccuacggcgguggguggaaacuggagggagaguggaaggaaggcgaggaagugcagguucuugcacuggagcccggcaaaaacccucgggcuguacagacgaagccaggguuguucaaaacuaauaccggaacaauaggugccgugucacuagacuuuagucccggcaccagcggguccccuauugucgauagaaagggaaaggugguuggccuguaugguaacgggguggucacaaggucuggagcguacgugucggccaucgcacagacugaaaaaagcauugaggacaauccggagaucgaagaugacauauuccgaaagaaacggcucaccauuauggaccugcaccccggcgcuggcaagacgaaacgcuaucuuccagccaucguaagagaggcuaucaagaggggguuacggacacugauucucgcaccuacucgagucguggccgccgaaauggaggaagcuuugagaggacugcccauccgcuaccaaaccccagcgauuagggcagagcauacaggucgugagauaguugaucucaugugucacgccaccuucacuaugcggcugcuuucaccugugagaguccccaacuauaaccugaucauuauggacgaagcucauuuuaccgauccagccuccaucgcagccaggggcuacaucaguacacgcguggagaugggggaagcugcgggaauuuucaugacggccacuccgccuggcucuaaggaccccuuuccacagagcaaugcacccauaauggaugaggagcgagaaaucccugagagauccuggaacucaggucacgaauggguuaccgacuucaaagggaagacagugugguuugucccaucuauuaaagcuggaaaugauaucgccgcaugcuugcggaagaacggcaaaaaggugauucagcuaagcaggaagaccuucgacagugaguauguaaaaacucgcacaaaugauugggacuuugugguuaccacggauaucuccgaaaugggcgccaacuucaaggcugagcgugucauagaccccagacgguguaugaaaccugugauccugacugacggggaggaaagggugauucucgccggaccgaugccagucacacacagcucugcggcacaacgccgagguagaaucggccggaaucccaagaacgagaaugaucaguacauuuacaugggggaaccuuuagagaacgacgaagauugcgcccauuggaaagaggcuaagaugcugcuugacaauaucaacacccccgagggaauaauuccaucaauguuugaaccugagagggaaaaaguagaugccaucgacggcgaguaucgccugagaggugaagcuaggaagaccuucguggaucucaugcggcguggggacuugcccguuuggcuggcauaccgcguggccgcugagggcauuaauuaugccgaucgaagaugguguuuugacggagucaagaacaaucagauccucgaggaaaacguggagguugaaauauggacuaaagagggcgagaggaagaaacugaagccacgguggcuugaugcacgcaucuacuccgacccucuagcgcugaaagaauucaaggaguucgccgcugggagaaagaguuugacauuaaaccugauuaccgaaaugggaaggcucccgacauuuaugacucagaaagcccgggaugcacuggacaaucuugcugugcugcacacggccgaggcagguggccgagccuauaaccaugcucucagcgaauugcccgagacccuggagacacuacugcuccuuacucuguuagcgaccgucacagggggaaucuucuuguuucugaugucgggcaaggguguggggaaaaugacccucggcaugugcugcauuaucacugccucuauacugcuuuggcacgcacaaauucagccacacuggaucgcugccuccaucauucuggaauucuuucucaucguauugcugauaccugagcccgaaaagcagagaacgccacaggacaaucaauuaaccuacgugguuauugccauccuaacagucguggcagcuacuauggccaacgagaugggauuccuggaaaaaaccaagaaggaucucggccuugggagcauugcgacacaggagccugagucaaauauccuggacauagauuugcgccccgcuagugccuggacccuguaugcaguggccacuacauuugucacgccgaugcucaggcauucuaucgaaaacuccagcguuaaugugucacugaccgcuauugcaaaccaggccacuguacuuaugggacucgguaaaggcuggccacugaguaagauggacaucggggugccuuugcuggcgauuggauguuacagccaggucaaucccaucacauuaaccgcugcccuacugcuccuuguggcacacuacgccauuaucggcccaggucugcaagcuaaagccacccgggaggcacagaagcgugcugccgcggggauaaugaaaaaccccacaguugauggcauuacugugaucgacuuggauccuaucccguaugaccccaaguucgaaaagcagcugggacaggucaugcuccugauucuuugcguaacgcaaguguuaaugaugagaaccacaugggcccugugugaggcacucacuuuggcuaccggcccaauauccacacugugggaagggaauccuggaagguuuuggaacaccacuaucgccguuucuauggcaaauauuuuccgcggcagcuaccuagcuggugccgggcugcucuuuuccaucaugaaaaacacgacaaauacccggcgaggaacuggcaacauuggugagacccuuggcgagaaguggaaaucaagacugaaugccuuggggaagucugaauuccagaucuauaaaaagaguggaauacaggagguggauaggacacuggcgaaagaaggcaucaagcgcggggagacugaccaucacgcugucucgcggggaagcgcaaagcucagaugguuuguggagcguaacauggucacccccgaaggcaaagugguugaucuggguugcgggaggggaggcugguccuacuauugugguggcuuaaagaacgugcgggagguaaaagggcuuacaaagggaggcccugggcaugaagagccaauucccaugucuacguacggauggaaucuggugcgccuccaaucaggcgucgacguuuucuucaccccuccagaaaaaugcgauacucuacugugugacaucggugagagcucccccaacccgacaauugaggccgggcgaaccuugagagugcugagucucgucgaaaauuggcuuaacaaugacacucaguuuugcaucaaggugcugaacccuuauaugccaucuguaauagagaagauggaaacauugcagaggaaauacggaggcgcucuggugcggaauccccucagccgcaacucaacccacgagauguacuggguuuccaaugccacgggcaacauugugaguagcgucaauaugaucucuagaauguuaaucaacagguucaccaugaagcacaaaaaggcaacauaugaaccugauguggaccugggguccggaacucgaaauauugguauagagucagagaucccaaaccuugauauuaucggcaaacggauugaaaagaucaagcaggagcaugaaaccagcuggcacuacgaccaagaucaucccuauaaaacaugggccuaccacgggucguaugagacuaagcagaccggaucugcuaguuccauggucaauggcgugguucgucugcuaacaaaaccgugggacguagugccuauggucacccagauggcgaugacugauacgacacccuuuggucagcaaagaguguucaaggaaaaaguugacacccgcacucaggagccaaaggaggggaccaagaaacucaugaagauaacagccgaauggcuguggaaagaguugggaaagaaaaagacgccuaggauguguacccgggaagaguuuacuagaaaagugcgcagcaacgcagcucugggcgccaucuucacagaugagaacaaguggaagucagcaagggaagccgucgaggacucccgauuuugggaacucguggauaaagagcggaaucuucaccuggaaggcaagugcgagaccuguguauacaacaugauggggaaaagagagaagaaauuaggagaauucgguaaggcuaagggcucuagggccauuugguauauguggcugggggcgcgcuuuuuggaguucgaagcacucggauuucugaaugaggaccauugguucagccgugaaaacagucuauccggcguggagggugaggggcuucacaaacugggauacauccuccgggacguuagcaagaaagaaggcggcgccauguacgcugaugacacugccgggugggauacaagaauuacccuggaggacuugaagaaugaagagauggucacaaaccauauggaaggagagcacaaaaagcuggcagaggcuaucuuuaagcucacuuaucagaauaaaguggugaggguccagcgccccaccccacgagguacgguuauggauauuauaucucggagagaccaaaggggcucagggcaggugggaaccuacggccuuaacacauucacuaauauggaagcccagcugauccgccaaauggagggugaagggauuuucaagaguauccagcauuuaaccgcuacagaggagaucgccguacagaacuggcuggcaagagugggacgggaaagguugucccguauggcgauuagcggcgaugacugcgucgugaaaccccucgaugaccgauuugccucugcucugacugcccuaaaugauaugggcaagguucgcaaagacauacagcaaugggagccuucgagaggguggaacgauuggacccaggugccauucugcucacaccacuuucaugaacuuaucaugaaggacggacggguccuggugguaccguguaggaaucaggacgagcucauuggucgcgcaagaaucagccagggcgcuggguggucccugaaggaaacggccugcuugggaaaaaguuaugcacaaauguggucuuuaauguacuuccaccggagggaucugcgacucgccgcgaacgcuauuuguagcgccguucccucccauugggugccuacaucacguaccacuuggaguauccacgcaaagcacgaguggaugacaaccgaggacaugcuuacugucuggaauagaguguggauacaggaaaacccauggauggaggauaaaacccccguggaaucuugggaggaagucccuuaucugggcaagcgcgaggaccaguggugcgguagccuaaucgggcugacaucccgggccacgugggcuaaaaacauucagaccgccaucaaucaaguuaggucacucauuggaaacgaggaauacacugauuauaugccaagcaugaagagauuucgccgggaggaagaggaagcaggcguguugugguga

SEQ ID NO: 14904 - RNA, 9876 nt, Artificial Sequence
  derived and/or modified CDS sequence (opt3) from DENV-2__JX286524__SS-prME
accgcaggcgugaucguaaugcugauucccaccgcuauggcauuccaccucacuacgaggaacggggagccucauaugauaguuggaaggcaggaaaaggguaaaagccuucuguuuaagaccgaggacggcgugaauaugugcacauugauggcaaucgauuuaggggaacugugugaggacacuauuaccuacaaaugcccacuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucaucccaaagagcuucgcaggccccgucucucagcacaacuaccgaccugguuaucauacccaaacagcuggcccauggcaccucgggaagcuggaaauggauuuugacuucugugagggaacuaccgugguugugacagaagauugcggcaacagagggcccucccuaaggacgaccacugccucaggaaaacugauuacagaguggugcugucgcaguugcacccucccgccucugcgguacagaggcgaggacgguuguugguacgggauggaaaucaggccacuuaaggagaaggaagagaauuuggucaacagccuggugacugcgggacauggccagauugauaauuuuucguuagguguucucggcauggcccuguuccuugaagagaugcugcgcacacgaguggggaccaaacacgcuauauugcucguagcacuguccuuugucacgcuaaucacuggaaacaugucuuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaagcaaggagcugaugauggcuaccaucgggauugcccuucugucacagaguacacuaccugaaacuauccucgagcugaccgaugcauuggcucugggaaugauggccuuaaaaauaguacgcaauauggaaaaguaccaacucgcagugacgaucauggccauuuccugcguccccaacgcugugauccugcagaaugcguggaagguuucuuguacaauucuugccgcagugagcgucuccccacuguugcucaccucaagccagcagaaagcugacuggaucccucuggcccuaacuauaaagggccugaaccccaccgccauuuuucuuacaacucucagucggaccucuaaaaagagauccuggccacugaaugaggcuaucauggcagugggcaugguuagcaucuuggccucgucacugcuaaagaacgacauuccgaugacggggccucucguggcgggaggucugcuuacagucugcuauguacugaccggcaggucugcugauuuggaacucgagcgagccgcagacgugaagugggaggaucaagccgaaauaaguggguccagccccauccugucuauuacuaucagcgaggacggauccaugucaauuaaaaaugaagaggaggaacagacacuaaccauccugauacgcacuggccuucucguuaucagugguguguucccagucagcauucccaucacagcugcagccugguaccugugggaggugaagaagcagcgggcggggguauugugggaugugccuucuccacccccugucggaaaagcugaauuagaggacggcgccuauagaauuaagcagaggggcauccugggguacucccaaauaggagccgguguuuauaaagaaggcaccuuucacacgauguggcaugugacucguggggcagugcucaugcaccgcggaaagcggauugagccgucaugggcugaugucaaaaaggaccugaucaguuacggcgguggguggaaacuugagggagaauggaaagagggcgaagaggugcagguucuggccuuggaaccaggcaagaaccccagagcaguacagaccaaaccugggaucuucaagacaaauaccggaacaauuggugcugugagccuagauuuuuccccaggcacuucugggucgcccaucgucgacaggaaaggaaaggugguuggccuguacgguaacgggguggucacccgaagcggagccuaugugucagcgauagcccagacggagaaguccauugaggauaauccugaaaucgaggacgauauuuuccggaaaaagcgccucacaaucauggaccugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuaguccagugagggucccuaacuacaaccugauuauaauggaugaggcccacuuuacggaccccgcuucuaucgccgcacgcggcuauauuagcacucgaguggaaaugggggaggccgcuggaaucuucaugaccgcgacaccaccgggcuccagagauccuuuuccccagucaaaugccccaaucauggacgaggaacgggagauucccgaaaggucuuggaacagcggucacgaguggguuaccgauuucaaggggaagacugugugguuugucccuaguauaaaagcaggaaaugacaucgcugccugcuugcgcaagaacggcaaaaaggugauucagcuaucccguaaaacauucgauagcgaauacguaaagaccagagcaaaugacugggauuuugugguuacgacugacaucucugagaugggcgccaacuucaaggcugagcgggucauugauccaaggcgcuguaugaaacccgugauccugacagacggggaagaacgagugauacucgccggaccuaugccggucacccauucauccgcggcacaaagacgggguaggaucggccgcaauccaaagaacgaaaaugaccaguauauuuacaugggggagcccuuagaaaacgaugaggacugcgcccacuggaaagaggcuaagaugcugcuugauaauaucaacaccccugaaggaauuauccccaguauguuugagccagaaagagagaaaguagacgccauagauggcgaauacaggcugcggggugaggcucguaagacuuucguggaccucaugcgccgaggggauuugccuguuuggcuggcauauaaaguggccgcugagggcauuaauuacgccgacagaaagugguguuuugauggaaucaagaacaaucagauucucgaagagaacgucgaaguggagaucuggacaaaagagggcgaaaggaagaaacugaagccccgguggcuugacgcacgcauauauagcgauccacuagcgcugaaagaguucaaggaguucgccgcugggagaaagucguugaccuuaaaccugaucacagagaugggaaggcucccuacuuuuaugacgcagaaagcccggaaugcacuggacaaccuugcuguucugcauaccgccgaaguggguggcaaggcauacacacacgcccucucugaguugccggagacucuggaaacccuacugcuccuuacacuguuagcugcggucaccgggggaauuuucuuguuucugauguccggcaaagguaucgggaagaugacucucggcaugugcugcauuaucacggccagcauacugcuuugguaugcacaaauucagccccacuggaucgcugccucaaucauucuggaguucuuucucaucguguugcugauaccagaaccugagaaacagcgaacaccccaggauaaucaauuaacauacguagugauugccauccuaacuguugucgcagcuaccauggccaacgaaaugggauuccuggagaagacaaagaaagaccucggcuuugggaguauuaccacucaggagucugaauccaauauccuugacauagaucugagaccagcgagcgcuuggacauuguaugccguggcaacgaccuucgugacuccuaugcugcgccauucaaucgagaacaguagcgucaauguuucccucacagccauugcuaaccaggcaaccgugcugaugggacuugguaagggcuggccccucucuaaaauggacaucgggguaccgcuguuggccauuggauguuacagccaggugaauccaaucacccugacagcggcuuuacuacugcucgucgcccacuacgcaauuaucggcccuggucuucaagccaaggcuacuagggaagcccagaaacgggcagcugccgggauaaugaagaaccccacgguggauggcauuaccguuaucgaccuggagccaauccccuaugauccuaaguuugaaaaacaguugggacaggugaugcugcucauucugugcgucacacaaguacuuaugaugcguacuaccugggcguuaugugaggcccugacacucgcaaccggcccgauauccacuuugugggaggggaaucccggaagauucuggaacacgacaaucgcugugucaauggccaauauuuuuaggggcucuuaccuggccggugcugggcuacuguucaguaucaugaagaacaccacuaauacccgccggggaacaggcaacguuggugaaacucucggcgagaaauggaagucgcgacuuaaugcccuggggaaaagcgaauuucagauuuauaagaaauccggaauccaggagguggacagaaccuuggccaaggagggcauaaagagaggggaaacagaucaucacgcggucucucgcggaucagcuaaacugcggugguucguggagagaaacauggucacgccagaaggcaaggugguugaccucgguugcgggcguggaggcuggagcuacuauugugguggccugaaaaacgugagggagguaaagggguuaaccaaaggaggcccugggcaugaggaacccaucccuauguccacuuacggauggaaucuugugcggcugcaaaguggcgucgauguuuucuuuacaccacccgagaagugcgacacccuccuaugugauauuggugaaucuagcccuaacccaacuaucgaggcagggcgcacacugcgaguguugaaucuggucgaaaacuggcucaauaacaauacccaguucugcauuaaggugcuuaaccccuauaugccgucaguaaucgagaaaauggaaacgcugcagagaaaguacggaggcgccuuggugaggaauccucugucccggaacaguacccacgagauguacuggguuagcaaugcuacaggcaacauagugucuuccgucaauaugauuucacgcaugcucaucaacagauuuacuaugaaacacaagaaagccaccuaugagccagacguggauuuagggagcggaacaaggaauaucgguauugaaucggagauacccaaccuggacaucauuggcaagcgaaucgaaaagauuaaacaggagcaugaaacuucuuggcacuacgaccaagaucauccuuauaagaccugggcauaccacgggaguuaugagacaaaacagaccggauccgccagcucaauggucaacggcgugguucggcuucugacuaagccaugggacguagugcccauggucacgcagauggcuaugacagauaccacuccguucggucagcaacguguguuuaaagagaagguugacaccagaacacaggaaccuaaggaggggacgaaaaagcuaaugaaaaucaccgcggaauggcucuggaaggagcugggaaaagagaagacuccccgcauguguacaagggaagaguucacccggaaagugagauccaaugccgcauugggcgcugucuuuacugaugaaaacaaguggaagucugcccgcgaggcaguggaagacggcagguucugggagcugguagaucgagagcggaaucuccaccuugaagggaaaugcgagacauguguguacaacaugaugggaaagagagagaaaaagcugggugaguuuggcaaagccaaggggagcagggcuauaugguauaugugguuaggagcccgcuuccuggaauuugaggcguugggcuuccucaaugaggaccauugguuuagucgugguaacucccugagcgggguugaaggagagggccuacaccggcuuggcuacauccugagagaagucgggaagaaagagggaggugcaauguacgccgaugacaccgcuggcugggauacaaggauuacucucgaagaccugaagaaugaggagauggugaccaaccauaugaaaggggaacacaagaaauuggccgaggcaaucuucaagcugacguaucagaauaaggugguccgcguucagcgaccaaccccucggggaacagugauggacauuaucucuagaaaagaucaaaggggcucaggucagguagggacuuacggacucaacaccuucacaaauauggaagcucagcuuauucgccaaauggagggcgagggcauauuuaagaguauccagcaucugacugccaccgaagagauugcugugcagaacugguuagccagagucgggcgggaaaggcugucccguauggcaaucagcggagacgauugcgugguuaaacccaucgacgaucgauucgcgucugccuugacggcucucaaugacauggguaaggugcgcaaagauauucagcaaugggagccaucgagaggcuggaacgacuggacacagguccccuuuugcucacaccacuuccaugaacuggugaugaaggaugggcgggucuuaguugugccuuguaggaaucaggacgagcuuauaggacgcgccagaaucagccagggcgcagguuggucccugaaggagaccgcuugccucgggaaaaguuaugcccaaauguggacucugauguacuuucaccggagggauuugcgauuagcagccaacgcgauuuguucugcugucccaagccauugggugccgacaucccguaccacuuggucaauccacgccaagcacgaauggaugaccacagaggacaugcuggcaguguggaacagagucuggauucaggaaaaucccuggauggaggauaaaacgccuguugaaaguugggaggaggugccauaucucggaaagcgcgaagaccaguggugcggcucucuuaucggccugaccagccgggccacuugggcuaaaaacauacagacagccaucaaucaaguaaggucccuaauugggaacgagggauacaccgacuauaugcccucaaugaagagauuccgccgggaagaggaagaggccggugugcugugguga

SEQ ID NO: 14905 - RNA, 9876 nt, Artificial Sequence
  derived and/or modified CDS sequence (opt3) from DENV-2__JX286520__SS-prME
accgcaggcgugaucgucaugcugauucccaccgcuauggcauuccaccucacuacgaggaacggggaaccucauaugauaguuggaaggcaggaaaaggguaaaagccuucuguuuaagaccgaggacggcgugaauaugugcacauugauggcaaucgauuuaggggaacugugugaggacacuauuaccuacaaaugcccauuacuccggcaaaacgaaccggaggauaucgacuguuggugcaauuccacaucuaccuggguuacuuauggaacauguaccacgacuggcgagcaccgccgagaaaagcguucaguggcgcuggucccccauguggguauggggcuugagacccggacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaggaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguauagugacaauggaguguagucccaggaccgggcuugauuucaacgaaaugguucuguugcaaauggaggacaaagcauggcucgugcaccggcagugguuucuggauuuaccucugccauggcuccccggcgcugacacucagggaagcaauuggauucagaaggagacacuugucacguucaagaacccucaugccaaaaagcaagacgugguugugcugggcucucaggaaggggcgaugcacaccgccuugacuggagcaacagagauccagauguccucagguaaucuacuguuuaccggccaucucaaaugccgucugcgcauggauaaacuucaacugaaagggaugagcuacaguauguguacaggaaaguucaagaucgucaaagaaauugcugagacucagcacggcaccaucgugauuagaguacaguaugagggugacgggucuccaugcaagauacccuucgaaaucacggauuuggagaaaaggcauguucucggccggcugauuaccgugaacccgaucgucacagaaaaggacuccccugugaacaucgaggccgaacccccauuuggagauagcuacauuauagucggcguggagccugggcaguuaaaacugaauugguucaagaagggaucgucuaucggucaaauguuugagacuaccaugcgaggcgcuaaacgcauggccauucuaggggacacagcaugggauuucggaucccucggcgguguuuuuacuucaaucgggaaggcccugcaccagguguucggcgcuauuuacggagcggcauuuaguggcguaagcuggaccaugaaaauccuuauaggggucaucauuacguggaucggaaugaacuccagaucuacuagcuugucagugagucugguucucgugggcgucgugacccuguaucuuggugccaugguacaggcugacuccggguguauugugagcuggaagaauaaagaacugaagugcggaucuggcaucuucauaacugauaacguucacacauggaccgagcaguacaaguuucaacccgaaucaccaaguaaauuggccagcgcaauucagaaggcccaugaggaagguaucuguggcauuagguccgucacucggcucgagaaucugauguggaaacagaucacccccgaguuaaaccacauacugucugaaaaugaggugaagcuaacaaucaugacgggggacauuaaaggaaucaugcaggcuggcaagcgcucgcucagaccucaaccaaccgaacugaaauauagcuggaagacuugggggaaggccaaaaugcuuuccacagagucacauaaccagaccuucuugauugauggaccggaaacagcagagugccccaauacuaacagggcguggaauagucuggagguggaagacuacggcuuuggugucuucaccacgaacaucuggcucaagcugcgugagaaacaggacguauuuugugauucuaaguuaaugagcgcugccauaaaagacaaucgggcagugcacgccgauaugggguauuggauugaauccgcucugaacgacacauggaagauggagaaggccucauucaucgaggugaaaagcugccacuggccuaagucucauacccuuugguccaauggaguauuggaaagugagaugaucauucccaagaauuucgcaggccccgucagccagcacaacuaccgaccugguuaucauacucaaaccgcuggcccauggcaccucgggaagcuggaaauggauuuugacuucugugagggaacaacugugguugugaccgaagauugcggcaauagagggcccucucuaaggacaacgaccgccuccggaaaacugaucacugaguggugcugucgcucaugcacacucccgccucugcgguacagaggcgaggacgguuguugguacgggauggaaauuaggccacuuaaggagaaggaagagaacuuggucaauagucuggugaccgcgggacauggccagauagauaacuuuagcuuagguguucucggcauggcccuguuccuugaagagaugcugcgcacucgaguggggacaaaacacgcuaucuugcucguagcacugucguuugucacccuaauuacgggaaauauguccuuccgggaccugggccgugugauggugauggucggggccacuaugaccgaugacaucggaaugggcguuacauaucucgcucugcuugccgcauuuaaggugagacccaccuucgcggccgguuugcuguuaaggaaacucacuucuaaggagcugaugauggcuacaauugggaucgcccuucugagccagucaacccuaccugaaacaauacucgagcugacugaugcauuggcucugggaaugauggccuuaaaaaucguacgcaacauggaaaaguaccaacucgcagugaccauuauggccaucaguugcguccccaaugcugugauucugcagaacgcguggaagguuuccuguacgauccuugccgcagugucugucagcccacuguugcucacauccucacagcagaaagcugacuggauaccucuggcccuaaccauuaagggccugaaucccacugccaucuuucuuaccacacucagccggacaaguaaaaagagaucuuggccacugaacgaggcuaucauggcagugggcaugguuuccauuuuggccagcucgcugcuaaagaaugacauaccgaugaccgggccucucguggcgggaggucugcuuacggucugcuauguacugacaggcaggucagcugauuuggaacucgagcgagccgcagacgugaagugggaggaucaagccgaaaucucugggaguucccccauucugagcaucaccauuucugaggacggaagcauguccaucaaaaacgaagaggaggaacagacucuaacaauacugauccgcaccggccuucucguuauuucagguguguucccagucaguauccccauuacugcugcagccugguaccugugggaggugaagaagcagcgggcggggguauugugggaugugccuagcccacccccugucggaaaagcugaauuagaggacggcgccuauagaaucaagcagaggggcauacugggguacucucaaauuggagccgguguuuauaaagaaggcacauuucacaccauguggcaugugacgcguggggcagugcucaugcaccgcggaaagcggaucgagccguccugggcugaugucaaaaaggaccugaucucauacggcgguggguggaaacuugagggagaauggaaagagggcgaagaggugcagguucuggccuuggaaccaggcaagaaucccagagcaguacagacuaaaccugggauuuucaagaccaacacaggaaccaucggugcugugagucuagauuuuagcccaggcacauccgggucucccauagucgacaggaaaggaaaggugguuggccuguacgguaaugggguggucacucgaucgggagccuaugugagcgcgauugcccagaccgagaagucaaucgaggauaacccugaaauugaggacgauaucuuccggaaaaagcgccucacgauaauggaccugcauccgggcgcaggcaaaacaaagagauaccuucccgcuauuguaagggaagccaucaaacggggguuacgaacucugauccucgcuccaaccagagucguggcagccgagauggaagaggccuugcgcggacugccuauuagguaucaaacacccgcuauccgugcggagcacaccggucgggaaauuguugaccucaugugucaugcaacuuucaccaugagacugcuuuccccagugagggucccuaacuacaaucugauaaucauggaugaggcccacuuuacagaccccgcuaguauugccgcacgcggcuauaucucuacgcgaguggaaaugggggaggccgcuggaaucuucaugacugcgaccccaccgggcagcagagauccuuuuccccaguccaacgccccaauuauggacgaggaacgggagauacccgaaaggucauggaacucuggucacgaguggguuacagauuucaaggggaagaccgugugguuugucccuagcaucaaagcaggaaacgacauugcugccugcuugcgcaagaauggcaaaaaggugauccagcuaagucguaaaacuuucgauuccgaauacguaaagacaagagcaaacgacugggauuuugugguuaccacggacauuagcgagaugggcgccaauuucaaggcugagcgggucaucgauccaaggcgcuguaugaaacccgugauacugacugacggggaagaacgagugauccucgccggaccuaugccggucacacauucuucagcggcacaaagacgggguaggauuggccgcaacccaaagaaugaaaacgaccaguauaucuacaugggggagcccuuagaaaaugaugaggacugcgcccacuggaaagaggcuaagaugcugcuugauaacauuaauaccccugaaggaaucauacccuccauguuugagccagaaagagagaaaguagacgccauugauggcgaauacaggcugcggggugaggcucguaagaccuucguggaccucaugcgccgaggggauuugccuguuuggcuggcauauaaaguggccgcugagggcaucaacuacgccgacagaaagugguguuuugauggaauuaagaauaaccagauccucgaagagaacgucgaaguggagauauggacuaaagagggcgaaaggaagaaacugaagccccgguggcuugacgcacgcaucuauagugauccacuagcgcugaaagaguucaaggaguucgccgcugggagaaagagcuugacauuaaaucugauuaccgagaugggaaggcucccuacauuuaugacucagaaagcccggaacgcacuggacaaucuugcuguucugcauacggccgaaguggguggcaaggcauacacccacgcccucucggaguugccggagacacuggaaacucuacugcuccuuacccuguuagcugcggucacagggggaaucuucuuguuucugaugucuggcaaagguauugggaagaugacccucggcaugugcugcaucauaacugccuccauucugcuuugguaugcacaaauccagccccacuggaucgcugccagcauuauccuggaguucuuucucauaguguugcugauuccagaaccugagaaacagcgaacgccccaggauaaccaauuaaccuacguagugaucgccauucuaacaguugucgcagcuacuauggccaaugaaaugggauuccuggagaagaccaagaaagacuuuggcuucgggucaaucacaacccaggagagugaaucuaacauacucgacaucgaucuuagaccagcguccgcuuggacucuguaugccguggcaacaacguuugugaccccuauguugcgccauagcauugaaaauucaagugucaacguuagccugacugccaucgcuaaucaggcaacagugcucaugggacuggguaagggcuggccccuuuccaaaauggacauugggguaccgcuccuggccaucggauguuacucucaggugaacccaauuaccuugaccgcggcucuguuacuacuggucgcccacuacgcaaucauaggcccuggucuccaagccaaggcuacaagggaagcccagaaacgggcagcugccgggauuaugaagaaucccacuguggauggcaucacgguuaucgaccuugagccaauucccuaugauccuaaguucgaaaaacagcugggacaggugauguugcugauacucugcgucacccaaguacugaugaugcguacaacuugggcgcuuugugaggccuuaacccuggcaacaggcccgaucagcacccucugggaggggaaccccggaagauuuuggaauacuacgauugcuguguccauggccaacaucuucaggggcucauacuuggccggugcugggcugcuauuuucuauuaugaagaauacaaccaacacucgccggggaaccggcaauguuggugaaacacugggcgagaaauggaagagucgacucaacgcccuugggaaaucggaguuccagaucuauaagaaaagcggaauacaggagguggacagaacucuggccaaggagggcaucaagagaggggaaaccgaucaucacgcggucucccgcggaucugcuaaauugcggugguucguggagagaaacauggucacaccagaaggcaaggugguugaccuggguugcgggcguggaggcuggucauacuauugugguggccucaaaaaugugagggagguaaaggggcugacgaaaggaggcccugggcaugaagaaccaauuccuaugagcaccuacggauggaacuuagugcggcuucaauccggcgucgauguauuuuucacuccacccgagaagugcgacacacugcucugugauaucggugaaaguucuccuaauccaaccauugaggcagggcgcacucuacgagugcugaacuuggucgaaaauuggcugaacaauaacacacaguuuugcaucaaggugcucaaucccuauaugccgagcguaauagagaaaauggaaacccuucagagaaaguacggaggcgcccuggugaggaacccuuugucaagaaauuccacgcacgagauguacuggguuaguaacgcuaccggcaauauugugagcucugucaacaugaucucccgcaugcugaucaauagauucacaaugaaacacaagaaagccacuuaugagccagacguggaucucgggucaggaaccaggaacauugguauagaaagcgagauccccaacuuagacauuaucggcaagcgaauugaaaagaucaaacaggagcaugaaacaucguggcacuacgaccaagaucauccuuauaagacuugggcauaccacgggucuuaugagaccaaacagacaggaagugccuccagcauggucaauggcgugguucggcugcuuaccaagccaugggacguagugcccauggucacucagauggcuaugacggauacaaccccguuuggucagcaacguguguucaaagagaagguugacacuagaacccaggaaccuaaggaggggacgaaaaagcugaugaaaauaacagcggaauggcuauggaaggagcucggaaaagagaagacaccccgcauguguacuagggaagaguuuacacggaaagugagaucaaacgccgcacugggcgcugucuucaccgaugaaaauaaguggaaguccgcccgcgaggcaguggaagacggcagguuuugggaguugguagaucgagagcggaaccugcaccucgaagggaaaugcgagacuuguguguacaauaugaugggaaagagagagaagaaacuuggugaguucggcaaagccaaggggucuagggcuaucugguauauguggcugggagcccgcuuuuuagaguucgaggcgcugggcuuuuugaacgaggaccauugguucagccgugguaauagucucuccgggguugaaggagagggccugcaccggcuaggcuacauucuuagagaagucgggaagaaagagggaggugcaauguacgccgaugacacagcuggcugggauaccaggaucacacuggaagaccucaagaacgaggagauggugacuaaucauaugaaaggggaacacaagaaacuggccgaggcaauuuucaaguugaccuaucagaacaaggugguccgcguucagcgaccaacgccucggggaaccgugauggacaucauuagcagaaaagaucaaaggggcucuggucagguagggacauacggacugaauacuuuuaccaacauggaagcucagcucauacgccaaauggagggcgagggcaucuucaagucaauucagcaucuuacagccacugaagagaucgcugugcagaauuggcuggccagagucgggcgggaaagguuaagucguauggcaaucuccggagacgauugcgugguuaaacccauugacgaucgauuugcgagcgcccugaccgcuuugaacgacauggguaaggugcgcaaagauauacagcaaugggagccaucuagaggcuggaaugacuggacgcagguccccuucugcucgcaccacuuucaugaacucgugaugaaggaugggcggguacugguugugccuuguaggaaccaggacgagcuaaucggacgcgccagaauuucacagggcgcagguuggagccuuaaggagacagcuugccuggggaaauccuaugcccaaauguggacccucauguacuuccaccggagggaucugcgauuggcagccaacgcgaucuguagugcugucccaucucauugggugccgacuagccguacaaccugguccauucacgccaagcacgaauggaugacuaccgaggacauguuagcaguguggaauagagucuggauccaggaaaaccccuggauggaggauaaaacaccuguugaaucaugggaggaggugccauaucugggaaagcgcgaagaccaguggugcggcagucucauaggccuuacgucucgggccaccugggcuaaaaauauccagacugccauuaaccaaguaaggagccugaucgggaaugagggauacacagacuauaugcccuccaugaagagauuucgccgggaagaggaagaggccggugugcuaugguga

SEQ ID NO: 14906 - RNA, 9876 nt, Artificial Sequence
  derived and/or modified CDS sequence (opt3) from DENV-2__JX286525__SS-prME
accgcaggcgugaucgucaugcugauucccaccgcaauggcauuccaccucacuacgaggaacggggagccucauaugauaguuggaaggcaggaaaaggguaaaagccuucuguuuaagaccgaggacggcgugaauaugugcacauugauggccaucgauuuaggggaacugugugaggacacuauuaccuacaaaugcccauuacuccggcaaaacgaaccggaggauaucgacuguuggugcaauuccacaucuaccuggguaacuuauggaacauguaccacgacuggcgagcaccgccgagaaaagcguucaguggcgcuggucccccauguggguauggggcuugagaccagaacagaaacuuggaugaguagcgagggagcuuggaaacacguucagaggauugagaccuggauccugcggcauccuggcuucacaauaauggccgcaaucuuggccuacaccauuggcacgacucacuuucagcgcgcucucaucuucauucugcugacagcaguggccccauccaugaccaugagaugcaucgggauaucuaacagggauuuugucgaaggagugucggguggcucauggguagacauuguucucgagcacgggagcugugugacuacaauggcuaagaauaagcccaccuuagauuucgaacugaucaaaacggaggccaagcagccugcgacccuucggaaauauugcauugaagcaaaguugacaaacacuaccacagagagucgcuguccaacucaaggagagcccucccugaaugaagaacaggacaaacgauuuaucugcaagcauucuauggucgauagaggcugggguaacggguguggacuauucggcaagggcgggaucgugaccugcgccauguuuacaugcaaaaagaauauggaaggaaaaauugugcagccugagaaccucgaauacaccauagucaucacuccacacagcggugaggagcaugcuguuggcaaugacacggggaagcacggaaaagaaauuaagaucacaccgcaguccucaaccacugaggccgaacugaccggcuaugguacagugaccauggaguguagucccaggacugggcuugauuucaacgaaaugguacuguugcaaauggaggacaaagcauggcucgugcaccggcagugguuucuggauuuaccucugccauggcuccccggcgcugacacacagggaagcaauuggauacagaaggagacgcuugucaccuucaagaacccucaugccaaaaagcaagacgugguugugcugggcucucaggaaggggcgaugcacacugccuugacaggagcaaccgagauucagauguccucagguaaucuacuguuuacaggccaucucaaaugccgucugcgcauggauaaacuucaacugaaagggaugagcuacaguauguguacuggaaaguucaagaucgucaaagaaaucgcugagacccagcacggcacgauugugaucagaguacaguaugagggugacgggucuccaugcaagauucccuucgaaauaaccgauuuggagaaaaggcauguucucggccggcugaucacagugaacccgauugucacugaaaaggacuccccugugaacaucgaggccgaacccccauuuggagauagcuacaucauugucggcguggagccugggcaguuaaaacugaauugguucaagaagggaucgucuauaggucaaauguuugagaccacaaugcgaggcgcuaaacgcauggccauccuaggggacacugcaugggauuucggaucccucggcgguguuuuuaccucaauugggaaggcccugcaccagguguucggcgcuaucuacggagcggcauuuaguggcguaagcuggacgaugaaaauucuuaucggggucauaaucacauggauuggaaugaacuccagaucuaccagcuugucagugagucugguucucgugggcgucgugacucuguaucuuggugccaugguacaggcugacuccggguguaucgugagcuggaagaauaaagaacugaagugcggaucuggcauuuucaucacagauaacguucacaccuggacugagcaguacaaguuucaacccgaaucaccaaguaaauuggccagcgcaauacagaaggcccaugaggaagguauuuguggcaucagguccgucacccggcucgagaaucugauguggaaacagauuacacccgaguuaaaccacauccugucugaaaaugaggugaagcuaacgauaaugaccggggacaucaaaggaauuaugcaggcuggcaagcgcucgcucagaccucaaccaacugaacugaaauauagcuggaagacaugggggaaggccaaaaugcuuuccaccgagucacauaaccagacauucuugaucgauggaccggaaacugcagagugccccaauaccaacagggcguggaauagucuggagguggaagacuacggcuuuggugucuucacgacaaacauuuggcucaagcugcgugagaaacaggacguauuuugugauucuaaguuaaugagcgcugccaucaaagacaaucgggcagugcacgccgauaugggguauuggauagaauccgcucugaacgacaccuggaagauggagaaggccucauucauugaggugaaaagcugccacuggccuaagucucauacucuuugguccaauggaguauuggaaagugagaugaucaucccaaagagcuucgcaggccccgucucucagcacaacuaccgaccugguuaucauacccaaacagcuggcccauggcaccucgggaagcuggaaauggauuuugacuucugugagggaacuaccgugguugugacagaagauugcggcaacagagggcccucccuaaggacgaccacugccucaggaaaacugauuacagaguggugcugucgcaguugcacccucccgccucugcgguacagaggcgaggacgguuguugguacgggauggaaaucaggccacuuaaggagaaggaagagaauuuggucaacagccuggugacugcgggacauggccagauugauaauuuuucguuagguguucucggcauggcccuguuccuugaagagaugcugcgcacacgaguggggaccaaacacgcuauauugcucguagcacuguccuuugucacgcuaaucacuggaaacaugucuuuccgggaccugggccgugugauggugauggucggggccaccaugacagaugacauuggaaugggcguuaccuaucucgcucugcuugccgcauuuaaggugagacccacuuucgcggccgguuugcuguuaaggaaacucacaagcaaggagcugaugauggcuaccaucgggauugcccuucugucacagaguacacuaccugaaacuauccucgagcugaccgaugcauuggcucugggaaugauggccuuaaaaauaguacgcaauauggaaaaguaccaacucgcagugacgaucauggccauuuccugcguccccaacgcugugauccugcagaaugcguggaagguuucuuguacaauucuugccgcagugagcgucuccccacuguugcucaccucaagccagcagaaagcugacuggaucccucuggcccuaacuauaaagggccugaaccccaccgccauuuuucuuacaacucucagucggaccucuaaaaagagauccuggccacugaaugaggcuaucauggcagugggcaugguuagcaucuuggccucgucacugcuaaagaacgacauuccgaugacggggccucucguggcgggaggucugcuuacagucugcuauguacugaccggcaggucugcugauuuggaacucgagcgagccgcagacgugaagugggaggaucaagccgaaauaaguggguccagccccauccugucuauuacuaucagcgaggacggauccaugucaauuaaaaaugaagaggaggaacagacacuaaccauccugauacgcacuggccuucucguuaucagugguguguucccagucagcauucccaucacagcugcagccugguaccugugggaggugaagaagcagcgggcggggguauugugggaugugccuucuccacccccugucggaaaagcugaauuagaggacggcgccuauagaauuaagcagaggggcauccugggguacucccaaauaggagccgguguuuauaaagaaggcaccuuucacacgauguggcaugugacucguggggcagugcucaugcaccgcggaaagcggauugagccgucaugggcugaugucaaaaaggaccugaucaguuacggcgguggguggaaacuugagggagaauggaaagagggcgaagaggugcagguucuggccuuggaaccaggcaagaaccccagagcaguacagaccaaaccugggaucuucaagacaaauaccggaacaauuggugcugugagccuagauuuuuccccaggcacuucugggucgcccaucgucgacaggaaaggaaaggugguuggccuguacgguaacgggguggucacccgaagcggagccuaugugucagcgauagcccagacggagaaguccauugaggauaauccugaaaucgaggacgauauuuuccggaaaaagcgccucacaaucauggaccugcauccgggcgcaggcaaaacuaagagauaccuucccgcuauaguaagggaagccauuaaacggggguuacgaacccugauccucgcuccaacaagagucguggcagccgagauggaagaggccuugcgcggacugccuaucagguaucaaacccccgcuauucgugcggagcacacuggucgggaaaucguugaccucaugugucaugcaaccuucacaaugagacugcuuaguccaauuagggugccuaacuacaaccugauaaucauggaugaggcccacuuuacggaccccgcuucuauugccgcacgcggcuauaucagcacucgagucgaaaugggggaggccgcuggaaucuucaugaccgcgacaccaccgggcuccagagauccuuuuccccagucaaaugccccaauuauggacgaggaacgggagauacccgaaaggucuuggaacagcggucacgagugggugaccgauuucaaggggaagacuguuugguuugugccuaguaucaaagcaggaaaugacauugcugccugcuugcgcaagaacggcaaaaaggucauccagcuaucccguaaaacauucgauagcgaauacgugaagaccagagcaaaugacugggauuuuguagugacgacugacauuucugagaugggcgccaacuucaaggcugagcggguuaucgauccaaggcgcuguaugaaacccgucauacugacagacggggaagaacgagugauccucgccggaccuaugccggugacccauucauccgcggcacaaagacgggguaggauuggccgcaauccaaagaacgaaaaugaccaguauaucuacaugggggagcccuuagaaaacgaugaggacugcgcccacuggaaagaggcuaagaugcugcuugauaauauuaacaccccugaaggaaucauacccaguauguuugagccagaaagagagaaagucgacgccauugauggcgaauacaggcugcggggugaggcucguaagacuuucguagaccucaugcgccgaggggauuugccuguguggcuggcauauaaaguugccgcugagggcaucaauuacgccgacagaaagugguguuuugauggaauuaagaacaaucagauccucgaagagaacguggaagucgagauauggacaaaagagggcgaaaggaagaaacugaagccccgguggcuugacgcacgcaucuauagcgauccacuagcgcugaaagaguucaaggaguucgccgcugggagaaagucguugaccuuaaaccugauuacagagaugggaaggcucccuacuuuuaugacgcagaaagcccggaaugcacuggacaaccuugcugugcugcauaccgccgaaguugguggcaaggcauacacacacgcccucucugaguugccggagacucuggaaacccuacugcuccuuacacuguuagcugcggugaccgggggaaucuucuuguuucugauguccggcaaagguauugggaagaugacucucggcaugugcugcaucauaacggccagcauucugcuuugguaugcacaaauccagccccacuggaucgcugccucaauuauccuggaguucuuucucauagucuugcugauuccagaaccugagaaacagcgaacaccccaggauaaucaauuaacauacgugguaaucgccauucuaacugugguugcagcuaccauggccaacgaaaugggauuccuggagaagacaaagaaagaccucggcuuugggaguaucaccacucaggagucugaauccaauauacuugacaucgaucugagaccagcgagcgcuuggacauuguaugccgucgcaacgaccuucgugacuccuaugcugcgccauucaauugagaacaguagcgugaaugucucccucacagccaucgcuaaccaggcaaccguucugaugggacuugguaagggcuggccccucucuaaaauggacauuggggugccgcuguuggccaucggauguuacagccagguaaauccaauuacccugacagcggcuuuacuacugcucguggcccacuacgcaaucauaggcccuggucuucaagccaaggcuacuagggaagcccagaaacgggcagcugccgggauuaugaagaaccccacggucgauggcaucaccgugaucgaccuggagccaauucccuaugauccuaaguuugaaaaacaguugggacagguuaugcugcucauacugugcgugacacaaguccuuaugaugcguacuaccugggcguuaugugaggcccugacacucgcaaccggcccgaucuccacuuugugggaggggaaucccggaagauucuggaacacgacaauugcuguaucaauggccaauaucuuuaggggcucuuaccuggccggugcugggcuacuguucaguauuaugaagaacaccacuaauacccgccggggaacaggcaacgugggugaaacucucggcgagaaauggaagucgcgacuuaaugcccuggggaaaagcgaauuucagaucuauaagaaauccggaauacaggagguugacagaaccuuggccaaggagggcaucaagagaggggaaacagaucaucacgcggugucucgcggaucagcuaaacugcggugguucgucgagagaaacauggugacgccagaaggcaaggucguggaccucgguugcgggcguggaggcuggagcuacuauugugguggccugaaaaacguuagggaggugaagggguuaaccaaaggaggcccugggcaugaggaacccauuccuauguccacuuacggauggaaucuuguacggcugcaaaguggcguggaugucuucuuuacaccacccgagaagugcgacacccuccuaugugauaucggugaaucuagcccuaacccaacuauugaggcagggcgcacacugcgaguuuugaaucugguggaaaacuggcucaauaacaauacccaguucugcaucaagguccuuaaccccuauaugccgucagugauagagaaaauggaaacgcugcagagaaaguacggaggcgccuugguaaggaauccucugucccggaacaguacccacgagauguacugggugagcaaugcuacaggcaacauuguuucuuccgugaauaugaucucacgcaugcucaucaacagauuuacuaugaaacacaagaaagccaccuaugagccagacgucgauuuagggagcggaacaaggaauauugguauagaaucggagauccccaaccuggacauuaucggcaagcgaauugaaaagaucaaacaggagcaugaaacuucuuggcacuacgaccaagaucauccuuauaagaccugggcauaccacgggaguuaugagacaaaacagaccggauccgccagcucaauggugaacggcgucgugcggcuucugacuaagccaugggacguuguacccauggugacgcagauggcuaugacagauaccacuccguucggucagcaacgugucuuuaaagagaagguggacaccagaacacaggaaccuaaggaggggacgaaaaagcuaaugaaaauaaccgcggaauggcucuggaaggagcugggaaaagagaagacuccccgcauguguacaagggaagaguucacccggaaaguuagauccaaugccgcauugggcgcuguguuuacugaugaaaacaaguggaagucugcccgcgaggcagucgaagacggcagguucugggagcugguggaucgagagcggaaucuccaccuugaagggaaaugcgagacauguguauacaacaugaugggaaagagagagaaaaagcugggugaguuuggcaaagccaaggggagcagggcuaucugguauaugugguuaggagcccgcuuccuggaauuugaggcguugggcuuccucaaugaggaccauugguuuagucgugguaacucccugagcgggguggaaggagagggccuacaccggcuuggcuacauucugagagaaguugggaagaaagagggaggugcaauguacgccgaugacaccgcuggcugggauacaaggaucacucucgaagaccugaagaaugaggagauggucaccaaccauaugaaaggggaacacaagaaauuggccgaggcaauuuucaagcugacguaucagaauaagguggugcgcguccagcgaccaaccccucggggaacaguuauggacaucauuucuagaaaagaucaaaggggcucaggucagguggggacuuacggacucaacaccuucacaaauauggaagcucagcuuauacgccaaauggagggcgagggcaucuuuaagaguauucagcaucugacugccaccgaagagaucgcuguacagaacugguuagccagaguggggcgggaaaggcugucccguauggcaaucagcggagacgauugcgucgugaaacccauugacgaucgauucgcgucugccuugacggcucucaaugacauggguaagguucgcaaagauauacagcaaugggagccaucgagaggcuggaacgacuggacacaggugcccuuuugcucacaccacuuccaugaacuggucaugaaggaugggcgggugcuaguaguuccuuguaggaaucaggacgagcuuaucggacgcgccagaauuagccagggcgcagguuggucccugaaggagaccgcuugccucgggaaaaguuaugcccaaauguggacucugauguacuuucaccggagggauuugcgauuagcagccaacgcgaucuguucugcugugccaagccauugggucccgacaucccguaccacuuggucaauucacgccaagcacgaauggaugaccacagaggacaugcuggcaguguggaacagaguguggauccaggaaaaucccuggauggaggauaaaacgccugucgaaaguugggaggagguuccauaucucggaaagcgcgaagaccaguggugcggcucucuuauaggccugaccagccgggccacuugggcuaaaaacauccagacagccauuaaucaagugaggucccuaaucgggaacgagggauacaccgacuauaugcccucaaugaagagauuccgccgggaagaggaagaggcugguguucugugguga

SEQ ID NO: 14907 - RNA, 9876 nt, Artificial Sequence
  derived and/or modified CDS sequence (opt3) from DENV-2__KM279598__SS-prME
accgccggcaucauuauaaugaugauccccacagugauggcuuuccaccugacuacgcgaaacggggagccucauaugauugucagcaggcaggaaaagggaaagucccuccuuuuuaagaccgagaaugguguuaacaugugcacacugauggcaauggacuugggcgaauuaugugaggauacuaucaccuacaauugcccacugcugcggcaaaacgaaccggaggacauugauuguuggugcaauucuacaucaaccugggugacuuaugggacauguaccgccacgggagagcaccgccgagaaaagcguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaagaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcacgcucagaccccagccuaccgagcugaaguacagcuggaaagccuggggcaaggcaaagaugcuuuccacugaauugcacaaucauacauuccugaucgaugggccagagaccgcggaaugcccgaacacaaauagggcuuggaacucacucgaggucgaggacuauggauuuggcguguucacuaccaauauauggcugaaauuaaaggaacgucaagauguauuuugugacaguaaacugaugucugccgcaaucaaggacaaccgggccgugcacgcugauauggguuacuggauugagagcgcccuuaacgacacguggaaaaucgaaaaggcauccuucauugaggucaagucaugccacuggcccaaaagccauacauuguggucuaauggggugcucgaguccgaaaugaucauaccuaagaacuucgcuggaccaguuagucagcacaauuaucgacccggcuaccauacccagacugccgguccuuggcaccugggcagacuagagauggauuuugacuucugugaagggaccacagugguagucacugaggauugcggaaacaggggcccaagccugcgcaccacaacggcgucugggaaacucauuaccgaauggugcugucgguccugcacucugcccccgcuuagauacaggggagaggacggcuguugguaugguauggagauccgcccuuugaaggaaaaagaggaaaaucuggugaacucauuagugacagccgggcauggacagaucgauaauuuuagucucggcguccuggguauggcucuuuuccuggaggaaauguugcgaacccggguuggcacuaagcacgcaauucuccugguggccguuagcuuugugacacuaaucaccgggaacaugucguuccgugacgucggaagagugaugguuauggugggcgcuacgaugacugaugacauugggaugggagucaccuaccuggcccuccuggcagcguuuaagauaaggccaacauucgccgcuggccuuuugcugcgcaaauuaaccuccaaggagcucaugaugacuacaaucgguauugugcugcuuucucaaagcaccauccccgagucaauucuggaacuaacagaugcccucgcacuggggaugaugguuuugaaaaucgugcggaauauggagaaguaucagcuggcugucacuauaauggccaucuuaugcguaccuaacgcagugauucuccagaaugccuggaaaguuaguuguaccacgcuggcuguggucuccgugucuccccuucuguugacaagcucccaacagaaggcggacuggaucccacucgcccugaccauuaagggacuaaacccuacugcaaucuuucugaccacacuuucaagaacuagcaaaaagaggaguuggccccucaaugaagcuauaauggccguaggcauggugucuauucuggccuccagcuugcugaaaaacgauaucccaaugaccggcccguuagucgcugggggacuccugacgguuugcuacgugcuuacaggucgaucggcagaccuggaguuggaacgcgccgcggacgugcggugggaggagcaggcugaaaucucaggcucuaguccuauucucuccauaaccaucagcgaggaugggucuaugagcauuaagaaugaagaggaggaacagacucugacaauccuaauuagaaccggacugcuugucaucuccggccucuuccccgugucaauaccaaucacugccgcagccugguaucugugggagguuaaaaagcaaagggcugguguauugugggacgugcccaguccuccacccgucgggaaagcagaauuagaggauggagccuaccguauuaagcagaagggcauccugggcuauagccagauuggggcgggaguguacaaagaagguacauuucacaccauguggcauguuacgcgcggcgcugugcucaugcacaaggggaaacggaucgagccuucuugggccgacgucaagaaagaucugauauccuacggaggcgguuggaaacuugagggggaauggaaggagggagaagaggugcagguacuggcauuggaaccgggcaaaaacccaagagccguccaaacuaagcccggccuauucaaaaccaacacagggaccauuggagcugugucacuggacuuuaguccugguacaagcggcuccccaaucguugauaagaaagggaagguggucggacucuauggcaauggugugguuacuaggucugggaccuacgugucggccaucgcacagacggaaaagagcauugaggacaaccccgaaaucgaggaugacauauucagaaagaagcggcugacaauuauggaucuucauccuggagcuggcaaaacuaagcgcuauuuaccggccaucgucagagaagcgauuaaaaggggccugcggacccucaucuuggcccccacacgagugguagcagcugagauggaagaggcccugagagggcucccaauacgcuaccagaccccugcuauuagggcagagcacacuggacgugaaaucguggaccugaugugucaugccaccuucacaaugcggcuucugucacccaucagaguuccaaauuauaacuugauuaucauggaugaggcccacuuuacggacccugcuuccauugcggcaagggguuacauaaguacucgcgucgaaaugggcgaggccgcugggaucuucaugaccgccacacccccaggaucucgagacccguuuccucagagcaaugcacccauuauggaugaggaaaaggagaucccagaaagauccuggaacucaggccacgagugggugaccgacuucaaggguaaaacugugugguuuguccccucuaucaaggccgggaaugauauugcugcgugccuacggaaaaacggaaagaaaguaauacaacugagcaggaagacauucgacagugaauauaucaagacccgcacgaaugauugggacuuugugguuacuacagauauuuccgagaugggcgccaacuucaaagcagagcgugugaucgacccuagacgguguaugaagccagucauucucaccgauggcgaagagagggugaucuuagcugggcccaugccuguuacccauagcucugccgcacagcgccgaggaagagugggucggaauccgaaaaacgaaaaugaccaguacauauacaugggcgagccacuggaaaacgaugaggacugcgcccacuggaaggaggcuaaaaugcuucuggacaauaucaacacucccgaagggauuaucccuucaauguuugagcccgaaagggagaaggucgaugccauugacggagaauaucgccucagaggcgaggcgaggaaaacauucguggauuugaugcggcguggugaccugccaguauggcucgcauaccgcguggccgcugaggggaucaacuaugccgaucgaagaugguguuuugacggcguuaagaauaaccaaauacuggaagagaaugucgaaguggagauuuggaccaaggagggagaaaggaagaaacuuaaaccucgguggcuagaugcucgcaucuacuccgacccccuggcauugaaagaguucaaagaguucgccgcuggcagaaagaguuuaacacugaaccucauuacugagauggggaggcugccaacguuuaugacccagaaggccaaaaaugcacuugauaaccuggcggugcuccauacagccgaagcuggaggucgggccuauaaucacgcauugagcgagcugccugagacucuagaaacccugcuccuucugacauuauuggcuaccgucacuggcgggaucuuccuguuucucaugucgggaaagggcauagguaaaaugacgcuggggaugugcugcaucauuaccgccucuauccuucugugguacgcacagauucagccgcacuggaucgccgcuuccauaauucucgaguucuuuuugaucguucuguuaauccccgaaccagagaagcaacgaacaccucaggacaaccagcuaacuuaugugguaauugcgauccugaccguggucgccgcaacaauggcuaaugaaaugggcuuccucgagaaaaccaagaaggauuuuggacuuggcagcauaacuacacagcaacccgagucaaacauucuggacaucgauuugagaccagccagugccuggacgcuguacgcaguggcuaccacuuucauuacaccuaugcuccgccauucuaucgaaaauuccagcguuaacgugucacugaccgccauagcgaaucaggcuaccguccuuauggggcucggaaaagguuggccccugaguaagauggacaucggcguaccguugcuggccauuggguguuacagccaggugaacccaaucacauuaacugcagcccuacugcuccuuguugcucacuaugcaauuaucggaccuggccugcaggccaaagcgacgagggaggcucaaaagcgggccgcagccgguauuaugaaaaaucccaccguggacgggaugacagucaucgauuuggacccaauacccuacgauccuaaguuugaaaagcagcugggccaggugaugcuccugguccuuugcgugacucagguuuuaaugaugcguaccacaugggcucugugugaggcccucaccuuggcaacuggaccgauuuccacgcugugggaaggcaaccccgggagauucuggaauacaaccaucgcugugucuauggccaacaucuuuaggggaagcuaucuagcgggcgccggucuacucuucuccauuaugaaaaacacugcaaauacccgccgggggacaggaaacacuggcgagacccuuggugagaaguggaaaaaucgacugaacgcuuugggcaagucagaauuucaaauauacaaaaagucugggauccaggagguagacagaacacuggccaaagaaggaauuaagaggggcgagacggaucaucacgcagugagucgcgggucggcuaagcuccggugguucgucgagagaaaucugguuaccccagaaggaaaaguggucgacuuaggcugcggucgugggggauggagcuauuacuguggcggucuuaagaacgugaaagagguaaagggccugacuaaagggggaccuggccaugaggaacccaucccuauguccacauauggguggaaucucgugaggcuacagucuggaguugauguguucuuuaccccacccgaaaagugcgacacucuguugugugauauuggcgagucaagcccuaacccaacagucgaggccggucggacccugcgcgugcucaaucuugucgaaaacuggcugaauaacaauacgcaauucugcaucaagguguugaaccccuacaugccguccguuauagagaaaauggaagcccugcagcgaaaguacgggggagcgcucguaagaaauccuuuaaguaggaacucuacccacgagauguauugggugagcaacgcuucaggcaauaucgucuccagugugaacaugauuagccggaugcugaucaaucgcuuuacaaugagacacaaaaaggcaacuuacgaaccagacguugaucuuggcucugggaccaggaacauuggaaucgaguccgagacacccaaucuggacauaauugguaaacgaaucgaaaagaucaagcaggagcaugaaacuucauggcacuaugaucaggaccauccuuacaaaaccugggccuaucacggcagcuacgagacaaagcaaaccgggucggcuucuaguauggugaacggagucgugcggcuacucacuaaaccaugggacguaauucccauggugacgcagauggccaugacagauaccacuccguucggccagcagcguguuuuuaaggaaaaagucgacaccagaacacaagagccuaaggaggguacgaagaaacugaugaagauaaccgcagaaugguuguggaaagagcuggggaagaaaaagacuccccgcauguguacaagggaagaguucacccggaaagugagauccaaugccgcucucggagcgaucuuuacugaugagaacaaguggaaaagcgcccgcgaagcaguggaggacucaggcuucugggaacuugucgauaaagagaggaaucugcacuuagaaggcaagugcgagacauguguuuauaacaugauggggaaacgagagaagaaacugggagaauuugguaaggcuaagggcucccgggccauuugguacaugugguugggggcaagauuccucgaguuugaagcccugggauuccuaaaugaggaccauugguuuucuagggaaaacagccuuaguggcguggagggugaggggcugcacaaacucggauacauccugcgcgauguauccaagaaagaaggcggcgcuauguaugccgacgauaccgcggggugggacacacguauuacuuuggaggaucugaagaaugaagagauggugaccaaccauauggaaggagagcacaaaaagcucgcagaggccaucuucaaacuuacguaccagaauaaagucgugcggguucagagaccaaccccuagggguacagugauggacauaaucagccgccgagaccagcggggcucugggcaagucgugacuuauggacugaacaccuucacaaacauggaagcucaguuaauuagacagauggagggcgaagguguauuuaagucaauccaacagcugacuguuaaagaggagauugccgugaagaauugguugaucagggucgggcgcgaaagacucagucggauggcaauuuccggagaugacugcguggugaaaccccuggaugacagguucgcuagcgcccuaaccgcucuuaacgauaugggcaagguccguaaggacauacagcagugggagccaucucgaggcuggaaugauuggacgcaaguucccuuuugcucgcaucacuuccacgaacugaucaugaaagacgggcgcgugcucguagugccuuguagaaaccaggaugagcugauuggacgggccaggaucucacagggugcaggcuggagcuugcgcgaaacagcgugcuuagggaaguccuacgcccagauguggagucugauguauuuucauagacgggaccucaggcuugcugccaaugcaaucuguucugcugucccaagccacuggauuccgaccucccgaacuacauggucaauacaugccacccacgaguggaugacuaccgaggauaugcugacaguguggaaccguguuuggauccaagaaaaucccuggauggaggacaaaacgccuguggaaaguugggaggaaauuccauaccuaggaaagagagaggaucaguggugcggcucucugaucggucucaccagccgcgcaacuugggccaaaaacauucagacagcgaucaaucagguccgguccuugauagggaacgaggaauauaccgacuacaugcccucaaugaagagguucagacgcgaggaagaggaagcuggagugcugugguga

SEQ ID NO: 14908 - RNA, 9876 nt, Artificial Sequence
  derived and/or modified CDS sequence (opt3) from DENV-2__KM279576__SS-prME
accgccggcaucauuauaaugaugauccccacagugauggcuuuccaccugacuacgcgaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacuguuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuuggauacuucggcauccuggauucaccaucauggcagccauucuggcuuacacaaucggcaccacguauuuucagcgcguguugauuuucauccuccugacugcaguuacaccaucuauggccaugagaugcauaggcauuucgaacagggacuuuguggaaggggucucaggagguagcuggguggauaucguacuggagcacggcaguuguguuaccacuauggcuaaaaauaagcccacacucgacuucgaauuaauuaagaccgaggccaaacaccuggcgacgcuucggaaguacugcguggaagcaaaauugaccaacacaacuaccgccucccgcuguccuacacagggggagccaucucugaaugaggaacaagauaagcgauuugucugcaaacauagcaugguggacagaggauggggcaacgguugugggcuauucggaaagggcggcaucgugacuugcgcuauguuuaccugcaagaaaaauauggaggggaaggucguucagcccgaaaaccucgaguauacaaucgugauuaccccucacuccggagaagagaaugccguagguaacgauacuggcaaacaugggaaggagauaaaagugacgccacagucaaguaucacagaagcagagcugaccggauacggcacugucaccauggaauguagcccgaggacaggucuugacuucaaugagauggugcuguugcagauggaaaacaaggcuuggcucguucaccggcaaugguuucuggauuuaccccugccuuggcucccaggggccgacacccagggcucuaacuggauucagaaagagacucuugugacauucaagaauccccacgcgaagaaacaggaugucgugguacugggaucccaagagggcgccaugcauacggcauugaccggggcuacugaaauccagaugucaagcggaaaccuacuguuuacaggucaccucaagugccgucugcgcauggacaaacuucagcugaagggcaugaguuauucuauguguaccgggaaauucaagguugugaaggagauagccgaaacacaacauggaacuauugucaucagagugcaguacgagggcgacgguuccccuugcaaaaucccauucgagauuauggauuuggaaaagaggcacguccucgggcggcugaucaccgugaaucccauuguuacggagaaagacagcccggugaacauagaagcugagccucccuuuggcgauucguacaucauuaucggaguagaaccaggccaguuaaagcugucuugguucaaaaagggguccucaaucggacagauguuugagaccacaaugcgaggugccaagcgcauggcaauucuaggcgacacugccugggauuucgggagucucggaggcgucuuuaccagcauagguaaagcucugcaucaaguguucggggcgaucuauggcgcagccuuuuccggaguuucuuggacaaugaagauucuuaucggcguggucauuacuuggaucgggaugaauagcagaucaaccaguuuguccgugagccugguacucgugggaguugucacgcuguaccuuggcgugauggugcaggcugacucugguugugucguuucauggaaaaacaaggagcugaaaugcgggaguggaauauucaucacagauaaugugcacaccuggacugaacaguauaaguuucagccugagagccccuccaaguuggccucugcaauucaaaaagcccacgaagagggcaucugugguauuaggucggugacacggcucgaaaaccugauguggaagcagaucaccccagaguuaaaucauauacugacugagaacgaaguaaaacuaaccauuaugacaggcgacaucaaggggauuaugcaggcuggaaaacgcacgcucagaccccagccuaccgagcugaaguacagcuggaaagccuggggcaaggcaaagaugcuuuccacugaauugcacaaucauacauuccugaucgaugggccagagaccgcggaaugcccgaacacaaauagggcuuggaacucacucgaggucgaggacuauggauuuggcguguucacuaccaauauauggcugaaauuaaaggaacgucaagauguauuuugugacaguaaacugaugucugccgcaaucaaggacaaccgggccgugcacgcugauauggguuacuggauugagagcgcccuuaacgacacguggaaaaucgaaaaggcauccuucauugaggucaagucaugccacuggcccaaaagccauacauuguggucuaauggggugcucgaguccgaaaugaucauaccuaagaacuucgcuggaccaguuagucagcacaauuaucgacccggcuaccauacccagacugccgguccuuggcaccugggcagacuagagauggauuuugacuucugugaagggaccacagugguagucacugaggauugcggaaacaggggcccaagccugcgcaccacaacggcgucugggaaacucauuaccgaauggugcugucgguccugcacucugcccccgcuuagauacaggggagaggacggcuguugguaugguauggagauccgcccuuugaaggaaaaagaggaaaaucuggugaacucauuagugacagccgggcauggacagaucgauaauuuuagucucggcguccuggguauggcucuuuuccuggaggaaauguugcgaacccggguuggcacuaagcacgcaauucuccugguggccguuagcuuugugacacuaaucaccgggaacaugucguuccgugaccugggaagagucauggugaugguuggcgcuacgaugacugaugacauugggaugggagugaccuaccucgcccugcuugcagcguuuaagauaaggccaacauucgccgcuggcuugcuguuacgcaaacucaccuccaaggagcugaugaugacuacaaucgguauuguccuucugucucaaagcaccauccccgagucaauucuagaacucacagaugcccuggcauuggggaugauggugcugaaaaucguucggaauauggagaaguaucaguuagcugugacuauaauggccauccucugcgucccuaacgcaguaauucugcagaaugccuggaaagugaguuguaccacgcuugcuguuguguccgucucuccccuguugcucacaagcucccaacagaaggcggacuggaucccacuggcccuaaccauuaagggacugaacccuacugcaaucuuucuuaccacacucucaagaacuagcaaaaagaggaguuggccccugaaugaagcuauaauggccgugggcaugguaucuauuuuggccuccagccugcuaaagaacgauaucccaaugaccggcccgcucguggcugggggacugcuuacggucugcuacguucugacaggucgaucggcagacuuggagcucgaacgcgccgcggacgugcggugggaggagcaggcugaaaucucaggcucuaguccuauucuguccauaaccaucagcgaggaugggucuaugagcauuaagaaugaagaggaggaacagacucuaacaauccugauuagaaccggacuucucgugaucuccggccuguuccccgucucaauaccaaucacugccgcagccugguauuugugggaggugaaaaagcaaagggcugguguuuuaugggacguacccaguccuccacccguggggaaagcagaacuggaggauggagccuaccguauuaagcagaagggcauccucggcuauagccagauuggggcgggagucuacaaagaagguacauuucacaccauguggcaugugacgcgcggcgcuguucugaugcacaaggggaaacggaucgagccuucuugggccgacgugaagaaagaucuuauauccuacggaggcgguuggaagcuggagggggaauggaaggagggagaagagguccagguguuggcacuagaaccgggcaaaaacccaagagccguacaaacuaagcccggccuguucaaaaccaacacagggaccauuggagcugucucacucgacuuuaguccugguacaagcggcuccccaaucguggauaagaaagggaagguugugggacuguauggcaauggugucgugacuaggucugggaccuacguuucggccaucgcacagacggaaaagagcauugaggacaaccccgaaaucgaggaugacauauucagaaagaagcggcuuacaauuauggauuuacauccuggagcuggcaaaacuaagcgcuaucugccggccaucgugagagaagcgauuaaaaggggccuccggaccuugauccuggcccccacacgagucguggcagcugagauggaagaggcccucagagggcugccaauacgcuaccagaccccugcuauuagggcagagcacacuggacgugaaaucguagaccuuaugugucaugccaccuucacaaugcggcuguugucacccaucagagugccaaauuauaaccuaauuaucauggaugaggcccacuuuacggacccugcuuccauugcggcaagggguuacauaaguacucgcguugaaaugggcgaggccgcugggaucuucaugaccgccacacccccaggaucucgagacccguuuccucagagcaaugcacccauuauggaugaggaaaaggagaucccagaaagauccuggaacucaggccacgagugggucaccgacuucaaggguaaaacugugugguuugugcccucuaucaaggccgggaaugauauugcugcgugccugcggaaaaacggaaagaaagucauacaacucagcaggaagacauucgacagugaauauaucaagacccgcacgaaugauugggacuuuguagugacuacagauauuuccgagaugggcgccaacuucaaagcagagcguguuaucgacccuagacgguguaugaagccagugauuuuaaccgauggcgaagagagggucauccuggcugggcccaugccugugacccauagcucugccgcacagcgccgaggaagaguuggucggaauccgaaaaacgaaaaugaccaguacauauacaugggcgagccacuugaaaacgaugaggacugcgcccacuggaaggaggcuaaaaugcugcucgacaauaucaacacucccgaagggauuaucccuucaauguuugagcccgaaagggagaagguggaugccauugacggagaauaucgcuugagaggcgaggcgaggaaaacauucgucgaucugaugcggcguggugaccucccaguguggcuggcauaccgcguagccgcugaggggaucaacuaugccgaucgaagaugguguuuugacggcgugaagaauaaccaaauacuugaagagaauguugaagucgagauuuggaccaaggagggagaaaggaaaaagcuaaaaccucgguggcuggaugcucgcacauacuccgaccccuuggcauuaaaggaguucaaagaguucgccgcuggcagaaagagucugacucucaaccugaucacggagauggggaggcuuccaaccuuuaugacacagaaggccaaaaaugcacuggauaaccucgcgguguugcauacugccgaagcuggaggucgggccuauaaucacgcacugagcgagcuaccugagacccuggaaacacuccuucuguuaaccuugcuggcuacugugacgggcgggauuuuccucuuucugaugucgggaaagggcaucgguaaaaugacccuugggaugugcugcauaaucacagccucuauucugcucugguacgcacagauccagccgcacuggauugccgcuuccaucauauuggaguucuuucugauugucuuacuaauccccgaaccagagaagcaacgaacuccucaggacaaccagcugaccuauguugugaucgcgauucucacaguaguggccgcaaccauggcuaaugaaaugggcuuccuugagaaaacuaagaaggauuuuggacugggcagcaucacaacgcagcaacccgagucaaacauauuggacauugaucugagaccagccagugccuggacccucuacgcagucgcuacuacauucaucaccccuaugcugcgccauucuauugaaaauuccagcgugaacguuucacuuaccgccaucgcgaaucaggcuacagugcucauggggcugggaaaagguuggcccuugaguaagauggacauaggcgucccgcuguuagccaucggguguuacagccagguaaacccaauuacucuaacggcagcccugcuccuucugguggcucacuaugcaaucauuggaccuggcuugcaggccaaagcgaccagggaggcucaaaagcgggccgcagccgguaucaugaaaaaucccacaguugacgggaugacugugauugaucuggacccaauccccuacgauccuaaguuugaaaagcagcucggccaggucaugcugcuuguguuaugcgucacccaggugcugaugaugcguacaaccugggcucucugugaggccuugacucuggcaacgggaccgauauccacacuaugggaaggcaaccccgggagauucuggaauaccacuauugcuguuucuauggccaacaucuuuaggggaagcuaucuggcgggcgccggucuccuuuucuccaucaugaaaaacaccgcaaauacacgccgggggacuggaaacaccggcgagacacugggugagaaguggaaaaaucgauugaacgcucugggcaagucagaauuucaaauuuacaaaaagucugggauacaggagguggacagaacgcucgccaaagaaggaaucaagaggggcgagaccgaucaucacgcaguaagucgcgggucggcuaagcugcggugguucguggagagaaauuuagucacuccagaaggaaaaguuguggaccuuggcugcggucgugggggauggagcuauuacuguggcggucugaagaacgucaaagaggugaagggccucacaaaagggggaccuggccaugaggaacccauuccuauguccaccuauggguggaaucuaguaaggcugcagucuggaguggauguuuucuuuacuccacccgaaaagugcgacacauugcugugugauaucggcgagucaagcccuaacccaaccguggaggccggucggacgcuccgcguccuuaaucugguggaaaacugguugaauaacaauacccaauucugcauuaagguccugaaccccuacaugccguccgugaucgagaaaauggaagcccuccagcgaaaguacgggggagcguuaguuagaaauccucugaguaggaacucuacacacgagauguauuggguaagcaacgcuucaggcaauauaguguccagugucaacaugaucagccggaugcuuauuaaucgcuuuacuaugagacacaaaaaggcaaccuacgaaccagacguggaucugggcucugggacaaggaacaucggaauugaguccgagacucccaaucuagacaucauagguaaacgaauugaaaagaucaagcaggagcaugaaaccucauggcacuaugaucaggaccauccuuacaaaacaugggccuaucacggcagcuacgagaccaagcaaacugggucggcuucuaguaugguuaacggagugguccggcuccugacgaaaccaugggacgugauccccaugguaacacagauggccaugaccgauacuaccccguucggccagcagcguguguuuaaggaaaaaguugacacaagaacgcaagagccuaaggaggguaccaagaaauugaugaagauuacugcagaauggcuguggaaagagcucgggaagaaaaagacaccccgcauguguaccagggaagaguucacucggaaagucagauccaaugccgcucuuggagcgauauuuacagaugagaacaaguggaaaagcgcccgcgaagcaguggaggacucaggcuucugggaacugguggauaaagagaggaauuuacaccuggaaggcaagugcgagaccugugucuauaacaugauggggaaacgagagaagaaauugggagaauuugguaaggcuaagggcucccgggccaucugguacauguggcucggggcaagauuccuggaguuugaagcccuaggauuccuuaaugaggaccauugguuuucuagggaaaacagccugaguggcguugagggugaggggcuccacaaacugggauacauuuugcgcgauguguccaagaaagaaggcggcgcuauguaugccgacgauacagcggggugggacacucguaucacccuggaggaucucaagaaugaagagaugguaacgaaccauauggaaggagagcacaagaaacuugcagaggccauuuucaaacugaccuaccagaauaaagugguccgggugcagagaccaacaccuagggguacuguuauggacaucauaagccgccgagaccagcggggcucugggcaaguggucaccuauggauuaaacacauucacuaacauggaagcucagcugaucagacagauggagggcgaagguguguuuaagucaauucaacaguugaccguaaaagaggagaucgccguuaagaauuggcucauuaggguggggcgcgaaagacugagucggauggcaaucuccggagaugacugcgucgugaaaccccuagaugacagguucgcuagcgcccuuacggcucugaacgauaugggcaaggugcguaaggacauucagcagugggagccaucucgaggcuggaaugauuggacacaaguccccuuuugcucgcaucacuuccacgaacucauaaugaaagacgggcgcguucuggugguaccuuguagaaaccaggaugaguugaucggacgggccaggauuucacagggugcaggcuggagcuuacgcgaaaccgcgugccuggggaaguccuacgcccagauguggagucucauguauuuucauagacgggaccuuaggcuggcugccaaugcaaucuguucugcugugccaagccacuggaucccgacuucccgaacaaccuggucaauucaugccacucacgaguggaugaccacagaggauaugcuaacggucuggaaccguguguggauacaagaaaaucccuggauggaggacaaaaccccuguugaaaguugggaggaaaucccauaccugggaaagagagaggaucaguggugcggcucucucauugguuugacuagccgcgcaacaugggccaaaaacauccagaccgcgauuaaucaggugcggucccugaucgggaacgaggaauauacugacuacaugcccucaaugaagagguucagacgcgaggaagaggaagcuggaguccuuugguga

SEQ ID NO: 14909 - RNA, 9876 nt, Artificial Sequence
  derived and/or modified CDS sequence (opt3) from DENV-2__KC964095__SS-prME
agcgcaggaaugaucauuaugcugauacccaccgugauggcuuuccaccucacaacucggaauggggagccucauaugaucgucuccauucaggaaaagggaaaaucucuucuguuuaagacggaggacgguguuaauaugugcaccuugauggcaauggauuuaggcgaacugugugaggacacaaucacuuacaaaugcccacuacucaggcaaaaugaaccggaggauauugaccggugguguaauucaaccaguacaugggugaccuaugggacuugcacaaccacgggagagcaccgccgagaaaagcguagcguagcccuggugccccaugucggcaugggucuugagacuagaaccgaaacauggauguccucugagggggcguggaaacacgcucagaggaucgagacuuggauucugcggcauccuggauucaccaucauggccgcaauuuuggccuacacaaucggcaccacgcacuuucagcgcgcucucauuuucauccugcugacugcaguggccccacccaugacaaugagauguauaggcauuucgaacagggauuuuguugaaggggugucaggagguagcugggucgacaucgugcucgagcacggcaguugcguaaccacuauggcuaagaauaagccuacauuagauuucgaacugauuaaaaccgaggccaagcagccagcgacgcuucggaaauauuguaucgaagcaaaguugaccaacacaacuaccgagucccgcugccccacacaaggggagccuucucugaaagaggaacaggacaagcgauuuguuuguaagcauagcaucguggauagaggauggggcaaugguugcggguccuucggaaaaggcggcauugucacuugugccauguuuaccugcaagaaaaacauggaagggaagauagugcagccagagaaucuagaauacacaaucguggucaccccgcacucaggagaggagcaugcuauugguaacgacacuggcaaacacgggaaggaaaucaaaguuacgccccagaguagcgugacagaggccgaacucaccggauauggcacuguaaccauagagugcucuccuaggacaggucuggauuucaaugaaauggugcuucugcaaauggggaacaaggcaugguugguccaccggcagugguuucucgaccugccauuacccuggcugccuggcgcugauacccagggauccaauuggauucagaaggagacucucgugacauucaaaaacccacaugccaagaaacaagacguugugguccuuggcucacaggagggggcgaugcacacggcccugaccggagcaacugaaauccagaugagcagugguaauuugcuauuuacaggccaucugaagugugggcuccguauggacaaacugcaacuuaagggaaugucuuacuccaugugcaccggcaaguucaaagugguaaaggagaucgcugaaacacagcacgguacuauuguuauccgcgugcaguaugagggggauggcagccccuguaaaauuccguucgagauaauggaccuggaaaagagauacgucuugggaaggcucaucaccgugaacccuauugucacggagaaagauucgcccgugaacaucgaagccgagccaccuuuuggcgacucuuacaucauuauagggguugaacccggacagcugaaguuaaauugguucaagaaagguuccucaaucggccaaauguuugagaccacaaugagaggggcuaagcgaauggccauucugggagauacugcaugggacuucggcagucuaggugggguguuuaccagcaucggcaaagcccuccaucagguauucggagcuauuuauggcgcggcauuuuccggggucucuuggacaaugaagauccugauaggagugaucauuacuuggaucggcaugaacagccgcucaaccagucuuuccguuagcuuggugcuggucgguauugugacgcucuaccuggggguaauggugcaggccgauucuggaugcguugucucauggaaaaauaaggagcuuaaguguggcagugguaucuucauaacagacaacgugagaaccuggacugaacaguauaaauuucaaccagagagccccuccaagcuggcuucugccauucagaaagcacaggaagagggcaucugcgggauuaggucggugacacgguuggaaaaucucauguggaagcagaucaccccugagcugaaccacauauuagccgagaaugaagucaaacugacuaucaugaccggagauauuaagggcacaaugcaagcugggaaacgcagccuaagaccacagccgacggagcucaaguacuccuggaagaccuggggaaaagccaagaugcugucaacugaaagucacaaccagacauuccuuaucgacggccccgagaccgcagaauguccuaauacaaacagggcguggaacucuuuggagguugaggauuaugguuuugggauguucacuaccaacauuuggcugcagcucaaagaaaagcaagacgcuuuuugcgacagcaaacugauguccgccgcaaucaaggauaaucgugccgugcaugcugacaugggauacuggauagagucagccuuaaacgauacguggaagauugaaaaagcgagcuucaucgaggugaagaauugucacuggccaaaaucucauacacugugguccaacggcguacuugagagugaaaugaucauucccaagaacuuggcugguccugucagccagcacaauuaucggccaggcuaccacacccagaucgccgggcccuggcaucaaggaaaaccggagauggacuucgauuuuugcgacggcacuaccgugguugugacagaagauugugggaaccgaggaccuucucucagaacuaccacagcguccggcaagcugauuacggaguggugcugcaggucauguacccuaccaccccugcgcuaccggggugaagacgggugcugguauggaauggagauaagaccucucaaggagaaagaagagaaucuggucaacagucuugugacugccggccacggucagaucgauaauuucagcuugggcguucuggggauggcuuuauuucucgaagagaugcugaggacacgcgugggaaccaagcaugcaauucuucugguagccgucucguucgugacuuugaucacaggcaacauguccuuuaaagaccucgggcgaguggucguuauggugggagcuaccaugacggaugacauuggcauggguguaacuuaccuggcccuacuggcagcguucaaggugcggcccaccuuugccgcugggcuccugcuucguaaauugacaucuaaggaacugaugaugaccacuaucggaauagucuuacucagccagucaacaaucccagagaccgugcuggagcuuacagaugcccuggcacuaggcaugauggcucucaagauuguuagagacauggaaaaauaucagcuggccgugacuaucauggcaauuuugugugucccuaaugccgugauccugcaaaacgcuuggaagguuaguugcaccauauuagcgguggucuccguaucuccccuccugcuuacgagcucccagcagaaaacagacuggauuccacuggccuugaccaucaagggccucaauccgacugcaaucuuccugaccacacuaucaaggacuaacaaaaagcgcagcuggccucugaaugaggcuauuauggccguggggaugguuaguauacuugccucuucccuccugaaaaacgauauccccaugaccggaccauugguggcugguggccuguuaacggucuguuacgugcucacagggcggagcgcagaccuggaacuugagagagccaccgauguaaauugggaagaccaggcggagauuucgggaucaucucccauccugaguauuacuaucuccgaggauggcagcaugucuauaaagaacgaagaggaggaacaaacauugaccauccucauuaggacuggucugcuagugaucagcgggcuguuuccugucuccauuccaaucacagcugccgcaugguaucuuugggagguuaagaaacagcgagccggagugcucugggacgugcccucaccuccgccaaugggcaaggcugaacuggaggauggcgcauaccgcauaaaacagaagggggucuugggauauagucagauuggugccggcguguacaaagaagggaccuuccacacgauguggcauguuacucggggagcgguauuaaugcacaagggcaagagaaucgagcccagcugggcugacgugaaaaaggaucugaucucuuacggugggggauggaaacucggcggcgaauggaaggagggggaggaaguccaagugcuggcccuugagccuggcaagaauccaagggcaguucagaccaagcccggucuguuuaagacaaacaccggcacaauuggggccguguccuuggacuucucaccuggaacaaguggcagcccgaucauagauaaaaaggguaaagucgaagggcuauauggaaacggcgugguaacccguuccggcacguacgucucugcuauugcccagacagagaagucgaucgaagacaaucccgagauugaggaugacaucuuucgcaaaaagcggcugacuauaauggaccuccacccaggggcaggaaagaccaaaagauaucugccugcuauugugagggaagccaucaagcgaggucuucggacauuaauccuggcgcccacccgcguuguggccgcagagauggaagaggcucucagaggcuugccaauuagguaccaaacuccugccauccgggcugaacauaccgggcgagagauugucgaucugaugugccacgcaacauucacgaugagacuccugagccccgugcgcguuccaaacuauaaucuuauaaucauggacgaggcccauuucacugauccggccucaauugcugcgaggggauacaucuccacccguguggaaaugggcgaggcagccgguaucuuuaugacagcuaccccucccgggagucgggacccauucccccagucuaacgccccuauuauagaugaagagagagagaucccagaaaggagcuggaacuccggacacgagugggucacugacuuuaaaggcaagacagugugguucguacccucaauuaaagcaggcaacgauaucgccgcuugucugcgcaagaaugggaagaaagugauucaguugucucgaaagaccuuugacagcgaauauguuaaaacgagaacuaacgauugggacuucgucgugacaaccgauaucagugagaugggagcgaauuuuaaggccgaacgggugauagacccuaggcgcugcaugaaaccggucauccuaaccgacggugaggagcguguaauucuggcaggcccaaugcccgugacucauuccagcgcugcccagagacgggggaggaucggacgcaacccuaagaaugaaaacgaucaauacauuuacaugggcgagccccucgaaaaugacgaggauugugcacacuggaaagaagccaagauguuacuggacaacaucaauacaccagaggguauaauuccuucuauguucgagcccgaacgagagaagguugaugcuaucgacggggaauauagacuucggggcgaggccaggaaaaccuuuguggaucugaugcgcagaggagaccucccagucugguuggcguacaagguggcagccgaaggcauuaacuaugcugauaggcgguggugcuucgacgggaucaaaaacaaucagauacuggaggagaacguugaaguggagaucuggacaaaggaaggagagcguaaaaagcucaagccucgcuggcuggaugcccgaauuuacucagacccgcuugcucuaaaagaguuuaaggaguucgcagccgguagaaaaucccugacuuugaauuuaaucacggagaugggcaggcugcccaccuucaugacacagaagacucgggaugcucucgacaaccuggccguccuucacaccgcagaagcaggcgggcgcgccuauaaucaugcucugagugagcucccagaaacauuggagacccugcuacugcucacucuucuggccacggugaccggggguauauuuuuauucuugaugagcgggagaggcaucggaaaaaugacacugggcauguguugcauaauuacugcaucgauccuccugugguacgcucagauccaaccucacuggauugccgcaucuaucauacuugaguuuuuccugauuguacucuugauccccgaaccagagaagcagaggaccccucaggacaaccagcugacauaugugguuauugccaucuuaaccgucguggcugcgacuauggccaaugaaaugggguuucuagagaagacuaaaaaggaucugggacucgguuccauaacgacccaacagcccgaaagcaacauccuugacauugaucugccgccagcaucagcuuggacuuuguacgccguggccacaaccuucgucaccccuaugcugcggcauaguaucgaaaauucuuccguuaacgugagccucacagcaauugcuaaucaggccacuguacugaugggccuugggaaaggauggccccucucaaagauggacaucggcgugccacuguuggcgauugguugcuacagucaggucaaccccaucacgcugaccgcugccuuacuacugcucguggcacacuaugccauaauugggccuggccuucaagcuaaagcaacacgagaggcccagaagagagcggcugccggaaucaugaagaauccgacuguugauggcaucaccgugauugaccuggaucccauaccauacgacccuaaauuugaaaagcaguuggggcaagucaugcugcucguacugugugugacacagguucuuaugaugcgcaccacuugggcauuaugcgaggcccugacgcucgcuacaggacccaucagcaccuugugggaaggcaacccugguagguucuggaauacuaccauugccguguccauggcaaacaucuuucgggggucuuaucuggcuggagccggccuacuguucagcauuaugaaaaauacaacuaacacccguagagguacaggcaacaucggggagacgcucggagaaaaguggaaauccaggcuuaaugcgcugggcaagucagaguuucagauauacaaaaagucugggauccaggaggucgaucgcaccuuggccaaggaaggaauuaaacggggcgagacugaccaccaugcagugagucgagguucggcuaagcugagaugguucgucgaaaggaacauggugacaccagaggggaaaguuguggaucucggauguggccgcgguggcuggagcuauuacugcgggggacugaagaauguacgggaggugaaaggcuuaaccaaagggggacccggccacgaggaaccuaucccaauguccacuuaugguuggaaccuugucagacugcaaucugggguugacguguuuuucauucccccggaaaagugugauacacuccuaugcgacaucggagaguggucaccuaauccaaccgucgaagccggccguacgcugaggguguugaaccugguagagaauuggcucaacaauaacacccaguucuguauaaaagugcuuaaucccuacaugccuagcguuauugagaagauggaaacacugcagcggaaauacggcggggcauuggugcgcaacccacugucccgaaauaguacucaugagauguauugggucucuaacgcuagcggaaauaucgugucauccgucaacaugaucaguagaaugcucauuaacagguuuaccaugcggcacaagaaagccacauacgaacccgacguggauuuagguagcggcacucgcaauauagggaucgagucugaaaccccgaaccuggacauuaucggaaagagaauuggcaagaucaaacaggagcaugagacauccuggcacuaugaucaagaccacccuuacaagaccugggccuaucaugguucauacgaaacuaaacagacggggagcgcgucgucuaugguugauggaguagugaggcuucugacaaagcccugggacgucauaccaauggugacccagauggcuaugacugauaccacaccuuucggccagcaacgaguuuuuaaagagaagguggacacgcggacccaggaacccaaggagggcacuaaaaagcuaaugaaaaucacagcagaauggcucuggaaggagcuggggaaaaaggagaccccacguaugugcacuagagaagaguucacacgcaaagucaggaguaaugccgcuuugggagccauuuuuaccgaugaaaacaaguggaaguccgcacgggaggccguggaggacagcgguuucugggaacugguagauaaagagagaaaucuccaccuugaaggcaagugugagacaugcguguauaacaugauggggaaacgcgaaaagaaacugggagaguuuggcaaggcuaaggguucaagggcgaucugguacaugugguuaggggcccgauuccuggaguuugaagcauugggauuccucaaugaggaccauugguuuucccgggaaaacucucugagcggcguugagggcgaagggcuacacaaacuuggauacauucugagagacgucaguaagaaagaggguggcgcuauguaugccgaugacacugcagggugggauaccaggaucacgcucgaggaccugaagaaugaagagauggugaccaaccacauggaaggagagcauaaaaaguuggccgaagcuauuuucaagcugacauaccagaauaaagugguccgcguucaacgucccccuccacggggcacugugauggauauaaucuccagaagggaccagcgcgguagcgggcagguagugaccuauggacucaacacauuuacuaauauggaggcccagcuuauucgacaaauggagggcgaaggcgucuucaagaacauccagcaccugaccgugacggaggaaaucgcgguucagaauugguuagcacggguggggagagagaggcugucucgcauggccauuucaggagaugacugugucgugaaaccguuggaugacagauucgcuagugcccucacagcacugaacgauguagguaagauacggaaagacauccagcaaugggagcccuccaggggcugggaugacuggacccagguuccuuuuugcagccaucacucucaugaacuaauuaugaaggacgggcgugugcuugucgugccaugccgaaaccaggaugagcugaucggacgcgcuagaauuucgcagggcgccgguuggucacuccgggaaacugcuugucugggaaagagcuacgcccaaaugugguccuugauguauuuccacaggcgcgacuuaagacuggcagcgaaugccaucugcagugcugugcccucucacugggucccuacaagccggaccacuugguccauacaugccaaacacgaguggaugaccacagaagauaugcucacgguuuggaacaggguguggauccaggagaauccauggauggaggacaagacccccguagaaucaugggaggaaauuccuuaccuuggaaaacgagagggccagugguguggcagucugaucgggcuaacuucucgugcaacaugggcuaagaacauucagaccgccaucaaucaagugagaagccugauaggaaacgaagaguauacugauuacaugccguccaugaaacgcuuucggagggaggaagaggaagccgguguccucugguga

SEQ ID NO: 14910 - RNA, 9876 nt, Artificial Sequence
  derived and/or modified CDS sequence (opt3) from DENV-2__KC964094__SS-prME
agcgcaggaaugaucauuaugcugauacccaccgugauggcuuuccaccucaccacucgaaacggggaaccucauaugaucgucuccauucaagaaaagggaaaaucucuucuguuuaagacggaggacgguguuaauaugugcaccuugauggcaauggauuuaggcgaacugugugaggacacaaucacuuacaaaugcccauuacucaggcaaaacgaaccggaggauauugacuguuggugcaauucaaccaguacaugggugaccuaugggacuuguacaaccacgggagagcaccggcgcgaaaagcgaagcguagcccuggugccccaugucggcaugggucuugagacucguaccgaaacauggauguccucugagggggcguggaaacacgcucagagaaucgagacuugggugcugaggcauccuggauucaccauaauggccgcaaucuuggccuacacaauuggcaccacguauuuucagcggguucucaucuucauucugcugacugcuguggcaccaucgaugacaaugcgcucaaucggcauaagcaacagagauuuugucgaaggggugaguggagguuccuggguagacguugugcucgagcacggcucuugcgucaccacuauggccaagaauaagcccacauuagauuucgaacugaccaaaacggaggcuaagcacccugccacccuuaggaaauacuguauugaagcgaaguugacaaacacuaccacagcaagccggugcccaacucagggggagcccucccugaaugaggaacaagacaaacgcuuuguguguaagcauucaaugguggaucgaggauggggcaacgguugcgggcuauucggaaagggcggcaucgucaccugugccauguuuacaugcaaaaagaauauggaggggaaaguugugcagccugaaaaccucgaguauaccauuguaaucacuccacacaguggagaagagaaugcuguggguaacgacacgggcaagcaugggaaagagaucaaggucacaccgcagagcucugugaccgaagccgagcugacuggauacggcaccguuacaauggaaugcucccccagaaccggucuugauuucaaugagauggugcuguugcagaugaaaaacaaggcauggcucguccacaggcaaugguuucuggacuuaccucugccauggcuccccggggcugauacucagggcucaaauuggauucagaaggaaacacuugugacguucaaaaacccucacgccaagaaacaggacguaguugugcugggaagccaagagggcgcgaugcauaccgccuugacuggggcaacagagauacagaugaguucuggaaaccuacuguuuaccggucaccucaagugucggcugcguacagacaaacuucagcugaagggcauguccuauagcaugugcacugggaaguucaaagucgugaaggaaaucgcugagacccaacauggaacgauugucauccgcgugcaguacgaaggcgaugguucgccauguaaaauacccuucgagauuauggacuuggagaagagacacguucucgggaggcugaucaccgugaauccgaucguaacagaaaaagauucuccugucaacauugaggccgaacccccauuuggcgacuccuacaucauuauaggaguggagccuggccaguuaaagcugucaugguucaagaaagaaaguagcaucgggcagauguuugagacuaccaugcggggagcuaagcgaauggccauucuaggugauacagcaugggacuucggcucccucgggggaguuuuuacuucuaucggcaaagcccugcaucaaguguucggugcuaucuauggggcggcauuuagcggcgucucauggaccaugaagauucuuauaggagugguaaucacguggauuggcaugaauagucgcuccaccucauugucugugucacugguucucgucgggguggugacccuguaccuuggagucaugguucaggccgauaguggcugcguggugagcuggaaaaacaaggagcugaagugugguuccgggaucuucguaacugacaauguccacacauggaccgaacaguauaaauuucagcccgagucuccaucgaaguuggcuagcgccauucaaaaagcacacgaagagggaaucugcggcauaagauccgugacuaggcucgaaaaccugauguggaagcagaucacccccgaguuaaaucauauucugucagagaacgaaguuaaacuaacaaucaugacgggugauauuaagggcaucaugcaggccgggaaacggagucuccgcccucagccaaccgagcugaaguacucuuggaaggcuuggggaaaagccaagaugcuuagcacugaauugcacaaucauacauuccugauagacggcccggagaccgcagaaagacccaacacaaauagggcguggaacucccucgagguggaggauuauggguuuggagucuucacuaccaauauuuggcugaaauuaaaggaacgucaagacguguuuugugacucaaaacugaugagcgcugccaucaaggauaaccgggcaguucacgccgacaugggcuacuggauugagucugcucuuaaugauacguggaagaucgaaaaagccuccuucauagaggugaagaguugccacuggccuaaaagccauacauuguggucuaacgguguacucgaguccgaaaugaucauuccaaagaacuucgcagggcccgucucacagcacaauuaucgaccuggauaccauacccagacugcuggcccauggcaccuggguagacuagagauggacuuugauuucugugaaggcaccacagugguggucacugaggacugcgggaacaggggacccagucugcgcaccacaacggccagcggcaaacucaucaccgaaugguguugccggucgugcacucugccgccucuuagauacagaggggaagauggauguugguauggcauggagauucgcccauugaaggaaaaggaggaaaaucugguuaacuccuuagugacagcgggucaugggcagaucgacaauuuuucucucggaguacugggcauggcccuuuuccuggaggaaauguugcgaacccggguggguacuaaacacgcuauacuccuggucgcagugagcuuuguuacacuaauuaccggcaacaugucauuccgugaucuggggagagugauggucauggugggagccacgaugacugacgauaucggcauggggguuaccuaccucgcucugcuugccgcauuuaaggugaggcccacauucgcggccggauugcuguuacgcaaacucaccaguaaggagcugaugaugacuacaaucggcauuguccuucugucccaaucuaccaucccugagacaauucuagaacucacugacgcucuggccuuggguaugaugguacugaaaauagugcggaauauggagaaguaucaguuagcaguuaccaucauggcuauucucugcgugcccaacgccgucauccugcagaaugcauggaaggugagcuguacgacacuugccguaguguccgucucaccacuguugcucaccagcagucaacagaaagcugauuggauuccucuggcgcuaacuaucaaggggcugaaccccaccgccauauuucuuacaacucucucuagaaccuccaaaaagaggagcuggccacugaaugaagcaaucauggcuguuggaauggugucgauuuuggccucaucucugcuaaagaacgacaucccgaugacgggcccucucguggccggcgggcugcuuacagucugcuacgugcuggcuggacgaagugcagacuuggagcucgaacgcgccgcggauguucggugggaggagcaggcugaaauuuccgguagcucucccauccugagcauaaccauuuccgaggacggcgggaugucaaucaagaaugaagaggaggaacagacucuaacaauccugauuagaaccggacuucucguaauaaguggccuguucccagugagcauccccauuacugccgcagccugguauuugugggaggucaaaaagcaaagggcugguguguuaugggauguuccuucuccacccccuguggggaaggcagaacuggaggacggagccuaccguaucaaacagaagggcauucucggcuauucccagaucggggcgggagucuacaaagaagguacauuucacaccauguggcaugugacgcgcggcgcuguacugaugcacaaggggaaacggauagagccgucaugggccgaugucaagaaggaccuuaucaguuacggaggcgguuggaaacuggagggggaauggaaggagggagaagagauucagguguuggcacuagaaccaggcaaaaaccccagagccguucaaacuaagccuggccuguucaaaaccaauacagggaccaucggagcugugagccucgauuuuuccccagguacaucuggcucgcccauugucgacaagaaggggaaagugguuggacuguauggcaacgguguggucacuaggagcgggaccuacgugucagccaucgcacagacggagaaguccauagaggauaacccugaaauugaggacgauacauucaggaaaaagcggcuuacuaucauggacuuacauccgggagcuggcaaaaccaagcgcuaucugcccgccaucguaagagaagcgauuaagaggggccuccggacauugauccuggccccaacccgagugguugcagcugagauggaagaggcccucagagggcugccuauacgcuaccagacucccgcuauuagggcagagcacaccggacgugaaaucgucgaucuuaugugucaugccacauucacgaugcggcuguugaguccaauuagagugccuaauuauaaccuaaucauaauggacgaggcccacuuuacugaccccgcuucuauugcggcaagggguuacaucagcacccgcguggaaaugggcgaggccgcugggaucuucaugacagccaccccaccgggaucccgagauccuuuuccccagucaaaugcaccaauuauggacgaggaaagagagauccccgaacggucuuggaacagcggccacgagugggucacugauuucaaagguaagacaguaugguuugugccuaguauuaaagccgggaaugacauagcugcgugccugaggaagaacggacgcaaaguuauccaacucucccguaagaccagcgauucugaauauauuaagacgagaacuaaugacugggauuucguggucacaaccgacaucucagagaugggcgccaacuuuaaagcagagcgggugaucgauccaaggcgcuguaugaagcccguuauuuuaaccgacggcgaagaacgagugauacuggcugggccuaugccggucacucauuccagugccgcacagagacggggaagggugggucgcaaucccaaaaacgaaaaugaucaguacaucuacaugggcgagccccuugaaaacgacgaggacugcgcccacuggaaggaggcuaaaaugcugcucgauaauauuaacacaccugaagggaucauucccagcauguucgagccagaaagagagaagguagacgccaucgauggagaauauagguugcggggcgaggcgcguaaaaccuuuguggaccugaugcgccgaggugaucucccuguuuggcuggcauacagagucgccgcugaggggauaaauuaugccgacaggcggugguguuucgauggcgugaagaacaaccaaauccuugaagagaauguggaagucgagauuuggacaaaggagggagaacgcaaaaagcuaaaacccagauggcuggacgcuaggaucuacucggauccauuggcauuaaaggaguuuaaagaguucgccgcuggccggaagucucugacucucaaccugauuacggagauggggcgacuuccuaccuucaugacacagaaggccagaaaugcacuggacaaccucgcgguuuugcauacugccgaagcuggaggucgcgccuauaaucacgcacuguccgagcuaccggagacccuggaaacacuccuucuguuaaccuugcuggcuacugugacgggcgggaucuuucucuuccugaugagcggaaaaggcauagguaagaugacccuugggaugugcuguauuaucacagccucaauucugcucugguacgcacagauccagccccacuggauagccgcuaguaucauuuuggaguuuuuccugaucguauuacuaauuccagaaccugagaaacaaaggacuccccaggauaaccagcugaccuauguggucaucgcgauacucacagugguugccgcaaccauggcuaaugaaaugggcuuucuugagaagacuaaaaaggacuucggacugggcucuauugccacacagcaaccagaguccaacaucuuggauaucgaccugcggccugccagcgcauggacgcucuacgcuguggccaccacuuuuauuacacccaugcugcgucauucaaucgaaaauaguagcgucaacguaucccuuaccgcgauagcuaaucaggccaccgugcucauggggcugggaaaggguuggccguugucuaaaauggacauuggcguuccacuguuagcaaucgggugcuacagccaggugaacccuauuacacuaacugccgcucugcuccuucuggucgcacacuaugccaucauaggacccggcuugcaggcgaaggcuacgagagaggcccagaaaagggcagccgcugguaucaugaagaauccaaccguggaugggauuacagucaucgaccuggaucccauuccuuacgacccgaaauucgaaaagcagcucggccaggugaugcugcuuguuuuaugcgugacucagguacugaugaugcgcaccacaugggcccucugugaggcauugacccuggcuacuggacccaucuccacgcuaugggaaggcaacccagggcgguuuuggaauacaaccauugccgugucaauggcgaacaucuuccgaggaucuuaucuggccggcgcaggucuccuuuuuaguauaaugaagaauacugcuaacaccagaagggggacaggaaacacuggcgagacccugggugagaaauggaagaaucgcuugaacgcccugggcaaaucggaguuccaaauuuacaagaaaagcgggauccaggaggucgaucggacacucgcaaaggaaggaaucaaaagaggcgagacggaccaucacgcuguuucccgugggucugccaagcugaggugguuuguggagcggaauuuagucaccccugaaggaaaggugguagaucuuggcugcggucgcgggggauggucauauuacuguggcggucugaaaaacgugaaggagguuaaaggccucacuaaagggggacccggccaugaagaaccuauuccaaugagcacauauggguggaaucuagugcgacugcaguccggagucgacguguucuucacaccaccugaaaaaugcgauacuuugcugugugacauaggcgagaguucuccaaaccccacagucgaggccgguagaacccucagggugcuuaaucugguugaaaacugguugaauaacaauacgcaauuuugcaucaagguacugaacccguacaugccuagcgugauugagaagauggaagcgcuccagcggaaauacgggggagcuuuagucggcaauccacugucacgcaacuccacccacgagauguauugggcaaguaaugccagcggcaacaucgugucuuccguuaacaugauuucaagaaugcuuaucaauagguucacaaugcgacacaagaaagcuacuuacgaacccgauguggaccuggggagcggaacccggcauauagguaucgagucggagacaccuaaccuagauauuaucggcaagcguauugagaaaaucaagcaggagcacgaaacuucuuggcauugugaccaggaccacccauauaagaccugggccuaccacgggaguuaugaggcaaaacaaacaggauccgccagcucaauggucaauggcgugguaagacuccugaccaagcccugggaugugauaccgaugguuacucagauggcuaugacggacacaaccccuuuuggucagcagcgcgucuucaaagaaaagguggauacuaggacccaagagcccaaagaggggacaaagaaguugaugaaaauuacggcggaauggcuguggaaggagcucggcaaaaagaaagccccacggaugugcaccagagaagaguuuacucgcaaggugagguccaacgcagcucuuggcgccauguucacagacgagaauaaauggaagucugcacgagaagccgucgaggauagcggcuuuugggaacugguugacaaggagcggaacuuacaucuggaagggaaaugugagaccugcguguacaauaugaugggaaagagagagaaaaaguugggugaguucggcaaagcuaaggggaguagggccaucugguauauguggcucggagcgcgcuuucuggaguucgaagcacuaggcuuucuuaacgaggaucacugguucucccgugaaaauagccugucugguguagagggggagggacuccauaagcugggcuacaucuugcgggacgugagcaaaaaggaaggcggggccauguacgcugaugacacugccggaugggauacaagaauuacccuggaggaccucaaaaacgaagagauggucacaaaucacauggaaggugagcauaagaaacuugcagaggcuauauuuaagcugacuuaucagaacaaggugguuagggugcagcgcccuacaccccgaggcacggucauggacaucauuagucggagagaucagaggggguccggacaagugguaaccuacggcuuaaauacauucacuaacauggaagcccagcugauccgccagauggagggugaagggguuuucaaaagcauucaacacuugaccgugacagaggagaucgcugucaagaauuggcucgugagagugggacgggaaaggcugucucguauggccauaucgggcgacgauugugucguuaaaccacuagacgaucgauuugcaucagcgcuuacugcccugaacgacaugggcaaggugcgcaaagauauccagcagugggagcccagcagaggguggaacgacuggacccagguaccuuucugcucccaccauuuucacgaacucauuaugaaggauggacgggugcuggucgugccaugcaggaaucaagacgaguugaucggucgcgcuagaauuagucagggcgccggguggucuuuacgggaaacggcaugucugggaaagagcuaugcucagauguggucccucauguacuuccauaggcgagaucuucgucuggccgcaaacgccaucugcucagcgguuccgagucacugggugcccacaucuagaaccacuuggagcauucacgcuacacaugaguggaugaccacugaggacaugcuaaccgucuggaaucgcguguggauacaggaaaacccuuggauggaggauaaaacaccaguagaauccugggaggaaauccccuaucugggcaagcgggaggaccaauggugugguucacucauuggguugacgagcagggccaccugggccaaaaauauccagacugccaucaaccagguuagaucucugauuggaaaugaggaauacacagacuauaugccuuccaugaagcgcuuucggagggaggaagaggaagcuggcgugcuuugguga

SEQ ID NO: 14911 - RNA, 9876 nt, Artificial Sequence
  derived and/or modified CDS sequence (opt3) from DENV-2__KC964093__SS-prME
accgcaggcgugaucauuaugaugauacccacaguaguugcuuuccaccugacuacgcggaauggggaaccucauaugaucgugagcaggcaggaaaagggaaaaucccuccuuuuuaagaccgagaaugguguaaacaugugcacacugauggcaauggacuugggcgaauuaugugaggauacuauuaccuacaauugcccacugcuucggcaaaacgaaccggaggacaucgauuguuggugcaauucuacaucaaccugggugacuuaugggacauguaccgccacgggagagcaccgccgagaaaaacguagugucgcgcucgugccccauguuggcaugggucuggagacuagaaccgaaacauggaugagcuccgagggggcuuggaagcacgcccagaggauugagacuugggugcuucggcauccuggauucaccaucauggcagccauacuggcuuacacaaucggcaccacguauuuucagcgcgucuugauuuucauccuccugacugcaguggccccaucuaugacaaugagaugcauuggcaucucgaacagggacuuuguagaagggguuucaggagguagcuggguggauauaguccuggagcacggcaguugugugaccacuauggcuaaaaauaagcccacacucgacuucgaauuaaccaagacggaggccaaacacccugcgacccugcggaaguacugcauugaagcaaaacuuacaaacacuaccacagccucccgcuguccaacucagggggagcccucuuugaaugaggaacaagauaagcgauuugugugcaaacauagcauggucgacagaggauggggcaacgguugugggcuguucggaaagggcggcaucguuaccugcgcuauguuuacaugcaagaaaaauauggaggggaaggugguacagccugaaaaccuagaguauaccauugugaucacuccacacuccggagaagagaaugucguggguaacgauacgggcaaacaugggaaggagaucaaaguuacaccgcagucaaguauuaccgaagccgagcucacuggauacggcaccgugacaauggaauguagccccaggaccggucuggacuucaaugagaugguccuucugcagauggaagauaaggcaugguuggugcaccggcaaugguuucucgaccugccuuuaccauggcugcccggggcugauacucagggcucuaacuggauacagaaagagacacucguaacguucaagaacccucacgccaagaaacaggacguugugguccuuggaucccaagagggcgcgaugcauaccgcccugacuggggcaacagaaauccagaugucaagcggaaauuugcuauuuaccggucaccugaagugccgucuccgcauggacaaacugcagcuuaagggcaugaguuauucuauguguacagggaaauucaaggcugugaaggagauugccgaaacucaacauggaaccaucgucauaagagugcaguacgagggcgaugguuccccaugcaaaauucccuucgagaucauggaccuggaaaagaggcacguuuuggggcggcucaucacggugaacccgauuguaaccgagaaagauagcccugucaauaucgaagcugagcccccauuuggcgacucguacauuauaaucggaguggaaccuggccagcugaaguuaucuugguucaaaaagggguccucaauuggacagauguuugagacaacuaugcgaggugccaagcgcauggcaauccugggcgauaccgccugggacuucgggagucuaggaggcguuuuuacaagcaucgguaaagcucuccaucaaguguucggggcgauuuauggcgcagccuuuuccggagucucuuggacuaugaagauacugaucggcgugguaauuaccuggaucgggaugaacagcagaucaacgagucuuuccgugagcuugguucuggucggaguggugacacucuaccugggcgucaugguucaggcugauucugguuguguggugucauggaaaaauaaggagcuuaaaugcgggaguggaauuuucaucaccgacaacguacacacuuggacagaacaguauaaguuucagcccgagagcccauccaagcuggccucugcaauacaaaaagcccacgaagagggcaucugugguauuaggucggucacccgguuggaaaaucucauguggaagcagaucacucccgagcugaaccauauuuuaagcgagaaugaagugaaacugaccaucaugacaggcgauauaaaggggauuaugcaggcuggaaaacgcucccuaagaccucagccaacggagcucaaguacucauggaaagccuggggcaaggcaaagaugcugaguaccgaacuucacaaccauacuuucuugaucgacgggccggagacagcggaaugccccaauaccaacagggcuuggaacucucuggagguugaggauuauggauuuggcguguucacaacuaacauuuggcucaaacugaaggaacgucaagacgucuuuugugacagcaaauuaauguccgccgcaaucaaggauaaucgggccgugcacgcugacauggguuacuggauagagucagcccugaacgauaccuggaaaaucgaaaaggccagcuucauugagguuaagucuugccacuggccuaaaucccauacgcuuuggaguaacgggguguuggagagcgaaaugaucauuccaaagaauuucgcuggacccguaucucagcacaacuaucgaccuggcuaccauacacagaccgccgguccauggcaccucggcaaacuggagauggacuuugauuucugugaagggacuaccgucguggugacagaggacugcggaaauagaggccccucccuaaggacuaccacagcgucagggaagcugaucacggaauggugcugucgcaguugcacccucccgccucugcgguacagaggagaggauggcuguugguaugguauggagauaaggccacuuaaagaaaaggaggaaaacuuggucaauagccugguuacugccgggcauggacagauugacaacuuuucguuaggcgugcucgguauggcucuguuccuugaggaaaugcugcgcacacgaguaggcaccaagcacgcaaucuugcucguggccgucuccuuugugacucugaucacagggaauaugucuagccgggaucuaggacguguuauggugauggucggcgcuaccaugacggacgauauugggaugggagugacuuaccuggcccuccuggcagcguucaaaguuagacccaccuuugccgcuggccuuuugcugaggaaguuaacaucaaaagagcucaugaugaccacuaucgguauugugcugcuuagucaauccucuauaccugagacaauccuggaacuaaccgacgcccucgcacuggggaugauggucuugaagauuguacgcaacauggagaaauaucagcuggcugugacaaucauggccauuuuaugcguucccaaugcagugauccuccagaacgccuggaaggucagcuguacuacccuggcugugguauccgugucaccacuucuguugacgagcagucaacagaaggcggauuggauaccucucgcccugacaaucaaaggacuaaaucccaccgcaauuuuccugacuacccuuucucggacauccaagaaaagaagcuggccacucaacgaagcuaucauggccgucggcaugguuucgauucuggccucaucuuugcugaagaaugacaucccgaugacuggcccuuuaguggcugggggacuccugaccgugugcuacguccuugcagguaggagugccgaccuggaguuggaacgagcggcugaugugcgcugggaggagcaggccgaaauauccggcagcucucccauucucagcaucacgaucuccgaggacgggggaaugucaauuaaaaacgaagaggaggaacagacacugaccauacuaauccggacuggccugcuuguuauuaguggucucuuuccaguaagcauccccauuacagcagccgcuugguaucugugggaggugaagaaacaaagagcaggggucuugugggaugugccuucuccacccccuguuggaaaggccgaauuagaggacggcgcguacaggaucaagcagaaaggcauacugggguauucccagaucggagcugguguguacaaggaaggcaccuuccacacuauguggcaugucacacguggggccgugcucaugcacaaaggaaagcgcauugagccgucaugggcagaugucaagaaggaccugaucaguuacggcgguggguggaaacuugagggagaauggaaagagggcgaagagauucagguccuggccuuggaaccaggcaagaauccccgggcugugcaaaccaaaccugggcuauuuaagacgaacacuggaaccaucggugccguuagccuggauuucuccccaggcacaucugggucgcccauaguggacaaaaagggaaaggucgugggccucuaugguaacgggguugugaccagaagcggaacauacgucucagcaauugcucagacugagaaauccaucgaggauaauccugaaaucgaggacgauauuuuuaggaagaaacgacugaccaucauggaccuucauccgggcgccggcaagacgaaacgguauuuacccgcgauagugcgcgaagccauuaagagagggcugaggacacucaucuuggcaccaacucggguaguggcugccgagauggaagaggcucugcgaggacucccuauuagauaccagacccccgcaauccgcgccgagcacacagguagggaaauaguugaucugaugugucaugccaccuucacuaugcgucuucugaguccaauucgggucccuaacuauaauuugaucaucauggacgaggcucacuucaccgaccccgcgucuauugcagccagaggcuacaucagcacaaggguggaaaugggggaggcugccggaauuuuuaugacggcaacuccaccgggcucccgcgauccuuucccccagucaaacgccccaauaauggacgaggaacgagagauccccgaaagaucuuggaauagcggucacgagugggugaccgauuuuaaggggaaaacagucugguucguaccuaguauuaaggcuggaaacgacaucgcggccugccuacggaaaaauggcaagaaagugauccaacuguccaggaagaccuuugauagcgaauauguuaagacucgcacaaacgacugggauuucguggucaccacggacauuucugagaugggcgcaaauuuuaaagcugagcgugugauagauccaagacgguguaugaagcccguuauccucacugacggggaagagagggugauuuuagccggaccuaugccggucacacauucauccgcagcccagcgccgagguagagugggccggaaccccaagaaugaaaacgaucaguacaucuacaugggggagccccuggaaaaugacgaggacugcgcucacuggaaggaggccaaaaugcuucuggauaacauuaauaccccugaaggaaucauacccaguauguucgagccagaaagggagcgcguagacgcgaucgauggcgaauauagacucaggggugaggcacggaagaccuuuguggacuugaugcgucgcggggaucugccuguuuggcucgccuaccgagucgcugccgagggcauuaacuaugcugacagaaggugguguuucgauggagugaaaaacaaucaaauccuggaagagaacguggaagucgagauuuggacuaaggagggcgaacggaagaaacuuaagccccgcuggcuagacgcaagaaucuacagcgauccacuggccuugaaagaguuuaaggaguucgcugccgggaggaaaucguuaacacugaaucucauaaccgagaugggacggcugccuacauucaugacucagaaggcacgaaacgcgcuugacgaucuggccguucuccauacggcugaagccgguggcagagcauauaaucacgcuuugucugagcugccggagacccuagaaacacugcuccuucugacuuuauuggccaccgugacagggggaauuuuucuguuccucauguccggcaaggguaucgggaaaaugacccugggcaugugcugcauuaucacugcaagcguacuucugugguacgcccagauacagccccacuggaucgcugcgucaauuauccucgaguuuuucuugauugugcuguuaaucccagaaccugagaagcaacgcacgccccaggacaaccagcuaaccuaugucgccauagcaauucugacagugguugcugccacuauggccaaugaaaugggauuucucgagaaaaccaagaaagauuucggccuugggaguaucgcaacacagcaaccagagucuaacauccuggacuuggaccugaggccugcuuccgccuggacccucuacgcgguggcuacuacauuuauuacgcccaugcugcggcauagcaucgaaaauucaagugucaacguaagccuuaccgccauagcaaaucaggccacugugcucaugggacuggguaagggcuggccguuguccaagauggauauugggguuccacuguuagcuaucggauguuacucucaggugaacccuauuacacuaaccgcagcccugcuccuucuggucgcgcacuaugcuaucauaggccccgguuugcaggccaaagcaacccgugaggcccaaaagagagcugccgcagggaucaugaaaaauccaacaguggacggcauuacugucaucgaucuggaccccauuccuuacgauccgaaguucgaaaaacagcucggacaggugaugcugcuuguuuuaugcgugacgcagguacugaugaugaggaccacaugggcucucugugaggccuugacucuggcgaccggccccaucagcacacuaugggaagggaacccaggacgcuuuuggaauaccacuauugccguguccauggcaaacaucuuccggggcucauaucuggcuggugucgggcuccuauuuucuauaaugaagaauacggccaacacacgaagaggaaccggcaacacuggugagacccugggcgagaaguggaaaaauagguugaacgcacuggggaagagugaguuccaaauuuacaaaaagucgggaauccaggagguugaccgcacacucgcuaaagaaggcaucaagagaggggaaacugaucaucacgccgugagcagaggauccgccaaacugcguugguuugucgagaggaauuuagugaccccugaaggcaagguaauggaccuugguugcgggcggggaggcuggucuuauuacugugguggccugaagaacgugaaagagguuaaggggcucacaaaaggaggccccgggcaugaagaaccuauuccaaugucaacguauggauggaaucuagugcgccugcagagcggcgucgauguguucuucgcgcccccugaaaagugcgacaccuugcugugugauauaggugaguccaguccaaaccccacugucgaggcugggcgaacacucagagugcuuaaucugguugaaaacugguugaauaacaauacccaauuuugcaucaaaguacugaacccguacaugccuucugugauugagaagauggaagcacuccagaggaaguacggaggcgccuuaguccggaauccacugagccgcaacucaacucacgagauguauuggguguccaaugcuaguggcaacaucguuagcucugugaacaugauuuccagaaugcuuaucaauagguucacaaugcgacacaaaaaggccaccuacgaacccgacgucgaucuggggucaggaacgcggaacauagguaucgagagcgagauuccuaaucuagacaucauuggcaaacguaucgaaaagauaaaacaggagcaugaaaccucguggcacuaugaccaggaucauccauacaagacaugggcauaucacgggucuuacgagacuaagcaaaccggaagugccuccagcauggugaacggcguagugagacuccugacaaaacccugggacguuauuccgauggucacucagauggcuaugaccgauacaaccccuuuuggucagcagcgcguguucaaggaaaaaguggacacuaggacgcaagagcccaaggaggggaccaaaaaguugaugaagaucaccgcggaauggcuguggaaagagcucggaaagaaaaagacuccacggauguguaccagagaagaguuuacacgcaaagucaggucaaaugccgcacuuggcgcuaucuucacggaugagaacaaguggaaauccgcccgagaagcaguugaggacucuggcuuuugggaacugguggauaaggagcggaauuuacaccuggaagggaagugcgagaccuguguauauaacaugaugggaaaaagagagaagaaauugggugaguucggcaaggccaaagggagcagggcuauuugguacauguggcucggagcccgcuuucuggaguucgaagcgcuaggcuuucuuaaugaggaccauugguucagucgugaaaacucccugagcgguguggagggggagggacuccacaagcugggcuacauauugcgggaagucucuaagaaagagggcggggcaauguaugccgaugacacugcuggaugggauacaagaaucacccuggaagaccucaagaaugaggaaauggugacuaaccauauggagggugagcacaagaaacuugccgaagcaauuuuuaaacugacauaccagaauaaaguugugaggguccagcgcccuacaccacgaggcacagugauggacaucauuucacggagagaucagagggggaguggacaaguaguuacuuauggcuuaaacaccuucacgaauauggaggcucagcugauccgccagauggaaggugaggggguguucaaguccauacaacauuugaccgucacagaggaaaucgccgugaaaaacuggcucacuagagugggacgggagaggcugagccguauggcuauuucuggcgacgauugcgucguuaagccacuagacgaucgauuugccucggcacuuaccgcgcugaacgacaugggcaaagugcgcaaggauauccagcagugggaacccucaagaggguggaaugacuggacacagguaccuuucugcagccaccacuuucaugagcucauuaugaaagauggacgggugcuggucgugccauguaggaaccaagacgaauugaucggucgcgccagaauuucccagggcgcuggguggaguuuacgggagacugccugccugggaaagucuuacgcacagauguggagccucauguauuuccacaggcgagaucuucgucuggcugccaaugcaauauguuccgccguuccgucacauugggugcccaccaguagaacgacauggucuauccacgcgacccacgaguggaugacuacagaagacaugcuaaccgucuggaaccgcguguggauucaggagaauccuuggauggaagauaagacuccaguagagagcugggaagagauccccuaccugggcaaacgggaggaccaauggugcgguucccucaucggguugaccucaagggcuacaugggccaagaacauucagacggcaauaaaucagguuagaagccugaucggaaacgaagaguauaccgacuacaugccuucuaugaaacgcuuucggagggaagagggcgaagccggcgugcuuugguga

SEQ ID NO: 14912 - RNA, 9876 nt, Artificial Sequence
  derived and/or modified CDS sequence (opt3) from DENV-2__DQ448231__SS-prME
accgccggcgugaucauuaugcugauacccacagcuauggcauuccaccucacuacgagaaacggggagccucauaugaucgucagcaggcaggaaaagggaaaaucccuucuguuuaagaccgaggacgguguuaauaugugcacauugauggccauggauuuaggcgaacugugugaggacacuauuaccuacaacugcccacuacuccggcaaaaugaaccggaggauaucgacuguuggugcaacucuacaucaaccugggugacuuaugggacauguaccgcgacgggagagcaccgccgagaaaaacguaguguagcucuggugccccaugucggcaugggucuugagacuagaaccgaaacauggaugagcuccgagggggccuggaagcacgcacagaggauugagacuuggauccugcggcauccuggauucaccauaauggccgcuaucuuggcauacacaauuggcaccacguauuuucagcgcgugcucaucuucauucugcugacugccguugcuccaucuaugacaaugagaugcaucggcauaucgaauagggauuuuguggaaggggucucaggagguagcuggguggacauuguacucgagcacggcaguuguguuaccacuauggccaaaaacaagcccacauuagauuucgaacugaucaagaccgaggcgaaacagccugcaacgcuucggaaguacugcauugaagccaaauugaccaauacaacuaccgcuucccgcuguccaacacaaggggagcccucucugaacgaggaacaggacaagcgauuugugugcaaacacagcauggucgauagaggauggggcaaugguugugggcuauucggaaagggcggcaucgugacuugcgccauguuuaccugcaagaaaaacauggaggggaagaucgugcagccugaaaaucucgaguauacaauugucguuaccccacauuccggagaagagaacacuguggguaaugacacgggcaaacacgggaaggagauaaaaguaacaccgcagucaaguaucaccgaagcagagcugacuggauacggcaccgugacaauggaauguagccccaggaccggucuugauuucaacgagaugguccuguugcaaauggaaaauaaggcuuggcucgugcaucggcagugguuucuggacuuaccucugccauggcuccccggggccgauacucagggcucuaacuggauucagaaagagacacuuguuacguucaagaacccucacgcgaagaaacaagacguggucgugcugggaucccaggagggcgccaugcacaccgcauugacuggggcuacagaaauccagaugucaagcggaaaucuacuguuuaccggucaucucaagugccgucugcgcauggacaaacuucaacugaagggcaugaguuauucuauguguacagggaaauucaagguaguuaaggagauagccgaaacucagcacggaaccauuguggucagagugcaguacgagggcgaugguuccccaugcaaaauccccuucgagaucauggacuuggaaaagaggcauguccucgggcggcugauuacggugaacccgaucguuaccgagaaagauagcccugugaauauugaagcugagcccccauuuggcgacucguacauaaucauuggaguagaaccuggccaguuaaagcugucuugguucaaaaagggguccucaaucggacaaauguuugagacaacuaugcgaggugccaagcgcauggcaauccuaggcgauaccgccugggacuucgggagucucggaggcgucuuuacaagcauugguaaagcucugcaccagguguucggggcgauauauggcgcagccuuuuccggaguuucuuggacuaugaagauccuuauuggcguggucaucaccuggauugggaugaacagcagaucaacgaguuuguccgugagccugguacucgugggaguugucacacuguaccuuggcgugauggugcaggcugauucugguugugucguuucauggaaaaauaaggagcugaaaugcgggaguggaaucuucauaaccgacaacgugcauacuuggacagaacaguauaaguuucaacccgagagcccauccaaguuggccucugcaauccagaaagcccacgaagagggcauuugugguaucaggucggugacccggcucgaaaaucugauguggaagcagauuacucccgaguuaaaccacauccugagcgagaaugaaguaaaacuaaccauaaugacaggcgauauuaaggggaucaugcaggcuggaaaacgcucccucagaccucaaccaacggagcugaaguacucauggaaaaccuggggcaaggccaagauucuuaguacugaaccgcauaaccagacauucuugaucgacgggcccgagaccgcagaaugcccuaauacaaacagggcguggaauucucuggaggucgaggauuauggauuuggcguguucacuaccaacauauggcucaaacugaaggaacgucaggacguuuuuugugacagcaaauuaauguccgcugccaucaaggauaaucgggcagugcacgccgacauggguuacuggauugagucagcucugaacgauacguggaaaaucgaaaaggccagcuucauugaggucaagucuugccauuggccaaaaucccacacacuuuggaguaacgggguguuggagagcgaaaugaucauacccaagaauuucgcaggaccuguuucucagcacaacuaucgaccaggcuaccauacccaaacugcuggucccuggcaccucggcaaacuggagauggacuuugauuucugugaagggaccacagugguagucacugaggacugcggaaauagaggcccgucccuaaggaccacaacggccucagggaagcugauuaccgaauggugcugucgcaguugcacucucccuccacugcgguacagaggagaggauggcuguugguaugguauggagaucaggccccuuaaagaaaaggaggaaaacuuggugaauagccuggugacagcggggcauggacagaucgacaacuuuucguuaggcguccucgguauggcccuguuccuugaggaaaugcugcgcacccgaguuggcacuaagcacgcuguguugcucguagcaguguccuuuaugacacugauuaccgggaauaugucuuuccgggaucuaggacgugucauggugaugguuggcgccgcuaugacggacgauaucgggaugggagugacuuaccuggcccuccuggcagcguuuaaagucagaccuaccuucgccgcuggccuuuugcugaggaaguuaacaagcaaagagcucaugaugaccacuauugguauagugcugcuuucacagaguacaauccccgagaccauucuggaacuaacagacgcccucgcacuggggaugaugaucuugaagauuguucgcaacauggagaaauaucaacuggcugugacuaucauggccauauuaugcgucccaaaugcaguaauccuccagaacgccuggaagguguccuguaccauucuggcuguugugucugucagcccucuucuguugacguccucacagcagaaggcggauuggaucccccucgcccugacaauuaaaggacuaaauccaaccgcaaucuuucugacuacccuuagccggacaaacaagaaaagaaguuggccgcucaaugaagcuauaauggccgugggcaugguaucuauucuggccuccagcuugcugaagaacgacaucccuaugacuggccccuuaguggcugggggacuccugaccgucugcuacguucuuacggguaggucggcagaccuggaguuggaacgagccgcggaugugcgcugggaggaccaagcugagaucucaggcucuaguccaauucucuccauaacaaucagcgaagaugggucuaugagcauuaaaaaugaggaagaggagcagacccugacuauccuaauucggacaggacugcuugugaucuccggccucuuccccgucucaauaccuaucaccgccgcagccugguaucugugggaagugaagaaacagagagcugguguuuugugggacguaccaagucccccuccgguggggaaggcagaguuagaagauggagccuacaggauuaagcagaaaggcauccugggcuauagccaaauuggggcgggagucuacaaggaggguacuuuucauacaauguggcacgugacccguggcgcuguucucaugcacaaagggaagcgcaucgaaccaucuugggccgacgugcggaaagaucugauauccuacggaggcgguuggaagcuugagggggaguggaaggaaggagaggaaguccaggugcuggcauuggagcccggcaaaaacccuagagccguacagacgaagccaggccuauucaaaacuaacaccgggacaauuggagcugucucacuggacuuuagucccgguaccagcggcuccccuaucguggauaagaaagggaagguugugggacucuauggcaauggugucgugacaaggucugggacuuacguuucggccaucgcacagaccgaaaagagcauugaggacaacccggagaucgaagaugacauauuccgaaaaaagcggcugacgauuauggaucuucaucccggagcuggcaaaacaaagcgcuauuuaccagccaucgugagagaggcgauuaaaaggggccugcggacucucaucuuggccccuacccgagucguggcagcugaaauggaggaagcccugagagggcuccccauacgcuaccaaacaccagcuauuagggcagagcacaccggacgugagaucguagaccugaugugucaugccacuuucaccaugcggcuucugucaccugugagaguucccaauuauaacuugaucauuauggacgaagcccacuuuacagauccagcuuccaucgcggcaagggguuacauuaguacgcgcgucgagaugggcgaagccgcugggauauucaugacugccaccccgccuggaucucgagaccccuuuccacagagcaaugcacccaucauggaugaggagagagaaauuccugagcgguccuggaacucaggccaugaaugggugacagacuucaaggguaagaccgugugguuugucccaucuaucaaagccgggaaugauaucgcugcgugccuaaggaagaacggaaaaaagguaauucagcugagccgcaaaacuuucgacagugaguauauaaagacacguaccaaugauugggacuuugugguuacgacugauaucuccgaaaugggcgccaacuucaaggcagagagagugauugacccccggagguguaugaaaccugucauccucacagauggcgaggaacgcgugauuuuagcugggccgaugccaguuacccacagcucugccgcacaacgaagaggacggaucgguaggaaucccaagaacgagaaugaccaguacauauacaugggcgaaccucuggagaacgacgaagauugcgcccacuggaaagaggcuaagaugcuucuggacaauaucaacacccccgaggggauuaucccaucaauguuugaaccugagcgcgaaaaaguggaugccauugacggagaguauagacucaggggcgaagcgcggaagacuuucgucgauuugaugcgucgcggugaccugcccguguggcucgcauaccgaguagccgcugaggggaucaacuaugccgauagaaggugguguuuugacggcauaaaaaauaaccagauucuggaggaaaauguggagguugaaaucuggacaaaggagggagagcggaagaaacuuaagccacgcuggcuagaugcuagaauuuacuccgacccucuggcauugaaagaauucaaggaguucgccgcuggcaggaaaaguuuaacccugaaccucaucacagaaauggggcggcugccgacuuuuaugacgcagaaggcccgaaaugcacuugauaaccuggcgguccuccauaccgccgaggcuggagguagagccuauaaucacgcauugagcgaacugcccgagacacuagagacucugcuccuucugaccuuauuggcuacagugaccggcgggauauuccuguuucucaugucgggaaagggcaucgguaaaaugacucuggggaugugcugcauuaucacggccucuauucuucugugguacgcacaaauccagccacauuggauagccgcuuccauuauccucgaauucuuuuugaucgugcuguuaauuccugagcccgaaaagcagcgcaccccacaggacaaccaacuaacauaugucguuaucgcgauacugacugugguagccgcaaccauggcuaaugagaugggcuuccucgaaaaaacaaagaaagauuuuggacuuggcagcauugccacccagcagccugagucaaacauccuggacauugacuugaggcccgccagugcauggacucuguacgcuguggccacaacguucaucaccccgaugcuccggcacucuauagagaauuccagcgucaacgugucacugacugcgaucgcuaaucaggccacaguucuuauggggcucggaaaggguuggccacugaguaagauggauauuggcgugccuuugcuggcaaucggguguuacagccaagucaaccccauuaccuuaaccgccgcucuacugcuccuuguagcacacuaugccaucauuggaccaggccugcaggcgaaagcuacacgugaagcccagaagagagcagccgcugguaucaugaaaaaucccacuguggacgggauaacgguuauugauuuggacccuaucccguacgaucccaaguuugagaaacagcugggccaagugaugcuccugguccuuugcgugacccaggucuuaaugaugaggacaacuugggcccugugugaagcacucaccuuggcuacaggaccaaucuccacccugugggagggcaacccugggcgcuucuggaauacuacgauugccgugucuauggcgaacauauuucggggaagcuaucuagccggcgcaggucugcucuucuccaucaugaagaacacaaccaauacucgaagagggaccggaaacacaggcgaaacucuuggugagaaguggaaaaauaggcugaacucauugggcaagucugaguuucagauuuacaaacgcagugggauccaagaaguugaccggacccuggcuaaggagggaauuaaaagaggcgaaacagaucaucacgccgugucgcgugggagcgcaaagcucaggugguucguagagcggaaucuggugacgcccgagggaaaagucguugacuuaggcugcggucgcgggggaugguccuauuacuguggcggucuuaagaacgugcgagaagucaagggccugaccaaagggggaccuggccaugaggaaccaauccccaugucuacuuauggguggaaucucgugagacuacagucaggaguagauguguucuuuacaccuccagagaagugcgacacccuguugugugauauaggcgaaagcucccccaacccgacuguugaggcugguaggacacugcgggugcucaaucuugucgagaacuggcugaauaacaauacccaguucugcaucaaaguguugaacccuuacaugccaagugucauugaaaagauggagacgcugcagcgcaaauacgggggagcccucgugagaaaucccuuaucuaggaacagcacccacgaaauguauuggguuucaaacgccuccggcaauaucguaaguagcgugaacaugauuucucgaaugcugaucaaucgguuuacaaugcgucauaagaaggcgacuuacgagccugacgucgaucuuggcuccgggaccagaaacauaggaauugaaucagagacaccaaaucuggacaucaucgguaaacgcauugagaagauaaaacaagaacacgagacuagcuggcacuaugaccaggaucaucccuacaagaccugggcuuaucacggcucguacgaaacaaaacagaccgggucugcaaguuccauggugaacggaguugugaggcuacucacuaagccgugggacgucaucccuauggugacgcagauggccaugacagauaccacucccuucggccaacagcggguauuuaaggagaaaguggacaccagaacacaggaaccaaaggaggguacgaaaaagcugaugaaaauuaccgcugagugguuguggaaggaacuggggaagaaaaagacuccucgcauguguacaagggaggaauucacccgaaaaguucggagcaaugccgcacucggagccaucuuuacugaugagaacaaguggaaaucagcuagagaggcggucgaagacuccagguucugggagcuuguggauaaggaacgcaaucugcauuuagagggcaaaugcgaaacauguguguauaacaugaugggcaagcgugagaagaaaauuggggaguuuggaaaggccaaagguucucgggcaaucugguacauguggcugggcgcuagauucuuggaauuugaggcccucggguuccugaaugaagaccacugguuuagcagggagaacagucuauccggagucgaaggcgagggucuucacaagcugggguacauacuccgcgagguuagcaaaaaggaaggaggcgcaauguaugccgaugacaccgcuggcugggauacacgaaucacucuggaggacuugaagaaugaagagauggugaccaaccauauggaaggggagcacaaaaagcuggccgaggcgauuuucaaacucacguaccagaauaagguagugcggguccaaagacccaccccaaggggaacagugauggacaucauuucucgcagagaucagcgggguucaggccagguugggacuuauggacuuaacaccuucacaaacaugggcgcacaacugaucaggcagauggaaggugaggggguguuuaaaggaauucagcauuuaacugccaccgaagaggucgcugugcaggacuggcuggcccguguaggccgagagcgcuugaguagaauggcaauauccggcgaugacugcguugugaagccccucgaugaccgguucgcuagcgcccugacggcucuaaaugauauggggaagaucaggaaagacauucaacagugggaaccuucucgcggauggaacgauuggacacaggucccauuuugcucgcaccauuuccacgagcuuaucaugaaggacgguagagugcugguggucccgugucggaaucaggaugaacucaucggcagggcccgaauuucacaaggggcaggauggagccugcgugagaccgcgugcuugggcaaauccuacgcccagauguggaguuuaauguauuuucacagacgcgaccugcggcucgcugccaacgcaauauguucugcuguucccagccauugggugccuacuuccaggacaaccuggucaauccacgccagacaugaauggaugacuaccgaggauaugcuuacaguauggaaucgcguguggauucaggagaacccauggauggaagacaagacgcccgucgagaguugggaagagaucccuuaccuggguaaacgggaagaccaguggugcgggucucuaauuggacugaccagcagggcaacuugggccaagaauauccaaacagcgauaaaccaggugcgaucccucaucggcucagaggaguauaccgauuacaugccaagcaugaagagauuccggagggaagaggaagaggcuggcguuuugugguga

SEQ ID NO: 14913 - RNA, 9876 nt, Artificial Sequence
  derived and/or modified CDS sequence (opt3) from DENV-2__JX470186__SS-prME
accgccggaaucauuauaaugaugauccccaccgugauggcuuuccaccugacuacgcgaaacggggagccucauaugauugucagcaggcaggaaaagggaaaaucccuccuuuuuaagaccgagaaugguguuaacaugugcacccugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacuagaaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugcggugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggcccaccggcaaugguuucucgaucugccuuuaccauggcugcccggggcggacacccagggcucuaacuggauccagaaagagacucucgugacauucaagaauccucacgccaagaaacaggauguugugguccuuggaucccaagagggcgcaaugcauacggcucugaccggggccacugaaauacagaugucaagcggaaacuugcuauuuacaggucaccugaagugccgucuccgcauggacaaacugcagcuuaagggcaugaguuauucuauguguaccgggaaauucaaggugguaaaggagauugcugaaacacaacauggaacuaucguuaucagagugcaguacgagggcgacgguuccccaugcaaaauucccuucgagaucauggaucuggaaaagaggcacgucuuggggcggcucauuaccgugaauccgauagucacggagaaagacagcccugugaacaucgaagccgagcccccauuuggcgauucguacauuaucaucggaguugaaccuggccagcugaaguuaucuugguucaaaaagggguccucaauuggacagauguuugagaccacaaugcgaggugcaaagcgcauggccauacugggcgacacugcuugggauuucgggagucuaggaggcguguuuaccagcaucgguaaagcgcuccaucaaguauucggggcaauuuauggcgccgcuuuuuccggagucucuuggacaaugaagauccugauuggcgugguuaucacuuggauagggaugaauagcagaucaaccagucuuuccgugagcuugguccuggugggaguagugacgcucuaccugggcguuaugguccaggccgacucugguuguguggugucauggaaaaacaaggagcuuaaaugcgggaguggaaucuucauuacagauaauguccacaccuggacugaacaguauaaguuucagcccgagagcccauccaagcuggcaucugccauccaaaaagcucacgaagagggcauuugugguaucaggucgguuacacgguuggaaaaccucauguggaagcagauaacccccgagcugaaucauauuuuaagcgagaacgaagugaaacugacuaucaugaccggcgacauuaaggggaucaugcaggccggaaaacgcucccuaagaccucagccaacagagcucaaguacucauggaaagcauggggcaaggcgaagaugcugaguacggaacuucacaaucauaccuucuugauagaugggccggagacugcugaaugccccaacacaaauagggccuggaacucucuggagguggaggacuauggauuuggcguauucaccacaaauaucuggcucaaaaugaaggaacgucaagaugucuuuugugacagcaaacugauguccgcagccauuaaggacucacgggcugugcacgccgauauggguuacuggaucgagagcgcauuaaacgacacuuggaaaauugaaaaggcuucuuucaucgagguuaaguccugccacuggccuaaaagucauacccuguggagcaacggggugcuugagucugaaaugauaauuccaaagaauuucgccggacccgucucccagcacaacuaucgaccuggcuaccauacgcagacagcggguccauggcacuugggcagacucgagauggauuuugacuucugugaagggaccacugugguugugaccgaggauugcggaaauaggggccccucacugcgcacaacuaccgccagugggaaacuaaucacagaauggugcugucggagcugcacgcugccgccucucagauacaggggagaggacggcuguugguaugguauggagauccgcccacugaaggaaaaagaggaaaaccuuguaaauucguuggucaccgcugggcauggacagauugauaacuuuucccugggcguguuagguauggcacucuuccuggaggaaaugcuucgaacucgggugggcacaaagcacgccauccuguuggucgcuguuucuuuugugacccucauuacugggaauaugagcuuccgugaccugggaagaguaauggugauggucggcgccacaaugaccgaugacauagggaugggagugacguaccuagcacugcucgcggccuuuaagguuaggcccacuuucgcugccggccugcuuuugcgcaaacugaccucaaaggaguuaaugaugacaaccaucgguauugugcuccugagucaagcaacuaucccugagacaauucuugaacugaccgaugcucuagcccucgggaugaugguccugaaaaucgugcggaacauggagaaguaucaguuggcaguuacaauaauggccauccugugcgugcccaaugcugucauuuuacagaacgcguggaaaguauccuguacuacccucgccgugguuucugugagcccacugcuucugacguccucacaacagaaggcagacuggaucccuuuggcucucacaauuaagggacugaaucccaccgccaucuuucuaacuacccugagcagaacaaacaaaaagaggaguuggccacuuaaugaagccauaauggcugucggcauggugucuauucucgcauccagccuguugaaaaacgauaucccgaugacuggcccucugguagccgggggauuacucaccgugugcuacguccugacgggucgaucggcggaccuugagcuggaacgcgcugccgacguucggugggaggagcaggcagaaaucucaggcucuagucccauuuuguccauaacaaucagcgaggaugggucuaugagcauuaagaaugaagaggaggaacagacccucacuauccugauuagaacaggacuacuggugguguccggccuuuucccagucucaacccccaucacugccgcugcaugguaucucugggaggugaaaaagcaaagggccgguguucugugggacguaccuaguccacccccuguggggaaagcggaauuggaggauggagcuuaccguauaaagcagaagggcaucuuaggcuauagccagauuggggccggagucuacaaagaagguacauuucacaccauguggcaugugacgcgcggcgcaguucugaugcacaaggggaaacggaucgagccgucuugggccgacgugaagaaagaucucauuuccuacggaggcgguuggaagcuggagggggaauggaaggagggagaagagguccaggugcuugcucuggaaccaggcaaaaaccccagagccguacaaacuaagccuggcuuguucaaaaccaacacagggaccaucggagcagucucacuagacuuuaguccagguacaagcggcucccccauaguggauaagaaagggaagguugugggacuguauggcaauggugucgugacuaggucugggaccuacguuucggcuauugcccagacggaaaagagcaucgaggacaacccugaaaucgaggaugacauuuuccggaaaaagagacucacaaucauggaucugcauccgggagcgggcaaaacuaagcgcuaucuucccgccauagugagagaagcaauuaaaaggggcuuacggacccugauccucgcuccaacacgagucguggccgcugagauggaagaggcauugagagggcugccuauucgcuaccagacccccgccaucagggccgagcacacuggacgugaaauaguagaccucaugugucaugcuaccuucacaaugcggcugcuuucaccaauuagagugccuaauuauaaccugaucaucauggaugaggcgcacuuuacggaccccgcauccauugccgcuagggguuacaucaguacucgcguugaaaugggcgaggccgcagggauuuucaugaccgccacaccaccgggaucucgagacccuuuuccccagagcaaugcuccaauaauggaugaggaaagagagauccccgaacgguccuggaacucaggccacgagugggucaccgacuucaaggguaagacugugugguuugugccuucuauuaaagcggggaaugauaucgccgcaugcuugaggaagaacggcaaaaaggucauccaacuaagccgcaaaacauucgacagugaauauauuaagacccguacgaaugauugggacuuuguagugacuacagauauauccgagaugggcgcuaacuucaaggccgagagaguuaucgacccacggagguguaugaaacccgugauucugaccgauggcgaagaacgcgucauccucgcagggccuaugccggugacccauagcucugccgcucagcgaagaggacggguugguaggaauccaaagaacgaaaaugaccaguacauuuacaugggcgagcccuuagaaaacgaugaggacugcgcccacuggaaagaggcgaagaugcugcuugacaauaucaacacuccugaagggauaauccccucaauguuugagccagaacgcgagaaaguggaugcaauugacggagaauauagacugaggggcgaggcccggaagacauucgucgaucucaugcgucgcggugacuugccuguguggcuggcuuaccgaguagccgcugaggggaucaacuaugcagauagaaggugguguuuugacggcgugaaaaauaaccaaauucucgaagagaauguugaagucgagaucuggaccaaggagggagaacggaagaaacugaagccccgcuggcuugaugccagaauauacuccgacccacuagcucugaaagaguucaaggaguucgccgcaggcaggaaaaguuugacauuaaaccugauuacugagauggggcggcucccuacguuuaugacccagaaggcgcgaaaugcccuggauaaccuugcugugcugcauacagccgaagcaggagguagagcuuauaaucacgcccucagcgaguugccggagacucuggaaacccuacugcuccuuacacuguuagcaaccgugacuggcgggaucuucuuguuucugaugucgggaaagggcauugguaaaaugacgcucgggaugugcugcaucauaaccgccucuauccugcuuugguacgcucagauucagccccacuggaucgcggccuccauuauccuggaguucuuucucauagucuugcugauuccagaaccugagaagcaacgcacaccccaggacaaccaguuaacuuauguugugaucgcaauccuaaccguaguggcugccacaauggccaaugaaaugggcuuccuggagaaaaccaagaaagauuuuggacucggcagcauuacuacacagcaaccagagaacaauauccuugacauagaucugaggccugcaucagcuuggacguuguacgccgucgcgaccacuuucauuacacccaugcugcggcauaguaucgaaaacucuuccgugaauguuagccucaccgcuauugccaaccaggcaaccgugcugauggggcuuggaaaggguuggccgcucucaaagauggacaucggcgucccacuguuggccauaggguguuacagucagguaaauccuaucacacugacugcugcauuacuacugcucguggcccacuaugcgauuaucggacccggccuucaggcuaaagccacgcgugaggcacaaaagagagccgcugccgguauuaugaaaaacccaaccguugacgggaucacagugauugaucuggaccccaucccuuacgauccgaaguuugaaaaacaguugggccaggucaugcugcucgugcugugcgucacucaggugcuuaugaugaggaccacaugggcauuaugugaggcucugacccucgccacuggacccauaagcacguugugggaaggcaauccagggcgcuucuggaacacaaccauugcgguuuccauggccaacaucuuucggggaucuuaucuggcaggcgcuggucuacuguucagcaucaugaagaauacugccaacacccgaagagggacaggaaauacuggcgagacccucggugagaaguggaaaaacaggcuuaaugcacugggcaaguccgaauuucaaauuuacaaaaagucagggauacaggagguggaccgcacauuggcuaaagaaggaaucaagcggggcgagacggaucaucacgccguaucuagagggagugccaaacugcguugguucguggagaggaaccucgucaccccugaaggaaagguuguggaccugggcugcgguagaggcggguggucguauuacuguggggguuuaaagaaugucaaagaggugaagggccuuacuaaagggggacccggccaugaggaaccuauuccaaugagcacauauggguggaaccugguacgccuccaguccggaguggauguuuucuuuacacccccugaaaagugcgacacucuacugugugauaucggcgagucuucaccaaaucccacaguggaggcgggucgaaccuugagaguccugaaccucguggaaaauuggcuuaacaauaacacgcaauucugcauuaaaguccugaauccguacaugccuagcgugaucgagaagauggaggcuuugcagaggaaguacgggggagcacugguucggaacccacucucccgcaacaguacccacgagauguauuggguaucuaaugccagcggcaacauagugucauccgucaauaugaucaguagaauguuaauuaacagguuuacaaugcgacacaaaaaggcuacuuacgaacccgacguggaucugggcagcgggacccggaauaucggaauugagucugagacaccuaaccuugacaucauagguaaacguauugaaaagaucaaacaggagcaugaaacuuccuggcacuaugaucaggaccauccauacaagaccugggccuaucacggcucauacgagacaaagcaaaccgggagcgcaucgucuaugguuaauggaguggucagacugcuaacuaaacccugggacgugaucccgaugguaacgcagauggccaugacagauaccacuccuuucggccagcagcgcguguuuaaggaaaaaguugacaccaggacacaagagcccaaggaggguacgaaaaagcucaugaagauuaccgcugaauggcuguggaaagaguuggggaagaaaaagacuccacggauguguacaagagaagaguucacccgcaaagucaggaguaacgcggcccugggagcaauauuuacugaugagaauaaguggaaauccgcucgagaagccguggaggacagcggcuucugggaacucguggauaaggagcggaaccuucaccuggaaggcaagugcgagacaugugucuauaauaugauggggaaaagagagaagaaauuaggagaauuugguaaggcaaaaggcucaagggccaucugguacauguggcugggggcucgcuucuuggaguuugaagcccucggauuccugaacgaggaccauugguuuucccgugaaaauucucuaagcggcguugagggugaggggcuucacaagcugggauacauucuccgggaugugaguaagaaagaaggcggcgcgauguaugcagacgauaccgccgggugggacacaagaaucacucuggaggauuugaagaacgaagagaugguaaccaaucauauggaaggagagcacaaaaagcuggcugaggccauuuucaaacucacguaccagaacaagguggucagggugcagcgcccuacaccccgagguacaguuauggacaucauaucccggagagaccagaggggcagcgggcaaguggucacuuauggacuuaacaccuucacaaauauggaagcacagcugauccgccagauggagggcgaagguguguuuaagucuauucaacaguuaacuguaaccgaggagaucgcuguuaaaaacuggcuggugagagucgggcgggaaagguugucacguauggccauuaguggagaugacugcguggugaagccacucgaugaccgauucgcuuccgcccugacggcacuaaaugauaugggcaaaguccgcaaggacauccagcagugggagcccagcagaggcuggaacgauuggacacaaguuccuuuuugcucucaucacuuccacgaacuuauuaugaaagacgggcgggugcugguagugccauguaggaaucaggaugagcucauaggacgcgcgagaaucucgcagggugccggcuggucacugcgggaaaccgcuugcuugggaaagagcuacgcccagaugugguccuuaauguauuuucauaggcgagaccugcgucucgcagcuaacgccauuuguagugcagucccgucucacugggugcccacuagcagaacaaccugguccauccaugccacucacgaguggaugaccacagaggauaugcuuacgguuuggaaucgcguguggauccaagaaaacccuuggauggaggacaagaccccagucgaaucaugggaggaaauucccuaccugggaaaacgggaggaucaguggugcggcagucuaauaggucugacuucuagggcgacaugggcuaagaauauccagaccgccauuaaccaggugagaagccucaucgggaaugaggaauauacugacuacaugccuuccaugaaacgcuuccggagggaggaagaggaagcaggaguauugugguga

SEQ ID NO: 14914 - RNA, 9876 nt, Artificial Sequence
  derived and/or modified CDS sequence (opt3) from DENV-2__KU517846__SS-prME
accgccggaaucauuauaaugaugauccccaccgugauggcuuuccaccugacuacgagaaacggggagccucauaugauugucagcaggcaggaaaagggaaaaucccuccuuuuuaagaccgagaaugguguuaacaugugcacacugauggcaauggacuugggcgaauuaugugaggauacuaucaccuacaauugcccacugcuacggcaaaacgaaccggaggacauugauuguuggugcaauucuacaucaaccugggugacuuaugggacauguaccgccacgggagagcaccgccgagaaaaacguaguguagcgcucgugccccaugucggcaugggucuggagacucggaccgaaacauggaugagcuccgagggggcuuggaagcacgcccagaggaucgagacuugggugcuucggcauccuggauucaccauaauggcagccauccuggcuuacacaauuggcaccacguauuuucagcgcguuuugaucuucauucuccugacugcaguggccccaucuaugacaaugagaugcaucggcauaucgaacagggacuuugucgaaggggugucaggagguagcuggguagauauuguucuggagcacggcaguugugugaccacuauggcuaaaaauaagcccacacucgacuucgaauuaaucaagaccgaggccaaacacccugcgacgcugcggaaguacugcauugaagcaaaacuuaccaacacaacuaccgccucccgcuguccaacacagggggagcccucuuugaaugaggaacaagauaagcgauuugucugcaaacauagcaugguggacagaggauggggcaacgguugugggcuguucggaaagggcggcaucgugacuugcgcuauguuuaccugcaagaaaaauauggaggggaagaucguccagccugaaaaccuagaguauacaauuguuauaaccccacacuccggagaagagaaugccguggguaacgauacuggcaaacaugggaaggagaucaaaguaacgccgcagucaaguauuacagaagcagagcucaccggauacggcacugugaccauggaauguagccccaggacaggucuggacuucaaugagaugguccuucugcagauggaaaacaaggcuugguuggugcaccggcaaugguuucucgaucugccuuuaccauggcugcccggggccgacacccagggcucuaacuggauccagaaagagacucucguuacauucaagaauccucacgcgaagaaacaggauguggucgugcuuggaucccaagagggcgccaugcauacggcacugaccggggcuacugaaauacagaugucaagcggaaacuugcuauuuacaggucaccugaagugccgucuccgcauggacaaacugcagcuuaagggcaugaguuauucuauguguaccgggaaauucaagguaguuaaggagauugccgaaacacaacauggaacuaucgugaucagaguccaguacgagggcgacgguuccccaugcaaaauucccuucgagaucauggaucuggaaaagaggcacguguuggggcggcucauuaccgucaauccgauagugacggagaaagacagcccuguuaacaucgaagcugagcccccauuuggcgauucguacauuaucaucggaguggaaccuggccagcugaaguuaucuugguucaaaaagggguccucaauuggacagauguuugagaccacaaugcgaggugccaagcgcauggcaauacugggcgacacugccugggauuucgggagucuaggaggcguauuuaccagcaucgguaaagcucuccaucaagucuucggggcgauuuauggcgcagccuuuuccggagugucuuggacaaugaagauccugauuggcguugugaucacuuggauagggaugaauagcagaucaaccagucuuuccgucagcuuggugcugguaggaaucgugacgcucuaccugggcguuaugguccaggcugacucugguuguguggugucauggaaaaacaaggagcuuaaaugcgggaguggaauuuucaucacagauaauguccacaccuggacugaacaguauaaguuucagcccgagagcccauccaagcuggccucugcaauucaaaaagcccacgaagagggcaucugugguauaaggucgguuacacgguuggaaaaccucauguggaagcagauuacccccgagcugaaucauaucuuaagcgagaacgaagugaaacugacuauuaugaccggcgacaucaaggggauaaugcaggcuggaaaacgcucccuaagaccucagccaacagagcucaaguacucauggaaagccuggggcaaggcaaagaugcugaguacggaacuucacaaucauaccuucuugaucgaugggccggagacugcggaaugccccaacacaaauagggcuuggaacucucuggagguggaggacuauggauuuggcguauucaccacaaauauuuggcucaaacugaaggaacgucaagaugucuuuugugacagcaaauuaauguccgccgcaaucaaggacaaccgggccgugcacgcugauauggguuacuggauugagucagcccugaacgacacuuggaaaaucgaaaaggccagcuucauagagguuaagucuugccacuggccuaaaucccauacccuuuggaguaaugggguguuggagagcgaaaugauuaucccaaagaacuucgcuggacccgucucucagcacaauuaucgaccuggcuaccauacgcagacagccgguccauggcaccucggcagacuggagauggauuuugacuucugugaagggaccacugugguugugaccgaggauugcggaaacaggggccccucccuacgcacaacuaccgcgucagggaaacugaucacagaauggugcugucggaguugcacgcucccgccucugagauacaggggagaggacggcuguugguaugguauggagauucgcccacuuaaggaaaaagaggaaaauuugguaaacagccuggucaccgccgggcauggacagaucgauaauuuuucguuaggcgugcucgguauggcucuguuccuugaggaaaugcugcgaacucgggugggcacaaagcacgcaauuuugcucgucgccguuuccuuuaugacccugauaacugggaacaugucuuuccgugaccuaggaagagugaugguaauggugggcgcuacaaugaccgaugacaucgggaugggagucacguaccuggcccuccuggcagcguuuaaggugaggcccacuuucgccgcuggccuuuugcugcgcaaauuaaccagcaaggagcucaugaugacaaccauugguaucguucugcuuucacaaaguacuauuccugagacaauccuggaacuaaccgaugcccucgcacuggggaugaugguguugaaaauaguccggaauauggagaaguaucagcuggcugugacaaucauggccauuuuaugcguucccaacgcagugauccuccagaaugccuggaaagucuccuguacuauucuggcuguagugucuguuagcccacuucuguugaccuccucacaacagaaggcggacuggaucccucucgcccugacgauaaagggacuaaaccccacagcaauuuuucugaccacucuuagcagaaccaguaaaaagaggucuuggccacucaaugaagcuaucauggccgugggcauggucuccauccuggccagcucguugcugaaaaacgauauuccgaugacaggcccuuuaguggcugggggacuccugacuguaugcuacgugcuuaccggucgaucagcagaccuggaguuggaacgcgccgcggacguccggugggaggagcaggcugaaauaucuggcaguucccccauccucagcauuacgaucucugaggaugggagcauguccauuaagaaugaagaggaggaacugacacuaaccauccugauaagaacuggacuucucguuaucucaggccuguucccagugaguauucccaucacagccgcagccugguauuugugggaggugaaaaagcagagggcuggugucuuaugggacgugccuagcccacccccuguugggaaagcagaacuggaggauggagccuaccguauuaagcaaaagggcauccucggcuauucucagauaggggcgggaguauacaaagaagguaccuuucacacuauguggcaugugacacgcggcgcuguccugaugcacaaggggaaacggauugagccguccugggccgacgugaagaaagaucuuaucucauacggaggcgguuggaagcuggagggggaauggaaggagggagaagagguucagguguuggcacuagaaccaggcaaaaaccccagagccguccagaccaagccuggccuguucaaaacgaacacugggaccaucggagcugugagucucgacuuuagcccagguacauccggcucucccauuguagauaagaaagggaaggucgugggacuguauggcaaugguguugugaccaggucggggacauacgucagcgccaucgcacaaacugagaagucaauagaggacaacccugaaauugaggaugacaucuucagaaagaagcggcuuaccauuauggauuuacauccgggagcuggcaaaacgaagcgcuaucugcccgccaucgugagagaagcgauaaaaaggggccuccggacauugauucuggccccaacucgaguuguggcagcugagauggaagaggcccucagagggcugccuauccgcuaccagacccccgcuaucagggcagagcacacaggacgugaaauugucgaccuuaugugucaugccaccuucacuaugcggcuguuguccccaaucagagugccuaauuauaaccuaauuauaauggaugaggcccacuuuaccgaccccgcuaguaucgcggcaagggguuacauuucuacacgcguagaaaugggcgaggccgcugggaucuucaugacggccacuccaccgggaagccgagacccuuuuccccaguccaaugcaccaaucauggaugaggaaagagagauucccgaacggucauggaacucuggccacgagugggugaccgacuucaaggguaagacaguuugguuugucccuagcauaaaagccgggaaugauaucgcugcgugccugaggaagaacggcaaaaaggugauucagcucagucgcaaaaccuucgacuccgaauauaucaagacucguacaaaugauugggacuuuguggucaccacggauauuagcgagaugggcgccaacuucaaggcagagagaguaaucgacccacggagguguaugaaacccgugauauuaacugauggcgaagaacgcguuauccuggcugggccuaugccggugacacauucuucagccgcacaacgaagaggacgggucgguaggaauccaaagaacgaaaaugaccaguacauuuacaugggcgagccccuugaaaacgaugaggacugcgcccacuggaaagaggcuaagaugcugcucgacaauaucaacaccccugaagggauuauccccuccauguuugagccagaacgcgagaaaguggaugccauagacggagaauauagauugaggggcgaggcgcggaagaccuucguugaucugaugcgucgcggugaccucccuguguggcuggcauaccgagucgccgcugaggggauuaacuaugccgauagaaggugguguuuugacggcgugaaaaauaaccagauccuugaagagaauguagaaguggagauuuggacuaaggagggagaacggaagaaacuaaagccccgcuggcuggaugcuagaaucuacagugacccauuggcauuaaaagaguucaaggaguucgccgcuggcaggaaaagccugacacucaaccugauaaccgagauggggcggcuuccuacauuuaugacucaaaaggcccgaaaugcacuggauaaccucgcgguuuugcauacggccgaagcuggagguagagccuauaaucacgcacugucggagcuaccggagacccuggaaacacuccuucuguuaacuuugcuggcuaccgucacaggcgggaucuuccucuuucugaugucuggaaagggcauugguaaaaugacccuugggaugugcugcaucauuacugccuccauccugcucugguacgcacagauacagccccacuggauugccgcuagcaucaucuuggaguucuuucugauuguguuacuaaucccagaaccugagaagcagcgcacgccccaagacaaccagcugaccuauguggucauagcgauucucacaguuguggccgcaacuauggcuaaugaaaugggcuuccuugagaaaaccaagaaagauuuuggacugggcucaaucacaacccagcagccagagaguaacauuuuggacaucgaucugaggccugccucugccuggacucucuacgcaguagcuacaacguucauaacccccaugcugcggcauuccaucgaaaauagcucagugaacgucagucuuacugccauugcgaaucaagcuacagugcucauggggcugggaaaggguuggccguugagcaagauggacaucggcguuccacuguuagccauuggguguuacucccaggugaacccuaucacccuaaccgcagcccugcuccuucuggucgcucacuaugcaauuaucggacccggcuugcaggccaaagcgacacgugaggcucagaagagagccgcagccgguauaaugaaaaauccaacuguagacgggauuacggugaucgaucuggaccccaucccuuacgauccgaaguuugaaaaacaacucggccagguuaugcugcuuguguuaugcgucacccaggugcugaugaugaggacaacuugggcucucugugaggccuugacccuggcaacaggacccauuucuacccuaugggaaggcaacccagggcgcuucuggaauacuacgauagcugucagcauggccaacaucuuucggggauccuaucuggcgggcgccggucuccuuuucucaauuaugaagaacacagcaaauacccgaagagggacuggaaacaccggcgagacacugggugagaaguggaaaaauagguugaacgcucugggcaagucugaauuucagaucuacaaaaagagugggauucaagagguggaccgcacucucgccaaagaaggaaucaagcggggcgagaccgaucaucacgcaguuucgagagggagcgcuaaacugcguugguucguggagaggaauuuaguaacaccugaaggaaagguggucgaccuuggcugcgguagaggcgggugguccuauuacugugggggucugaagaacguuaaagaggugaagggccucacgaaagggggacccggccaugaggaaccuauaccaaugucuaccuauggguggaaucuaguccgccugcagucaggaguggauguauucuuuacucccccugaaaagugcgacacauugcugugugauaucggcgagagcuccccaaaccccaccguggaggccggucgaacucucagaguucuuaaucugguggaaaacugguugaauaacaauacacaguucugcauuaaaguccugaguccguacaugccuucugugaucgagaagauggaagcccuccaaaggaaguacgggggagcguuaguccggaacccacugagccgcaauucaacccacgagauguauuggguguccaacgcuaguggcaacauuguuagcucuguaaauaugaucuccagaaugcuuauaaacagguuuacgaugcgacacaaaaaggcaaccuacgaacccgacguggaucugggcucagggacacggaauauuggaaucgagagcgagacuccuaaccuagacaucauugguaaacguauagaaaagaucaaacaggagcaugaaaccucguggcacuaugaucaggaccauccauacaagacaugggccuaucacggcucuuacgagacuaagcagaccgggagugcuuccagcauggucaauggagugguuagacuccugacaaaacccugggacgugauuccgauggucacccaaauggccaugacugauacgacaccuuucggccagcagcgcguguuuaaggaaaaaguagacaccaggacucaggagcccaaggaggguaccaaaaaguugaugaagaucacagcagaauggcuguggaaagagcucgggaagaaaaagacgccacggauguguaccagagaagaguucacucgcaaagugaggucaaacgccgcucuuggagcgauuuuuacagaugagaauaaguggaaauccgcccgagaagcaguugaggacucuggcuucugggaacuggucgauaaggagcggaacuuacaccuggaaggcaagugcgagaccuguguguauaauaugauggggaaaagagagaagaaauugggagaauuugguaaggcuaaaggcagcagggccaucugguacauguggcucggggcacgcuuccuggaguuugaagcccuaggauuccuuaacgaggaccauugguuuagucgugaaaauucccugagcggcguggagggugaggggcuccacaagcugggauacauauugcgggaugucucuaagaaagaaggcggcgcuauguaugccgacgauacugcggggugggacacaagaaucacccuggaggaucucaagaacgaagagaugguuacaaaucauauggaaggagagcacaagaaacuugcagaggccauuuucaggcugacuuaccaaaacaaagugguacgcgugcagcgaccuacaccccgggguacggucauggacaucauuucaagaagggaccagcgcggcaguggacaggugguuaccuauggauuaaauacauucacuaacauggaagcucaacugaucagacagauggagggcgaagguguguuuaaauccauucagcauuugaccgucacagaggagauagccgugaagaacuggcucgaacggguagggagggagcgucugagccgaauggcaaucucuggagaugacugcguugugaaaccacuagaugaccgcuucgcuucggcccuuacugcucugaaugauaugggcaagauuagaaaagacauccaacagugggaacccucacggggcuggaacgauuggacccaggucccuuuuugcagccaccacuuccaugagcucaucaugaaggacgggagggugcugguggucccaugucgcaaucaggaugaauugauuggacgagcacggauaucccaaggugcaggcuggaguuuaagggagacggcgugccuggggaaaucuuacgcccagauguggagccucauguauuuucaccgacgugaccuuagacuggcugccaacgcaaucuguuccgcuguuccgucacauugggugcccacaagucgcaccacuuggucuauucacgccacacacgaguggaugaccacugaagauaugcuaaccguauggaaucggguguggauccaggagaacccuuggauggaagacaagacaccagucgagagcugggaagagauucccuaccugggaaagagggaggaucaguggugcggcucccucaucgguuugacgucaagagcaaccugggccaaaaauauacaaacugcgaucaaccaggugcgcagccugauugggaaugaagaguauacagacuacaugccuucuaugaagcgguucaggcgagaagaggaagaggcuggaguucuuugguga

SEQ ID NO: 14915 - RNA, 9876 nt, Artificial Sequence
  derived and/or modified CDS sequence (opt3) from DENV-2__KJ830750__SS-prME
accgccggcgugaucauuaugcugauacccacugcuauggcauuccaccucacuacgcguaacggggagccucauaugaucgucuccaagcaggaaaaaggaaagucccuucuguuuaaaaccgaggacgguguuaauaugugcacauugauggccauggauuuaggcgaacugugugaggacacuauuaccuacaacugcccacuacucagacaaaaugaaccggaggauaucgacuguuggugcaacucuacaucaaccugggugacuuaugggacauguaccgcgacgggagagcaccggcgcgaaaagcgaaguguggcucuggugccccaugucggcaugggucuugagacucguaccgaaacauggaugagcuccgagggggccuggaaacacgcacagagaauugagacuuggauccugaggcauccuggauucaccauaauggccgcuaucuuggcauacacaauuggcaccacguauuuucagcgggugcucaucuucauucugcugacugccguugcuccaucuaugacaaugcgcugcaucggcauaucgaauagagauuuuguggaaggggucucaggagguagcuggguggacauuguacucgagcacggcaguuguguuaccacuauggccaagaacaagcccacauuagauuucgaacugaucaaaaccgaggcgaagcagccugcaacgcuuaggaaauacugcauugaagccaaguugaccaauacaacuaccgcuucccgguguccaacacaaggggagcccucucugaacgaggaacaggacaaacgcuuugugugcaagcacagcauggucgaucgaggauggggcaaugguugugggcuauucggaaagggcggcaucgugacuugcgccauguuuaccugcaaaaagaacauggaggggaaaaucgugcagccugaaaaucucgaguauacaauugucguuaccccacauuccggagaagagaacgcaguggguaaugacacuggcaagcacgggaaagagauaaagguaacgccgcagucaaguaucacagaagcugagcugaccggauacggcacugugaccauggaauguagccccagaacaggucuugauuucaacgagaugguccuguugcaaauggaaaauaaagccuggcucgugcauaggcagugguuucuggacuuaccucugccauggcuccccggggcggauauucagggcucuaacuggauccagaaggagacccuuguuacuuucaagaacccucacgccaaaaagcaagacguggucgugcugggaucccaggagggcgcaaugcacacagcuuugacgggggccaccgaaauacagaugucaagcggaaaucuacuguuuacuggucaucucaaaugccggcugcguauggacaaacuucaacugaaaggcaugaguuauucuauguguacagggaaguucaagguaguuaaagagauugcugaaacccagcacggaacaaucgugguccgcgugcaguacgagggcgaugguuccccaugcaagauccccuucgagauuauggacuuggagaagcggcauguccucgggaggcugaucacugugaacccgauuguuaccggcaaggauagcccugugaauauagaggccgaacccccauuuggagacucguacaucauuaucggcguagagccugggcaguuaaaacugucuugguucaagaagggauccucaaucggucaaauguuugaaacgaccaugcggggcgcaaaacgaauggccauucuaggggauacagcuugggacuucggaagucucggcggugucuuuacuagcauagggaaggcgcugcaccagguguucggcgcaaucuauggagccgcuuuuuccggcguuucuuggaccaugaaaauucuuaucgggguggucauuacauggaucggaaugaacagccgcucaacaaguuuguccgugagccugguacucgugggcguugucacccuguaccuuggugugauggugcaggccgauucugggugugucguuucauggaagaauaaagagcugaagugcggaaguggcauauucaucacggacaacgugcauacauggaccgagcaguauaaguuucaacccgaaagcccauccaaauuggcaucugccauucagaaggcucacgaggaagguaucuguggcauuagaucggugacuaggcucgagaaucugauguggaaacagaucacacccgaauuaaaccacauacugagcgagaaugagguaaagcuauccauuaugaccggggauaucaaaggaauuaugcaggccggcaagcggucacuccgcccucaaccaacugaacugaaauacaguuggaagaccugggggaaggcaaaaaugcuuucuacagagccgcauaaccagacguucuugaucgacggacccgaaaccgcggagugcccuaauacuaacagagcuuggaauagccuggaagucgaggauuauggcuuugguguguucacaaccaacauauggcucaagcugaaagagaggcaggacguuuccugugacucaaaguuaaugagcgccgcaaucaaagauaaucgugccgugcacgcugacaugggguacuggauugaaucugcccugaacgauacauggaagaucgagaaggcauccuuuauugaagucaaaaguugccauuggccaaagagccacacucuuuggucuaacggaguguuggaguccgagaugaucauacccaaaaauuucgcuggcccuguuucacagcacaacuaucggccagguuaccauacccaaacggccggccccuggcaccucgggaagcuggaaauggacuucgauuuuugugagggaacaaccgugguagucacugaagacugcggcaaucgagggccgagucuaagaaccacaacugcgagcggaaaacugauuaccgaguggugcuguaggucgugcacacucccuccacugcgcuaccggggcgaagaugguuguugguaugggauggagaucagaccccuuaaggagaaggaagagaacuugguaaauucccuggugacggccggacauggccagaucgacaacuucucuuuagguguccucggcauggcucuguuucuugaagagaugcugaggacccgcguugggacuaaacacgcaguguugcucguagccgugagcuucaugacacugauuaccggaaauaugucauuucgagaucuaggccgggucauggugaugguuggggcugccaugacugacgauaucggaaugggcgugacauaccuggcacuccuggcggccuucaagguccguccuaccuuugcugccggucuuuugcugagaaaauuaacgaguaaggaacucaugaugacuaccauugggauagugcugcuuucccagucuacaacccccgagagcauccuggagcuaacugacgcacucgcucugggaaugaugauuuugaaaaucguuaggaacauggaaaaguaucaacuggccgugacaauuauggcaaucuuaugcgucccaaaugccguaauacuccagaacgcuuggaagguguccuguaccauccuggcggccguuucagugagcccucuucuguugacaaguucucagcagaaagcagauuggauuccccucgcucugacuaucaagggccuaaauccaaccgccauuuuccugacgacacuuucccgcaccaacaaaaagcggagcuggccgcucaaugaggccaucauggcugucggcauggugucgauacuggcaucaucuuugcugaaaaacgacauuccuaugacugggcccuuaguagccggaggucuccugaccgugugcuacguccuuacaggcagaagugcggaccuggaauuggagaaggcugccgauguuaggugggaagaccaagcagagaucuccgggagcucuccaauccucagcauuacuauauccgaggauggaucaaugaguaucaaaaaugaagaggaagaacagacccugacgauucuaauccgaacaggccugcuugugauuagcggucucuuucccgugucuaucccuauaaccgccgcugcaugguaucugugggaggucaagaagcagcgcgccgggguguugugggacguuccaucacccccuccgguaggaaaagcggaauuagaggauggcgcuuaccggaucaagcagaaaggcauucugggguauagccaaaucggagccgguguguacaaggaaggcacuuuccauacaauguggcacgucaccagaggggcagugcucaugcacaaaggaaagaggauugagccaaguugggccgacguucguaaggaucugaucagcuacggcgguggguggaaacuugaaggagaguggaaggagggcgaagaggugcagguccuggcuuuggaacccggcaaaaacccucgcgccgugcagacuaagccagggcuauuuaaaacaaacaccggaacgauaggugcaguaucccuggacuucucucccggcacuucggggagcccuauugucgauaagaagggaaaagugguuggccucuaugguaaugggguggucacccggucaggaacauacguguccgcuaucgcccagaccgagaagaguaucgaagacaacccggagauugaggaugacaucuuuaggaaaaagaggcugacaauaauggaucuucaucccggcgcgggcaaaacuaagcgauauuuaccagccauuguucgggaagcaaucaagcgcgggcugagaacccucauuuuggcuccuacgaggguggucgccgcugagauggaagaggcacugcggggacuccccauccgauaccaaacaccagccauaagagccgaacacacuggucgcgagauuguggaccugaugugucaugcuaccuucacaaugaggcuucugucuccuguacgugugcccaauuauaacuugaucaucauggacgaggcgcacuucaccgauccagcaagcauugccgcucggggcuacaucuccacuagaguugaaaugggggaggccgcaggaauuuuuaugaccgccacaccgccuggcucaagggaccccuucccacagucuaaugcucccauaauggaugaagaacgcgagaucccugaacgaagcuggaacaguggucaugagugggucacggacuuuaaagggaagacugugugguucgugccauccauuaaagcgggaaaugauaucgccgcaugccuaagaaagaacggcaaaaaggucauccagcugagccggaagaccuuugacucugaauauauuaaaacaaggaccaaugauugggacuucguagugacuacagauauaucagagaugggcgcuaacuuuaaggccgaacgcguuaucgacccccguagauguaugaaaccugugauucucaccgauggggaggagcgggucaucuuagcaggaccgaugccagugacgcacuccagugccgcucaaaggcgcggucgaauuggcagaaaucccaagaacgaaaaugaccaguacaucuacaugggggagccucuggaaaacgacgaggauugcgcccacuggaaagaagcgaagaugcuucuggacaauauaaacacucccgagggaaucauuccaagcauguucgagccugaacgggagaaaguugaugcaaucgacggcgaauauaggcuccgcggugaggccagaaagacauuuguggauuugaugaggagaggggaccugcccgucuggcucgcuuaccguguggccgcugaaggcauuaacuaugcagaucgccgaugguguuucgacggaaucaagaauaaccagauacuggaggagaauguagaaguggagauuuggaccaaagaaggcgagagaaagaaacuuaagccaagguggcuagaugcccggaucuacucggacccucuggcuuugaaagaguuuaaggaguucgccgcagggcgcaagucuuuaacccugaaccucauuacugagaugggaagacugccgacauucaugacccagaaagcgaggaaugcccuugauaaccuggcuguucuccauacagccgaagcagggggacgggcuuauaaucacgccuuguccgagcugcccgaaacucuagagacgcugcuccuucugaccuuauuggcaacagucacugggggaaucuuucuguuccucaugagcggcaaggguauagggaaaaugacccugggcaugugcugcaucauuacagccucaauccuucugugguacgcucaaauucagccacauuggaucgcggccaguauaauucucgaguuuuucuugaucgugcuguuaaucccugaacccgagaagcagcgaaccccacaggacaaccaacuaacuuauguggucauugcaauccugacgguuguggcugccaccauggccaaugaaaugggauuucucgagaaaacaaagaaggauuucggccuugggucuauagcaauucagcagccugaauccaacauccuggacauugacuugagacccgcuagcgccuggacucuguacgcgguagcuaccacauuuaucaccccgaugcuccgccacucaauagagaauaguagcgugaacgucucccugacugccaucgcaaaucaggccacagugcuuaugggacucgguaaaggcuggccacugucuaagauggauauugggguuccuuugcuggcuaucggauguuacagccaagugaaccccauuacguuaaccgcagcccuacugcuccuugucgcgcacuaugcuaucauuggcccaggucugcaggccaaagcaacuagggaggcccagaagcgggcugccgcagggaucaugaaaaaucccacaguagacggcgugaccguuauagauuuggacccuauuccguacgaucccaaguucgaaaagcagcugggacaagugaugcuccugguccuuugcgugacccaggucuuaaugaugcguacaacuugggcucugugugaggcccucacguuggcgaccggcccaaucuccacacugugggaagggaacccuggaagauuuuggaauacuaccaucgccgugucaauggcaaacauuuucaggggcucuuaucuagcuggugccgggcugcucuuuaguauaaugaaaaacacaaccaauacucgccggggaacgggcaacacaggugagacccuuggcgaaaaguggaaaaaucgacugaacucguuggguaagagcgaguuccagaucuacaaaagauccggcauucaagagguugacaggacucuggcaaaggaaggcaucaaacgcggggagaccgaucaucacgcugugucucggggaucagccaagcucagaugguuuguagaacguaaucuggugacacccgagggcaaggucguugacuuagguugcgggaggggaggcuggagcuauuacugugguggccuuaaaaacgugcgggaggucaaggggcugacuaaaggaggcccugggcaugaggaaccaauucccauguccaccuauggauggaaucucgugcgccuacagaguggcguagauguguucuucacaccuccagaaaagugcgacacgcuguugugugauaucggugagucuagccccaacccgaccguugaagccgggcgaacucugagagugcucaaucuugucgagaacuggcugaauaacaauacacaguuuugcauaaaaguguugaacccuuacaugccaucagucaucgagaagauggaaacccugcagaggaaguacggaggcgcgcucgugcggaaucccuuaucccgcaacaguacucacgagauguauuggguuagcaacgcuucuggcaauauuguauccucagugaacaugaucagcagaaugcugauuaauagguucacaaugcgacauaaaaaggcaaccuacgaaccugacgucgaucuugggucgggaacgcggaacaucgguauagagucugaaaccccaaaucuggacauuaucggcaaacguaucgagaagauuaaacaagagcacgaaacaaguuggcacuaugaccaggaucaucccuacaagacuugggccuaucacggguccuacgagaccaagcagacaggaagcgcuucauccauggugaacggcguugugagacuacucacuaaaccgugggacgucauaccuauggugacccagauggccaugacagauaccacucccuuuggucaacagcgcguauucaaggaaaaaguggacacgaggacacaggagccaaaggaagggaccaaaaagcugaugaagaucacugcagagugguuguggaaagagcugggaaagaaaaagaccccucggauguguacaagagaagaguuugcccgcaaaguuaggucuaaugcugcgcucggcgccauuuucacggaugaaaacaaguggaaaagcgcacgagaggcugucgaggacagucgguuuugggaacuuguggauaaggagagaaaucugcauuuagaaggcaagugcgagaccuguguguauaacaugauggggaaaagggaaaagaaaaucggagaguucgguaaggccaaaggcucccgcgcaauuugguacauguggcugggggccagauuuuuggaguucgaagcucucggauuucugaaugaggaccacugguucagccgggaaaacucucuaucaggcgucgagggugaagggcuucacaagcugggauacauccucagagagguuaguaagaaagagggcggcgccauguaugcggaugacacugcagggugggauacaaggauaacccuggaagacuugaagaaugaggaaauggugacuaaccauauggagggagaacacaaaaagcuggccgaggcuaucuuuaaacucacauaccagaauaagguagugcgcguccaacgacccaccccacgggguacagugauggacauuaucuccagaagggaucagcgcggcagcgggcagguuggaacuuauggccuuaacaccuucacgaacaugggugcccaacugauuagacagauggagggggaaggaguguucaagggcauccagcauuuaaccgcaacagaggaagucgcugugcaggacuggcuggcccggguaggcagggagcguuugucucgaauggcuauuucgggggaugacugcguugugaaaccccucgaugaccgcuuugccucagcacugacugcgcuaaaugauaugggaaaggucagaaaagacauacaacagugggagccuagccgggguuggaacgauuggacccaggugccauucugcucccaccauuuucacgaacuuaucaugaaggacggcagggugcuggucguuccgugucgcaaucaggaugagcucauugggagagcccggaucagucaaggagcuggcuggucucugagggaaacagccugcuuggguaaaagcuacgcacagaugugguccuuaauguauuuccaccgacgugaccugagacucgcugccaacgcaaucuguucagccgugcccagucauuggguaccuacuucucgcaccacguggagcauucacgcggggcaugaguggaugacaaccgaagauaugcuuacuguguggaaucgggucuggauacaggagaacccauggauggaggacaagacacccguggaauccugggaggaaaucccuuaccugggaaagagggaggaccaguggugcggcucacuaauuggccugaccagcagagcuacuugggcccgcaauauccaaaccgcaauuaaccagguucggucucucaucggguccgaagaguauacagauuacaugccaaguaugaaaagguuucgaagagaggaagaggaagccggaguguugugguga

SEQ ID NO: 14916 - RNA, 9876 nt, Artificial Sequence
  derived and/or modified CDS sequence (opt3) from DENV-2__FM210231__SS-prME
agcgcaggaaugaucauuaugcugauccccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacuaucacuuacaaaugcccacugcucaggcaaaacgaaccggaggauauugacuguuggugcaauucuaccucaacaugggugaccuauggaacuuguacgaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucguacugcagaaugccuggaaggugucauguaccauucuugcuguugugagugucuccccacuguugcucacaucuagccagcagaagacugacuggaucccucuggcgcuaaccauaaagggacugaaccccacggccauuuuccuuacaacccucuccagaacuaauaaaaagaggucauggccacugaacgaggcaaucauggcugugggcaugguaagcaucuuggccaguucucuguuaaagaaugacauuccgaugaccggcccucucguggccgggggacugcuuacagucugcuauguucugacuggucgcuccgcugauuuggaacucgagcgggcaaccgacgugaaaugggaggaucaggccgaaauaagcggcucgucacccauccugucuauuacgaucagugaggacggguccaugagcauuaagaacgaagaggaggaacagacacuaaccauccugauaagaacuggacuucucgugaucucuggccuguuuccaauuagcauccccauuacagcggcugccugguacuugugggaggucaaaaagcagagggccgguguguuaugggauguuccuuccccacccccuauggggaaagccgaacuggaggacggagcuuaucgaaucaagcaaaagggcauacucggcuacucacagauuggggcaggaguauacaaagaagguaccuuccacacuauguggcaugugacacgcggcgccguccugaugcacaaggggaaacggaucgagccgaguugggcggaugugaagaaagaccuuaucagcuauggaggcgguuggaagcuggagggggaauggaaggagggagaagagguucagguguuggcucuagaaccaggcaaaaaucccagagccguccagaccaagccuggccuguuuaaaacgaacacugggaccauuggagcagugucucucgauuucuccccagguacaucaggcagucccaucauagacaagaaagggaagguagucggacuguacggcaacggugugguuaccaggagcggggccuauguguccgcuauugcccaaacagagaagucuaucgaggauaauccugaaauugaggacgauaucuuucguaaacgccggcuuacuauaauggacuuacacccgggagcaggcaagaccaaaagauaccugcccgcuauugucagggaagccaucaagcgaggccuccggacguugauccuggcgccaacacgcgugguugccgcagagauggaagaggcucucagagggcugccuauuagguaucagacucccgccaucaaagcugagcauaccggacgggaaauuguggaccuuaugugucacgcaacauucaccaugcgacuguugucgccagucagagugccuaacuacaaucuaauaaucauggaugaggcccauuucacugaccccgccagcauugcugcgcgcgguuauaucucaaccaggguagaaaugggcgaggcagccgggaucuuuaugacagcuacgccaccgggaucccgugauccuuucccccagaguaacgccccaauuauagacgaggaacgggagauccccgaaagaucuuggaauagcggccacgagugggugacugauuuuaaggguaagaccguuugguucgucccuuccauuaaagcagggaacgacaucgccgcuugccugaggaagaauggcaagaaggugauucaacucucacgcaaaacauuugauucugaauacgugaagacccgaacuaacgacugggauuucgucguaacaaccgacaucagcgagaugggcgcgaauuuuaaagccgagagagugauagauccacggagguguaugaagcccguuaucuuaacggacggcgaagaacgcgugauucuggcagggccuaugccggucacucauaguuccgcugcccagcguagaggacggaucgguaggaacccaaagaaugaaaacgaccaguacauuuauaugggcgagccccuugaaaaugaugaggacugcgcacacuggaaagaggccaagaugcugcucgauaacaucaauacaccugaagggauaauucccagcauguucgagccagaacgcgagaaaguggacgcuaucgauggagaauaccgauugagaggcgaggcccggaagaccuuuguugaccugaugaggcgcggugaucucccuguguggcuggcguauaaagucgcagccgaggggauuaacuacgcugacagaaggugguguuucgauggcaucaagaacaaucagauacuugaagagaacguggaaguagagaucuggaccaaggagggagaacggaaaaagcuaaaaccccguuggcuggacgcccgcauuuauucugauccauuggcuuuaaaggaguuuaaagaguucgcagccggccgaaagucacugacucucaaucugaucacagagauggggagacuuccuaccuucaugacacaaaagacuagggacgcucuggauaaccucgccguguugcacacggcagaagcgggaggucgggccuacaaucaugcucuguccgagcuaccggagacccuggaaacacuccuucuguuaacuuugcuggccaccguuacaggcgggauuuuucucuuccugaugaguggacgcggcaucgguaaaaugacccuugggaugugcugcauaauuacugcaagcauccugcucugguaugcucagauccagccccacuggauugccgcaucgaucauauuggaguuuuuccugauugucuuacuaaucccagaaccugagaagcagagaacgccccaagacaaccagcugaccuacguggugauugccauccucacagucguugcugcgacuauggccaaugaaaugggcuuucuugagaaaaccaagaaagaccugggauugggcucuauagugacacagcagccagaguccaacauccuggauauugaccucaggccugcaagcgcuuggacccuguacgccguagccacuacauucgugacgcccaugcuucggcauucaaucgaaaauaguucugucaacgugucccucaccgcaauugcuaaucaagccacuguucugaugggguugggaaaggguuggccgcugagcaagauggauaucggcgugccauuacuagcgauuggguguuauucacaggucaacccuaucacacugaccgcugcccuccuucuguugguagcacacuacgccauaauuggacccggccugcaggcuaaagcaacccgagaggcccagaagagagcggcugccgguaucaugaaaaauccaacaguggacgggaucacuguuauugaucucgaccccauaccuuaugauccgaaguuugaaaaacaacugggccaggugaugcuuuuaauccugugcgucacacaggugcucaugaugcgcaccacaugggcauugugugaggcccugacucuagcuaccggacccauuaguacacugugggaaggcaacccagggagguucuggaauaccacuaucgccgucagcauggcaaacauuuuucggggauccuaccucgcuggcgccggucuucuguucucuaucaugaagaauacgacaaacacccguagagggacuggaaacauaggcgagaccuugggugagaaauggaaaagcaggcugaaugcgcucggcaaguccgaauuucaaaucuauaaaaagucagggauucaggagguggaccgcacacuggccaaagaaggaaucaagcggggcgagacugaucaccaugcaguuucucgagggagugcuaaauuaagaugguucguggagaggaacaugguaaccccugaaggaaagguggucgaccuuggcugcggucgcgggggauggucguacuauuguggcggucuaaagagcguucgggaggugaaaggccucacaaaagggggacccggccacgaagaaccuauuccaauguccacguacggguggaaucuagucagacugcagucuggaguggauguauuuuucauacccccugaaaaaugcgacaccuugcugugugauauaggcgagucaagcccaaaccccacuguggaggccggucguacacucaggguucuuaaucugguggaaaacugguugaauaacaauacccaguucugcauuaagguccugaacccguacaugccuuccgugaucgagaaaauggaagcacuccaacggaaguaugggggagcuuuaguccgcaauccacugagucgaaacucuacucaugagauguacugggugagcaaugccucaggcaacaucguuuccaguguaaauaugauuagcagaaugcuuauaaacagguuuacaaugcggcacaagaaagccaccuaugaacccgacguggaccugggcucugggacgcgcaacaucggaauugaguccgagaucccuaaucuagauauuaucgguaagagaauagagaagaucaagcaggagcaugaaaccucauggcacuacgaccaggaucacccauauaaaacaugggcguaccauggcagcuaugagacuaagcagaccgggucggcuucuaguauggucaacggagugguuaggcuccugacaaagcccugggacguguugccgacugucacccaaauggcaaugacagauaccacuccuuucggccagcagcgaguguuuaaagaaaagguagacacgcggacacaggagcccaaagaggguaccaagaaacugaugaagauuacugccgaauggcucuggaaagagcuugggaagaagaaaaccccacguauguguacaagagaagaguucacgcgcaaggugagguccaaugcugcccugggagcaaucuuuaccgaugagaacaaauggaaaagcgcccgggaagcuguugaggacucaagauucugggaauuagucgauaaagagcgcaaucugcacuuggaaggcaagugcgagacuuguguguacaacaugaugggcaagagggagaaaaagcucggggaauuuggaaaagcgaaggguucccgagccauuugguacauguggcugggcgcacgguuccuagaguuugaagcucuuggguuccugaaugaggaccauugguuuucuagagaaaacagccucaguggaguggagggcgagggucugcacaaauugggguauauccugagggaugucuccaagaaggaaggaggcgccauguacgcagacgacacagccggcugggauacccgcauuacucucgaggaccuuaaaaaugaagagaugguuacaaaccacauggaaggggagcauaagaaacuggcugaggccauauucaaguuaaccuaucaaaauaaagugguacgugugcagcggccuacacccagaggaacugucauggauaucauuagcaggcgcgaccagcgagguucuggccaaguggggaccuacggacugaacacguuuaccaauauggaagcgcaguugauccggcagauggagggcgaagguguuuucaagaacauccagcaccucacagugacugaggaggucgcagugcaaaauuggcuggccagaguagggagggaacgccuaucaagaauggcuauuaguggagaugacugcguugugaagccacuugaugaccgguucgccaacgcacugaccgcucucaacgauaugggcaaaauaaggaaggacauccagcagugggagcccuccaaaggcuggaaugauuggacacaggucccuuuuugcagccaucacuuccaugaacugauuaugaaggacgggcguguguugguggucccaugucgaaaccaagaugaguuaaucggacgcgccagaauuucucagggugcuggcuggucgcugcgggaaacugccugccucgggaaaucauaugcacagauguggagccuuauguacuuucacaggcgcgaccugagacuagcggccaaugcuaucuguuccgccguuccgagucacugggugcccaccucucggacgacauggagcauacaugcaaagcacgaguggaugaccacugaggacaugcugacaguauggaacaggguguggauccgagaaaauccuuggauggaggauaagaccccagucgaauccugggaggaaauucccuaucucggaaaacgugaggaccaguggugcggcucauugaucggucugacaaguagagcuaccugggccaagaacauucaagcagccaucaaucaggugcgcucucuuauagggaacgaggaauacacagauuacaugccuagcaugaaacgguucaggagagaggaagaggaagcgggaguucugugguga

SEQ ID NO: 14917 - RNA, 9876 nt, Artificial Sequence
  derived and/or modified CDS sequence (opt3) from DENV-2__FM210239__SS-prME
accgccggcgugauaauuaugcugauacccacagcuauggcauuccaccucacuacgaggaauggggaaccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccaggacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuuggugaacagucuggucacugcuggacacggccagauagauaauuuuagcuuaggugugcucggcauggcacuguuccuugaagagaugcugcgcacacgaguugggaccaaacaugccaucuugcucgugacuguaucguuugucacacugauuaccggaaacauguccuuccgggaccuaggccgugugauggugauggucggggcugccaugacggaugacaucggaaugggcguuacuuaccuggcacuccuggcggccuuuaaggugagaccuaccuucgcugccggucuuuugcugaggaaauuaacaucuaaggagcucaugauggcaaccauugggaucgcucugcuuagccagucaacuauacccgaaacaauccuggagcuaaccgaugcccucgcacugggaaugaugguauugaaaauugugcgcaauauggaaaaguaucaacuggccgucacaaucauggcuauuaguugcgugccaaacgcgguuaucuuacagaaugccuggaagguguccuguacuauacucgcagcugucucugugagcccucugcuucugaccuccucacagcagaaagccgacuggauucccuuggcccucacgaucaagggccugaacccaacagcuaucuuucuaaccacucugagccggaccaguaaaaagagaucuuggccgcuuaaugaggcaauuauggccguuggcaugguguccauacucgcgagcucgcuguugaaaaacgacaucccuaugacagggccccuggucgcuggagguuuacucacuguaugcuacgugcugaccggcaggucagccgaucuugaacuggagcgagcaacggacguuaagugggaggaucaagccgaaauuucugggaguuccccaaucuugagcauuacaaucgcugaggacggaucuaugagcaucaagaaugaagaggaggaacagacccucacuauccugauucgcacaggccuacuggugaucuccggucuuuuccccgucucaauuccuaucaccgcagccgcgugguaucucugggaggugaagaagcagcgggcugggguacugugggaugugccaagucccccuccggucggaaaagccgaauuggaggacggcgcauacagaauaaagcagaaaggcauuuuaggguauagccaaaucggagccgguguuuacaaggaaggcacuuuucacacaauguggcacgugaccagaggggcugugcugaugcaucguggaaaacgcaucgagccaucuugggccgaugucaagaaggaccucauuuccuacggcgguggguggaaacuggagggagaauggaaggagggcgaagaggugcagguucuugcacuggaacccggcaaaaacccucgggcuguacagacgaagccaggguuguucaaaacuaauaccggaacaaucggugccgugucacuagauuuuagucccggcaccagcggguccccuauagucgacagaaagggaaaggugguuggccuguaugguaacgggguggucacaaggucuggagcguacgugucggccauugcacagacugagaaaagcaucgaggauaauccggaaauugaggacgauaucuuccgaaagaaacggcucaccauaauggaccugcaccccggcgcuggcaagacgaaacgcuaucuuccagccauuguaagagaagcuaucaagaggggguuacggacacugauccucgcaccuacucgagucguggccgccgagauggaagaggcuuugagaggacugcccauucgcuaccaaaccccagcgaucagggcagagcauacaggucgugaaauuguugaccucaugugucacgccaccuucacuaugcggcugcuuucaccugugagaguccccaacuauaaccugauaaucauggaugaggcucauuuuaccgacccagccuccauugcagccaggggcuacaucaguacacgcguggaaaugggggaggcugcgggaaucuucaugacggccacuccgccuggcucucgagaucccuuuccacagagcaaugcacccauuauggacgaggaaagagagauaccugaacgguccuggaacucaggucacgaguggguuaccgauuucaaggggaaaacagugugguuugucccaucuaucaaggcuggaaaugacauugccgcaugcuugaggaaaaacggcaagaaagugauccagcuaagccgcaagaccuucgauagugaauauguaaagacucguacaaaugacugggauuuugugguuaccacggacauuuccgagaugggcgccaacuucaaagcugagagagucaucgauccccggagguguaugaagccugugauacugacugacggggaagaacgcgugauccucgccggaccgaugccagucacacacagcucugcggcacaacgaagaggucggauuggcaggaaucccaaaaacgaaaaugaccaguacaucuacaugggggagccuuuagaaaacgaugaggacugcgcccauuggaaggaggcuaaaaugcugcuugauaauauuaacacccccgaaggaaucauaccaucaauguuugagccugaacgcgagaagguagacgccauugauggcgaauauagacugaggggugaggcucggcguaccuucguggaccucaugcgccgaggggauuugcccguuuggcuggcauacagaguggccgcugagggcaucaauuaugccgacaggcggugguguuuugauggagucaaaaacaaucagauucucgaagagaacguggaaguugagaucuggacuaaggagggcgaacgcaagaaacugaagccaagauggcuugacgcaaggauauacuccgauccucuagcgcugaaagaguucaaggaguucgccgcugggcggaaaaguuugacauuaaaccugaucaccgagaugggacgacucccgacauuuaugacucagaaggccagagacgcacuggauaaucuugcugugcugcacacggccgaagccgguggacgcgcauauaaccaugcucucagcgaguugcccgagacccuggaaacacuacugcuccuuacucuguuagcgaccgucacagggggaauuuucuuguuucugaugucgggcaaggguguggggaaaaugacccucggcaugugcugcaucauuacugccucuauccugcuuugguacgcacaaauacagccacacuggauugcugccuccaucauccuggaguucuuucucauuguauugcugaucccugaacccgagaagcagaggacgccacaggacaaucaauuaaccuaugugguuauagccauucuaacagucguggcagcuacuauggccaacgaaaugggauuccuggagaaaaccaagaaagaccucggccuugggagcaucgcgacacaggagccugaaucaaauauucuggauaucgacuugcggcccgcuagugccuggacccuguacgcaguggccacuacauuugucacgccgaugcuccgucacucuauagagaacuccagcguuaaugugucacugaccgcuaucgcaaaccaggccacuguacuuaugggacucgguaagggcuggccacugaguaagauggauauuggggugccuuugcuggcgaucggauguuacagccaggucaaucccauuacauuaaccgcugcccuacugcuccuuguggcacauuaugccaucauuggcccaggucugcaagcuaaagccaccagagaagcacagaagagggcugccgcggggaucaugaaaaaccccacaguugacggcgugacugucauagauuuggacccuauuccguacgaucccaaguucgagaaacagcugggacagguaaugcuccugauccuuugcgugacgcaaguuuuaaugaugcgcaccacaugggcccugugugaagcacucacuuuggcuaccggcccaaucuccacacugugggaggggaauccuggacgguuuuggaacaccacuauugccgugucuauggcaaauauauuccgaggcagcuaucuagcuggugccgggcugcucuuuuccaucaugaagaacacgacaaauaccagaaggggaacuggcaacauuggugagacccuuggcgaaaaguggaaaucacgccugaaugccuuggggaagucugaguuccagaucuacaaaaagaguggcauucaggaagucgaccggacacuggcgaaagagggcaucaagagaggggagacugaucaccaugcugugucgcguggaagcgcaaaacucaggugguuugucgaacggaacauggugacccccgagggcaagguuguggaccuggguugcgggcgcggaggcugguccuauuacugugguggcuuaaaggauguacgagaagugaaagggcuuacaaagggaggcccugggcacgaggaaccaauacccaugucuacguauggauggaaccuggucagacuccaaucaggcguugacguguucuucaccccuccagagaaaugcgauacucuacugugugacaucggugagagcucccccaauccgacaauugaagccgggaggaccuugcggguccugagucucguggagaacuggcuuaauaacgacacucaguuuugcaucaagguacugaauccuuacaugccaucugugauugagaaaauggagacauugcagcgcaaguacggaggcgcucugguuagaaacccccucagcagaaauucaacccaugaaauguauuggguguccaacgccacgggcaauaucgucaguagcgugaacaugauaucucgaauguuaauuaaucgguucaccaugaagcacaaaaaggcaacauacgagccugaugucgaccugggguccggaacucguaacaucgguaucgagucagaaauuccaaaucuugauauaaucggcaaaagaauugagaagaucaaacaggaacacgagaccagcuggcauuaugaccaagaucaccccuacaagacaugggccuaucaugggucguacgaaacuaagcagaccggaucugcuaguuccauggugaacggcguuguacgccugcuaacaaaaccgugggacguggucccuauggugacccagauggcgaugacugauacgacacccuuuggucagcaaaggguuuucaaggagaaaguggacacccggacucaggagccaaaggaagggaccaaaaagcucaugaagauuacagccgaguggcuguggaaagaauugggaaagaaaaagacgccuagaauguguacccgcgaggaguuuacuaggaaaguccgaagcaaugcagcucugggcgccaucuucacagaugaaaacaaguggaaaucagcacgggaggccguggaagacuccagauuuugggagcucguagauaaggaaaggaaccuucaccuggagggcaagugcgagaccuguguguauaauaugauggggaaacgcgaaaagaaauuaggagaguucgguaaggcuaaaggcucucgugccauaugguacauguggcugggggcgcgguuuuuggaguucgaggcacucggauuucugaacgaagaccacugguucagcagagagaauagucuauccggcguugagggugaagggcuucauaagcugggauacauccucagggacgucagcaagaaagagggcggcgccauguaugcugaugacacugccgggugggauacacgcauuacccuggaagacuugaagaacgaggaaauggugacaaaucacauggagggagagcauaaaaagcuggcagaagcuaucuuuaaacucacuuaccagaacaaggugguccgaguucagcggcccaccccaagagguacggugauggauauuaucucuaggcgcgaccaaagaggcucagggcagguaggaaccuauggccuuaauacauucacuaacauggaggcccagcugauucggcaaauggaaggugaggggguguucaagaguauacagagguuaaccgucacagaggaaaucgcugugcagaauuggcuggcccguguuggacgagagcgcuuguccagaauggcaauuagcggcgaugacugcguggucaaaccccucgaugaccgguuugcgucugcccugacugcucuaaacgauaugggcaaggugaggaaagacauccagcaaugggaaccuucgcgcggguggaaugauuggacccagguaccauucugcucacaccauuuucacgagcuuaucaugaaggacggaagaguucugguggucccgugucggaaccaggacgaacucauugguagggcccgaauaagccagggcgcaggguggucccugaaagagacggcuugcuugggaaagaguuacgcccaaauguggucuuuaauguauuuccaccguagagaucugcgccucgcagccaaugcgaucuguagcgcugugcccucccauugggugccuacaucacggaccacuuggaguauucacgccaagcaugaguggaugacaaccgaagacaugcuuacugucuggaacaggguuuggauccaggagaauccauggauggaagauaaaacccccguggagucuugggaagagguaccuuaccugggcaagagagaggaccaguggugcgguagccuaauugggcugacaucccgcgcaacgugggccaaaaacauccagaccgcuauaaaccaagugcggucacucaucggaaaugaagaguauacugauuacaugccaagcaugaagagguuucgaagagaagaggaagaggccggcgucuugugguga

SEQ ID NO: 14918 - RNA, 9876 nt, Artificial Sequence
  derived and/or modified CDS sequence (opt3) from DENV-2__FM210232__SS-prME
accgccggcgugaucauuaugcugauacccacagcuauggcauuccaccucacuacgagaaacggggagccucauaugaucgucggaaggcaggaaaaggguaaaagccuucuguuuaagaccgaggacggcguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagagcaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaagcuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaauucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagccugcggcaacagagggccgucucuaaggacuaccacagcuuccggaaaacugaucacggaguggugcugucgcucaugcacccucccuccacugcgguacagaggcgaggaugguuguugguaugggauggaaauuaggccccuuaaggagaaggaagagaauuuggugaacagucuggucacugcaggacacggccagauagacaauuuuagcuuaggugugcucggcauggcccuguuccuugaagagaugcugcgcacacgaguugggaccaaacaugcuaucuugcucgugacuguaucguuugucacacugauuaccggaaacauguccuuccgggaucuaggccgugugauggugauggucggggccgcaaugacggacgauaucggaaugggcguuacuuaccuggcgcuccuggccgcuuuuaaggugagaccuaccuucgccgcaggucuuuugcugaggaaauuaacaucuaaggagcucaugauggcuaccauugggaucgcccugcuuagccagucaacuauacccgaaacaauccuggagcuaaccgacgcacucgcccugggaaugaugguauugaaaauugugcgcaauauggaaaaguaucaacuggcugucacaaucauggcgauuaguugcgugccaaacgccguuaucuuacagaaugcauggaagguguccuguacuauacucgcugccgucucugugagcccucugcuucugaccuccucacagcagaaagccgauuggauucccuuggcucucacgaucaagggccugaacccaacagcaaucuuucuaaccacucugagccggaccaguaaaaagagaucuuggccgcuuaaugaggccauuauggcgguuggcaugguguccauacucgcuagcucgcuguugaaaaacgacaucccuaugacagggccccuggucgccggagguuuacucacuguaugcuacgugcugaccggcaggucagcagaccuugaacuggagcgagccacggauguuaagugggaggaccaagcugaaauuucugggaguuccccaaucuugagcauuacaaucgcagaggauggaucuaugagcauaaaaaaugaagaggaggaacagacccucacuauccugauucgcacaggccuacuggugaucuccggucuuuuccccgucucaauuccuaucaccgccgcggcuugguaucucugggaggugaagaagcagcgggccgggguacugugggacgugccaagucccccuccggucggaaaagcagaauuggaggauggcgccuacagaauaaagcagaaaggcauuuuaggguauagccaaaucggagcugguguuuacaaggaaggcacuuuucacacaauguggcacgugaccaggggggccgugcugaugcaucguggaaaacgcaucgagccaucuugggcagacgucaagaaggaucucauuuccuacggcgguggguggaaacuggagggagaauggaaggagggcgaagaggugcagguucuugcucuggaacccggcaaaaacccucgggccguacagacgaagccaggguuguucaaaacuaauaccggaacaaucggugcggugucacuagacuuuagucccggcaccagcggguccccuauagucgauagaaagggaaaggugguuggccuguaugguaacgggguggucacaaggucuggagccuacgugucggcaauugcucagacugagaaaagcaucgaggacaauccggaaauugaggaugacaucuuccgaaagaaacggcucaccauaauggaucugcaccccggcgccggcaagacgaaacgcuaucuuccagcuauuguaagagaagcaaucaagaggggguuacggacacugauccucgccccuacucgagucguggccgcugagauggaagaggcguugagaggacugcccauucgcuaccaaaccccagcaaucagggccgagcauacaggucgugaaauuguugaccucaugugucacgcuaccuucacuaugcggcugcuuucaccugugagaguccccaacuauaaccugauaaucauggacgaggcccauuuuaccgauccagcauccauugccgcuaggggcuacaucaguacacgcguggaaaugggggaggcggccggaaucuucaugacggcaacuccgccuggcucucgagaccccuuuccacagagcaaugcucccauuauggaugaggaaagagagauaccugaacgguccuggaacucaggucacgaguggguuaccgacuucaaggggaaaacagugugguuugucccaucuaucaaggccggaaaugauauugcagccugcuugaggaaaaacggcaagaaagugauccagcuaagccgcaagaccuucgacagugaauauguaaagacucguacaaaugauugggacuuugugguuaccacggauauuuccgagaugggcgcuaacuucaaagccgagagagucaucgacccccggagguguaugaagccugugauacugacugauggggaagagcgcgugauccucgcgggaccgaugccagucacacacagcucugcagcccaacgaagaggucggauuggcaggaaucccaaaaacgaaaaugaccaguacaucuacaugggggagccuuuagaaaacgacgaggauugcgcucauuggaaggaggccaaaaugcugcuugacaauauuaacacccccgaaggaaucauaccaucaauguuugagccugaacgcgagaagguagaugcuauugacggcgaauauagacugaggggugaggcacggaaaaccuucguggaucucaugcgucgcggggacuugcccguuuggcuggccuaccgaguggcugccgagggcaucaauuaugcagauagaaggugguguuuugacggagucaagaacaaucagauucucgaagagaacguggaaguugagaucuggacuaaggagggcgaacggaaaaagcugaaaccacgcuggcuugaugcgagaauauacuccgacccucuagcccugaaggaguucaaagaauucgcugccgggaggaagaguuugacauuaaaccugaucaccgagaugggacggcucccgacauuuaugacucagaaggcacgagaugcucuggacaaucuugccgugcugcacacggcagaagccgguggcagagcuuauaaccaugcgcucagcgaguugcccgagacccuggaaacacuacugcuccuuacucuguuagccaccgucacagggggaauuuucuuguuucugaugucgggcaaagguguggggaagaugacccucggcaugugcugcaucauuacugcaucuauccugcuuugguacgcucaaauacagccacacuggauugccgccuccaucauccuggaguucuuucucauuguauugcugaucccugaacccgagaaacagcgcacgccacaggauaaucaauuaaccuaugugguuauagcaauucuaacagucguggcugccacuauggcgaacgaaaugggauuccuggagaagaccaaaaaggaccucggccuugggagcaucgcuacacaggagccugaaucaaauauucuggacaucgauuugaggcccgccagugcauggacccuguacgccguggcuacuacauuugucacgccgaugcuccggcacucuauagagaacuccagcguuaaugugucacugaccgcaaucgccaaccaggcgacuguacuuaugggacucgguaagggcuggccacugaguaaaauggacauuggggugccuuugcuggcuaucggauguuacagccaggucaaucccauuacauuaaccgccgcacuacugcuccuuguggcccauuaugcuaucauuggcccaggucugcaagccaaggcaacccgugaagcucagaaaagagccgcggccgggaucaugaagaaccccacaguugauggcgugacugucauagacuuggauccuauuccguacgaccccaaauucgagaagcagcugggacagguaaugcuccugauccuuugcgugacgcaaguuuuaaugaugaggaccacaugggcacugugugaagcucucacuuuggccaccggcccaaucuccacacugugggaggggaauccuggacgcuuuuggaacaccacuauugcagugucuauggcuaauauauuccggggcagcuaucuagccggugccgggcugcucuuuuccaucaugaagaacacgacaaauacccgaagaggaacuggcaacauuggugagacccuuggcgaaaaauggaagucaaggcugaaugcguuggggaaaucugaguuccagaucuacaagaaaaguggaauucaggaagucgaucgcacacuggcuaaggagggcaucaaacggggggagacugaccaccaugcagugucgagaggaagcgccaagcuccguugguuugucgaaaggaacauggugacccccgagggcaagguuguggaucuggguugcgggcggggaggcugguccuauuacugugguggcuuaaaagacguacgcgaagugaaggggcuuacaaaaggaggcccugggcacgaggaaccaauacccaugucuacguauggauggaaccugguccgacuccaaucaggcguugauguguucuucaccccuccagagaagugcgacacucuacugugugauaucggugagagcucccccaauccgacaauugaagcugggagaaccuugaggguccugagucucguggagaacuggcuuaauaacgacacucaguuuugcaucaaaguacugaauccuuacaugccaucugugauugaaaagauggagacauugcagcggaaguacggaggcgcccugguucgcaacccccucagcagaaauucaacccaugaaauguauuggguguccaacgcaacgggcaauaucgucaguagcgugaacaugauaucuaggauguuaauuaaucgauucaccaugaaacacaagaaagccacauacgagccugacgucgaucugggguccggaacucggaacaucgguaucgagucagaaauuccaaaucuugacauaaucggcaagcguauugagaaaaucaagcaggaacacgagaccagcuggcauuaugaucaagaccaccccuacaagacaugggcuuaucaugggucguacgaaacuaaacagaccggaucugcgaguuccauggugaacggcguuguaagacugcuaacaaagccgugggauguggucccuauggugacccagauggccaugacugacacgacacccuuuggucagcaacgcguuuucaaagagaagguggauaccaggacucaggagccaaaagaagggaccaagaagcucaugaaaauuacagcagaguggcuguggaaggaauugggaaaaaagaaaacgccucggauguguaccagagaggaguuuacucgcaaggucaggagcaaugcugcccugggcgcaaucuucacagacgaaaacaaauggaagucagcccgagaggcuguggaagauucccgguuuugggagcucguagacaaggaaagaaaccuucaccuggagggcaaaugcgagaccuguguguauaauaugauggggaagagggaaaaaaaguuaggagaguucgguaaagccaagggcucucgcgcgauaugguacauguggcugggggcacguuuuuuggaauucgaggcccucggauuucugaacgaagaucacugguucagccgggagaauagucuauccggcguugagggugaagggcuucauaagcugggauacauccucagagacgucagcaaaaaggagggcggcgcuauguaugccgacgauacugcagggugggacacaaggauuacccuggaagauuugaaaaacgaggaaauggugacaaaucacauggagggagagcauaagaaacuggcugaagccaucuuuaagcucacuuaccagaacaaggugguccgcguucagcgacccaccccacgggguacggugauggacauuaucucuagaagggaucaacgcggcucagggcagguaggaaccuauggccuuaauacauucacuaacauggaggcucagcugauuagacaaauggaaggugaggggguguucaaaaguauacagcacuuaaccgucacagaggaaaucgccgugcagaauuggcuggcacggguuggaagggagcguuugucccgaauggcgauuagcggcgacgauugcguggucaagccccucgacgaucgcuuugccucugcucugacugcccuaaacgacaugggcaaagugagaaaggauauccagcaaugggaaccuucgcggggguggaaugacuggacccagguaccauucugcucacaucacuuucacgagcuuaucaugaaagauggaaggguucugguggucccgugucgcaaccaggacgaacucauugguagagcacggauaagccagggcgcuggguggucccugaaggagacggccugcuugggaaagaguuacgcacaaauguggucuuuaauguauuuccauaggcgagaccugcgucucgccgcgaaugcuaucuguagcgccgugcccucccacugggugccuacaucaagaaccacuuggaguauucaugcaaaacacgaguggaugacaaccgaagauaugcuuacugucuggaaccgcguuuggauccaggagaauccauggauggaagacaagacccccguggagucuugggaagagguaccuuaccugggcaaacgggaggaucaguggugcgguagccuaauugggcugacauccagggccacgugggcuaagaacauccagaccgccauaaaccaagugagaucacucaucggaaaugaagaguauacugacuacaugccaagcaugaaacgcuuucggagggaagaggaagaggcaggcgucuugugguga

SEQ ID NO: 14919 - RNA, 9876 nt, Artificial Sequence
  derived and/or modified CDS sequence (opt3) from DENV-2__FM210233__SS-prME
agcgcaggaaugaucauuaugcugauaccaaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacgaucacuuacaaaugcccacuacucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauacgggggaucaugcaagccggaaaacgcucgcucagaccucagccaaccgagcugaaguacagcuggaagacauggggcaaagcuaagaugcuuuccacggaaucauauaaccagaccuucuugauugacgggccggagacugccgagugccccaauacaaacagggcauggaauagucuggaaguggaggauuacggauuuggcguguucaccacaaacaucuggcucaaacugaaggaaaaacaggacgcguuuugugacucuaaguuaaugagcgcugccauuaaggauaaucgugcaguacaugccgacauggguuauuggauggaguccgcucugaacgauacuuggaaaaucgagaaggccucauucauagaagucaaaaauugccacuggccuaagagccauacccuuuggucuaacgggguguuggaguccgaaaugauuauccccaagaaccucgcaggacccguuagucaacacaauuaccggccuggcuaccacacgcagaucgcugguccauggcaucugggcaagcuagagauggacuucgauuuuugugacgggacaaccgugauugucacugaagauugcggaaaccgaggccccagccugagaaccacaacugccucugggaagcucaucaccgaguggugcuguagguccugcacacugccgccucuucgcuaucggggagaggacggcuguugguacgguauggaaauuagaccauugaaagagaaggaagagaaucuggugaacucauuaguuacggcggggcacggacagguggauaauuucagucucggcguacuggguauggcccuuuuucuggaagagauguugaggacccgcgucggcacuaaacaugcuauacuccugguggcagugagcuucgucacacuaaucaccgggaacaugucguuuaaggaccugggacgaguugugguaauggugggcgccacuauggcugaugacauugggaugggagucacauaucucgcccugcuugcagcguucaaagugcggcccaccuuugccgcuggcuugcuguuacguaagcucacguccaaggagcugaugaugacuaccaucgguauuguucuucugucucaaagcacaaucccugaaaccgugcuagagcucacugaugcccuggcauuggggaugaugguccugaaaauagugagaaauauggaaaaguaccaguuagcuguuacaaucauggccauucucugcgugcccaacgcagucauccugcagaaugccuggaaaguaucauguaccauucuugcugugguuaguguguccccacuguugcucacaucuagccagcaaaagacugacuggaucccucuggcgcuaaccauaaaaggacugaaccccacggccauuuuccuuacaacccucuccaggacuaauaagaaacgcucauggccacugaacgaggcaaucauggcugucggcauggugagcaucuuggccaguucucuguuaaagaaugacauuccgaugaccggcccucucguagccgggggacugcuuacagugugcuauguccugacuggucgguccgcugauuuggaacucgagagagcaaccgacguuaagugggaggaucaggccgaaauaagcggcucgucacccauccugucuauuacgaucagugaggacggguccaugagcauuaaaaacgaagaggaggaacagacacuaaccauccugauaaggacuggacuucucgugaucucuggccuguuuccaauuagcauccccauuacagcggcugccugguacuugugggaggugaagaaacagcgagccggugucuuaugggaugugccuuccccacccccuauggggaaggccgaacuggaggacggagcuuaucgcaucaaacaaaagggcauacucggcuacucacagauuggggcaggaguuuacaaggaagguaccuuccacacuauguggcauguaacacggggcgccgugcugaugcacaaagggaagagaaucgagccgaguugggcggaugucaaaaaggaccuuaucagcuauggaggcgguuggaaacuggagggggaauggaaggagggagaagaggugcagguuuuggcucuagaaccaggcaagaaucccagggccgugcagaccaaaccuggccuguuuaagacgaacacugggaccauuggagcagucucucucgauuucuccccagguacaucaggcagucccaucauagacaaaaaggggaaagugguaggacuguacggcaacggugucgugacccguagcggggccuauguuuccgcuauugcccaaacagagaagucuaucgaggauaauccugaaauugaggacgauaucuuucgcaagcggagacuuacuauaauggacuuacacccgggagcaggcaaaaccaagagguaccugcccgcuauugugcgagaagccaucaaacggggccuccgcacguugauccuggcgccaacaagagucguggccgcagagauggaagaggcucucagggggcugccuauucgguaucagacucccgccauccgagcugagcauaccggaagagaaauuguugaccuuaugugucacgcaacauucaccaugcgccuguugucgccagugagggucccuaacuacaaucuaauaaucauggaugaggcccauuucacugaccccgccagcauugcugcgcgugguuauaucucaacccggguggaaaugggcgaggcagccgggaucuuuaugacagcuacgccaccgggauccagagauccuuucccccagaguaacgccccaauuauagacgaggaaagggagauccccgaacgcucuuggaauagcggccacgaguggguaacugauuuuaaggguaaaaccgugugguucguuccuuccauuaaggcagggaacgacaucgccgcuugccugcgaaagaauggcaaaaaggucauucaacucucaagaaaaacauuugauucugaauacgugaagacccggacuaacgacugggauuucguggucacaaccgacaucagcgagaugggcgcgaauuuuaaagccgagaggguaauagauccacgccguuguaugaagcccgugaucuuaacggacggcgaagagagaguuauucuggcagggccuaugccggugacucauaguuccgcugcccagcggaggggacgcaucggucgaaaccccaaaaaugaaaacgaccaguacauuuauaugggcgagccccuugaaaaugaugaggacugcgcacacuggaaggaggccaagaugcugcucgauaacaucaauacaccugaagggauaauucccagcauguucgagccagaaagagagaaagucgacgcuaucgauggagaauaccgguugaggggcgaggcccgcaagaccuuuguggaccugaugagaaggggugaucucccuguuuggcuggcguauaaaguggcagccgaggggauuaacuacgcugaccggcguugguguuucgauggcaucaagaacaaucagauacuugaagagaacgucgaaguggagaucuggaccaaagagggagaacgcaagaagcuaaaaccccgauggcuggacgccagaauuuauucugauccauuggcuuuaaaggaguuuaaagaguucgcagccggcaggaagucacugacucucaaucugaucacagagauggggcggcuuccuaccuucaugacacagaaaacucgcgacgcucuggauaaccucgccguauugcacacggcagaagcgggagguagagccuacaaucaugcucuguccgagcuaccggagacccuggaaacacuccuucuguuaacuuugcuggccaccgugacaggcgggauuuuucucuuccugaugaguggaaggggcaucgguaagaugacccuugggaugugcugcauaauuacugcaagcauccugcucugguaugcucagauccagccccacuggauugccgcaucgaucauauuggaguuuuuccugauuguuuuacuaaucccagaaccugagaagcagcggacgccccaagacaaccagcugaccuacgucgugauugccauccucacaguggucgcugcgacuauggccaaugaaaugggcuuucuugagaaaaccaagcgagaccugggauugggcucuauagcaacacagcagccagaguccaacauccuggauauugaccucagaccugcuagcgccuggacccuguacgccguugcaacuacauucgugacgcccaugcuucgccauucaaucgaaaauaguucuguaaacgugucccucaccgcuauugccaaucaagcgacuguccugaugggguugggaaaagguuggccgcugagcaagauggauaucggcgugccauuacuagcuauuggguguuauucacagguuaacccuaucacacugaccgccgcacuccuucuguugguggcccacuacgcuauaauuggacccggccugcaggcaaaagccaccagggaggcgcagaagcgggcugccgcagguaucaugaagaauccaacagucgacgggaucacuguaauugaucucgaccccauaccuuaugauccgaaauuugaaaagcaacugggccaggugaugcuuuuaauccugugcguuacacaggugcucaugaugcguaccacaugggccuugugugaggcucugacucuagccaccggacccauuaguacacugugggaaggcaacccagggagauucuggaauaccacuaucgcagucagcauggcuaacauuuuuaggggauccuaccucgccggcgcgggucuucuguucucuaucaugaaaaauacgacaaacacccgccgggggacuggaaacauaggcgagaccuugggugagaaguggaaaagccgacugaaugcccucggcaaguccgaauuucaaaucuauaaaaagucagggauucaggagguggacagaacacuggcaaaggaaggaaucaaaaggggcgagacugaucaccaugcugucucucgcgggagugccaaguuacggugguucguggagagaaacaugguuaccccugaaggaaaagugguagaccuuggcugcggucgugggggauggucguacuauuguggcggucugaagaaugugagggaggucaaaggccucacaaaagggggacccggccacgaagaaccuauuccaaugagcacguacggguggaaccuaguucggcugcaguccggaguggaugucuuuuucaucccaccugaaaagugcgacaccuugcugugugauauaggcgagucuucaccaaaucccacuguggaggcaggucgcacacuccgaguacuuaaccugguggaaaauugguugaacaauaacacccaguucugcauuaaaguucugaauccguacaugccuagcgugaucgagaagauggaagcucuccaaagaaaauaugggggagccuuagucaggaacccacugucccggaauaguacucaugagauguacugggugucuaacgccagcggcaauaucgucucauccgugaacaugauuagucgcaugcuuauaaacagauuuacaaugaggcacaagaaagcgaccuaugaacccgacguugaccugggcagcgggacgcgaaauaucggaauugagucugagaucccuaaccuagauauuaucgguaagcggauagaaaagaucaaacaggagcaugaaaccuccuggcacuacgaccaggaucacccauauaagacaugggcuuaccauggcucauaugagacuaaacagaccgggagcgcaucgucuaugguaaauggagugguccgucuccugacaaagcccugggacguguugccgacuguuacccaaauggccaugacagauaccacuccuuucggccagcagagaguguuuaaagaaaaggucgacacgcgcacacaggagcccaaggaggguaccaaaaagcugaugaaaauuacugcugaauggcucuggaaggagcuugggaaaaagaaaaccccaaggauguguacacgggaagaguucacgagaaaggugcgcaguaacgccgcacugggagccaucuuuaccgaugagaauaaguggaaauccgcuagggaagcgguagaggacagccgauucugggaauuaguggauaaggagcggaaccugcacuuggaaggcaaaugcgagacuuguguuuacaauaugaugggcaagagagagaaaaagcucggggaauuuggaaaggccaaagguucaagggcaauuugguacauguggcugggcgcucgcuuccuagaguuugaagcccuuggguuccugaacgaggaccauugguuuucccgugaaaauucucucagcggagucgagggcgagggucugcacaaguugggguauauccugcgggaugugaguaaaaaggaaggaggcgcaauguacgccgacgacacagcuggcugggauaccagaauuacucucgaggaccuuaaaaacgaagagauggugacaaaucacauggaaggggagcauaagaagcuggccgaggcgauauucaaauuaaccuaucaaaacaaggucguuagggugcagcgcccuacaccccgaggaacuguaauggauaucauuucccggagagaccagagggguagcggccaaguggggaccuacggacugaauacguuuaccaacauggaagcacaguugauccgccagauggagggcgaaggugucuucaaaaauauccagcaccucacagugacugaggagguugccgugcauaacuggcuggcuagagucgggcgggaaaggcuaucucguauggccauuucaggagaugacugcgugguaaagccacuugaugaccgauucgcaaacgcucugaccgcccucaaugauaugggcaaaauacgcaaggacauccaacagugggagcccaguaagggcuggaacgauuggacacagguuccuuuuugcucccaccauuuccacgaacugauuaugaaagacgggagaguguuggucgugccaugucggaaucaggaugaguuaaucggaagggcucgcauuagccaaggugccggcuggucucugagagaaacugcaugccucgggaagucguaugcgcagauguggucacuuauguacuuucaccggagggaccugcgacuagccgcuaacgccaucuguagcgcagugccgucccauuggguccccaccagucguacgacauggucuauacacgcuaaacaugaguggaugaccacugaggacaugcugacaguuuggaauagaguguggauccgcgaaaacccuuggauggaggauaagaccccaguagaaagcugggaggaaauucccuaucucggaaaacgggaggaccaguggugcggcuccuugaucggucugacuucaagggccaccugggcaaagaauauucaggccgcgaucaaccaagugagaagucuuauagggaaugaggaauacacagauuacaugccuucuaugaagcgcuuccggagggaggaagaggaagcuggaguccugugguga

SEQ ID NO: 14920 - RNA, 9876 nt, Artificial Sequence
  derived and/or modified CDS sequence (opt3) from DENV-2__FM210241__SS-prME
accgccggagugaucauuaugcugauacccacggcuauggcauuccaccucacuacgaggaacggggagccucauaugaucgucgggaggcaggaaaaggguaaaagccuucuguuuaagaccgaggacggaguuaauaugugcacauugauggccauugauuuaggggaacugugugaggacacuaucaccuacaaaugcccacuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccaucggcacgacucacuuucagcgcgcacucauuuucauccugcugacagccguggcuccauccaugaccaugagaugcauagggauuucuaacagggauuuuguugaaggagugucggguggcucaugggucgacaucgugcucgagcacgggagcuguguaacuacaauggccaagaauaagcccaccuuagauuucgaacugauuaaaacggaggcgaagcagccugcaacccuucggaaauauugcaucgaagccaaguugacaaacacuaccacagagagucgcuguccaacucaaggagagcccucccugaaugaagaacaggacaaacgauuuguuugcaagcauucuaugguggauagaggcugggguaacggguguggacuauucggcaagggcgggaucgucacaugcgcuauguuuacaugcaaaaagaauauggaaggaaaaauugugcagccugagaaccucgaauacaccauagugaucacuccacacagcggugaggagcaugccgucggcaaugacacggggaagcacggaaaagaaauuaagaucacaccgcaguccucaauaaccgaggcagaacugacuggcuaugguaccguuacaauggaguguagucccaggaccgggcuugauuucaacgaaauggugcuguugcaaauggaggacaaggcuuggcucguacaccggcagugguuucuggauuuaccucugccauggcuccccggcgccgacacucagggaagcaauuggauucagaaggagacacuugugacguucaagaacccucaugcgaaaaagcaagacgucgugguucugggcucucaggaaggggccaugcacaccgcauugacuggagcuacagagauccagauguccucagguaaucuacuguuuaccggccaucucaaaugccgucugcgcauggauaaacuucaacugaaagggaugagcuacaguauguguacaggaaaguucaagaucgugaaagaaauugccgagacucagcacggcaccaucgucauuagagugcaguaugagggugacgggucuccaugcaagauacccuucgaaaucauggauuuggagaaaaggcauguacucggccggcugauuacgguuaacccgaucgugaccgaaaaggacuccccugucaacaucgaggcugaacccccauuuggagauagcuacauuauaaucggcguggagccugggcaguuaaaacugaauugguucaagaagggaucgucuauuggucaaauguuugagacaacuaugcgaggcgccaaacgcauggcaauccuaggggacaccgccugggauuucggaucccucggcggugucuuuacaucaauugggaaggcucugcaccagguguucggcgcgaucuacggagcagccuuuaguggcguuagcuggacuaugaaaauacuuaucggggcuauuaucaccuggauuggaaugaacuccagaucuacgagcuugucagugagucugguacucgucggcgugaucacacuguaucuuggugccaugguucaggcagacuccggguguguggucagcuggaagaauaaagaacugaagugcggaucuggcauauucauuaccgauaacgugcacacuuggacagagcaguacaaguuucaacccgaaucaccaaguaaauuggccagcgcuauccagaaggcccaugaggaagguauuuguggcaucagguccguaacccggcucgagaaucugauguggaaacagauaacucccgaguuaaaccacauccugucugaaaaugaggugaagcuaaccauuaugacaggggacaucaaaggaauuaugcaggcaggcaagcgcucgcucagaccucaaccaacggaacugaaauauagcuggaagaccugggggaaggcgaaaaugcuuuccacugagucacauaaccagacauucuugaucgauggaccggaaaccgcugagugccccaauacaaacagggccuggaauagucuggagguugaagacuacggcuuuggugucuucacuaccaacauauggcucaagcugcgugagaaacaggacguguuuugugauucuaaguuaaugagcgcagccauuaaagacaaucgggcugugcacgccgauaugggguauuggaucgaauccgcacugaacgacacguggaagauggagaaggcuucauucaucgaggucaaaagcugccacuggccuaagucucauacacuuugguccaauggaguuuuggaaagugagaugauuaucccaaagagcuucgccggccccgugucucagcacaacuaccgaccugguuauuacacccaaacugcgggcccauggcaucucgggaagcuggaaauggauuuugacuucugugagggaaccacagugguagucacugaagauugcggcaacagagggcccucccuaaggaccacaacggccucaggaaaacugauuaccgaguggugcugucgcaguugcacucucccgccucugcgguacagaggcgaggacgguuguugguaugggauggaaauaaggccacuuaaggagaaggaagagaauuuggugaacagccugguuacagcuggacacggccagaucgauaauuuuucguuaggugugcucggcauggcacuguuccuugaagagaugcugcgcacccgagucgggacuaaacaugccauuuugcucguggcuguuuccuuugugacacugaucaccggaaacaugucuuuccgggaccuaggccguguaauggucauggugggggccacgaugacugaugacauuggaaugggcgugaccuaccuggcacuccuggcggccuuuaaggucagacccacauucgcugccggucuuuugcugaggaaauuaaccagcaaggagcucaugauggcaacuaucgggauagcucugcuuucacagaguacaaucccugaaaccauucuggagcuaacagaugcccucgcacugggaaugaugguuuugaaaaucgugcgcaauauggaaaaguaucaacuggccguaacuauuauggcuaucuccugcgugcccaacgcggucauauuacagaaugccuggaaggugucuuguaccauucucgcagcuguuagcguguccccacugcuucugacgucaagccagcagaaagccgacuggaucccuuuggcccucacaaucaagggccugaaccccaccgcuauuuuucuaacuacccugagucggacaucuaaaaagagauccuggccacuuaaugaggcaauaauggccgucggcauggugagcauccucgcgucgucacuguugaaaaacgacauuccgaugacugggccucugguugcuggagguuuacucaccgugugcuacguccugacgggcaggucugccgaucuugaacuggagcgagcaacagacguaaagugggaggaucaagccgaaaucaguggguccagccccauuuugucuaucaccauaagcgaggacggauccaugucaaucaaaaaugaagaggaggaacagacucucacaauucugauccgcaccggccuacuggugauuaguggucuuuucccaguuagcauccccauaacugcugcagccugguaucucugggaggugaagaagcagcgggcggggguccugugggaugugccuucuccacccccuguaggaaaagcugaauuggaggacggcgccuacagaauuaagcagaaaggcaucuuaggguauucccaaaucggagcugguguguacaaggaaggcacauuucacaccauguggcacgucacgagaggggcaguucugaugcaucguggaaaacgcauugagccgucaugggcagaugugaagaaggaccucaucaguuacggcgguggguggaaacuggagggagaauggaaggagggcgaagaggugcagguccuugcccuggaaccaggcaaaaacccccgggcagugcagacuaagccuggguuguucaaaaccaauacaggaaccauaggugcuguuagccuagauuuuuccccaggcacaucugggucgcccauuguagacagaaagggaaagguggucggccuguaugguaacggggugguuacuaggagcggagccuacgugucagcgaucgcccagaccgagaaauccauugaggauaauccugaaaucgaggacgauauauuccgaaagaaacggcucacgauuauggaccugcacccgggcgcaggcaagacaaaacgcuaucuucccgcuaucgucagagaagccaucaagaggggguuacggacucugauucucgcuccaacccgagugguagcagccgagauggaagaggccuugagaggacugccuauccgcuaccaaacacccgcuauuagggcggagcauaccggucgugaaauagucgaccucaugugucacgcaacuuucaccaugcggcugcuuaguccagugagaguuccuaacuauaaccugaucauuauggaugaggcccauuuuacagaccccgcuucuaucgccgcaaggggcuacaucagcacgcgcguggaaaugggggaggccgcuggaauuuucaugacugcgaccccaccgggcucccgagauccuuuuccccagucaaaugccccaauaaucgacgaggaaagagagauucccgaacggucuuggaacagcggucacgagugggucacagauuucaaggggaaaaccgugugguuuguuccuaguaucaaggcaggaaaugacauugcugccugcuugaggaaaaacggcaagaaagugauccagcuaucccgcaagacuuucgauagcgaauaugucaagacacguaccaaugacugggauuuugugguaacgacugacauaucugagaugggcgcaaacuucaaagccgagagagugaucgauccacggagguguaugaagcccguuauucugacagacggggaagaacgcgucauccucgcuggaccuaugccggugacccacucauccgccgcgcaacgaagaggucggauuggcaggaaucccaagaacgaaaaugaccaguacaucuacaugggggagcccuuagaaaacgaugaggacugcgcacauuggaaggaggccaaaaugcugcuugauaauauaaacaccccugaaggaauuauccccaguauguuugagccagaacgcgagaagguggacgcuauugauggcgaauauagacugaggggugaggcccggaaaacuuucgucgaccucaugcgucgcggggauuugccuguauggcuggcuuaccgaguggcagccgagggcaucaauuaugcugacagaaggugguguuuugauggaguuaagaacaaucagauacucgaagagaacguggaagucgagaucuggacaaaggagggcgaacggaaaaagcugaaaccccgcuggcuugacgccagaauuuacagcgauccacuagcacugaaggaguucaaagaguucgcggccgggaggaagucguugaccuuaaaccugaucacagagaugggacggcucccuacuuuuaugacgcagaaggcucgagacgcccuggauaaucuugcagugcugcacaccgcugaagccgguggcagagcauauaaccaugcccucucugaguugccggagacacuggaaacucuacugcuccuuacccuguuagcuacaguuaccgggggaauuuucuuguuucugauguccggcaaagguguggggaagaugacucucggcaugugcugcaucauaacggcgagcauucugcuuugguacgcccaaauccagccccacuggaucgcagcuucaauuauccuggaguucuuucucauagucuugcugauuccagaaccugagaaacagcgcaccccacaggacaaucaauuaacauaugugguaaucgccauucuaacugugguugccgcaaccauggcuaacgaaaugggauuccuggagaagaccaagaaagaccucggccuugggaguaucgccacccaggagccagaaucuaauauacuggauaucgacuugaggccugcguccgcuuggacucuguacgccgucgcaacaacguuugugacccccaugcuccggcacagcauugagaacucaagugugaaugucagccugacugccaucgcuaaccaggcaacaguucuuaugggacucgguaagggcuggccgcuguccaaaauggauauuggggugccauugcuggccaucggauguuacucucagguaaauccuauuaccuuaaccgcggcucuacugagccucaucgcccauuaugcaauaauuggccccggucuucaagccaaggcuacacgugaagcccagaaaagagcagcugccgggaucaugaagaacccaacuguggacggcaucacggucauugaucuggaccccauaccuuacgauccgaaauucgagaagcaguugggacaggugaugcugcucauccugugcguuacccaagugcuuaugaugaggacaacuugggcguuaugugaagcccugacccucgcaacaggccccauuuccaccuugugggaggggaauccaggacgcuuuuggaacacuacgaucgcugucucaauggccaauauuuuccggggcucuuaucuggccggugcugggcuacuguuuaguaucaugaagaacacaaccaauacucgaagaggaaccggcaacauaggugagacacucggcgaaaaauggaagucgaggcuuaaugcccuggggaaaagcgaguuccagaucuacaagaaauccggcauucaggaaguagaccgcacuuuggccaaggagggcaucaaaagaggggaaaccgaucaccaugcggugucuagaggaucagcuaagcugcguugguuuguugaaaggaacauggugacaccugagggcaaggucguggaccucgguugcgggcggggaggcuggagcuauuacugugguggccugaaaaacguccgcgaagugaagggguuaacgaaaggaggccccgggcacgaggaaccuauuccaauguccaccuauggauggaaucuuguucgacugcaaaguggcguggauguauucuucacucccccugagaagugcgacacacuccuaugugauaucggugagucuagcccaaaccccaccauagaagcagggagaacucugaggguguugucacuggucgagaauuggcucaacaaugacacacaguuuugcauuaaaguucuuaacccguacaugccuuccgugaucgaaaagauggagacccugcagcggaaguacggaggcgccuugguccgcaauccacugaguagaaacagcacgcaugaaauguauugggugucuaaugcuaccggcaacaucguauccucagugaauaugauuagcaggaugcucauaaaccgauucacaaugaaacacaagaaagccacuuacgagcccgacguugauuuagggucgggaacccggaauaucgguauugagucugaaaucccuaaccuggacauuaucggcaagcguauagagaaaaucaagcaggaacacgagacaaguuggcauuaugaucaagaccacccauacaagacuugggcauaucauggguccuacgaaaccaaacagacaggaagcgccucauccauggugaauggcgucgugagacuucugaccaagcccugggaugucgugccgaugguuacucagauggcuaugacggacacaaccccuuuuggucagcaacgcguauucaaagagaagguggauacuaggacccaggagcccaaagaagggacaaagaagcuaaugaaaauuacggcggaguggcucuggaaggaacugggcaaaaagaaaaccccacggauguguacuagagaggaguuuacacgcaaggucaggucuaacgccgcauugggcgcuaucuucaccgacgaaaacaaauggaaaagcgcccgagaggcaguggaagauagucgguuuugggagcugguugacaaggaaagaaaucuccaccuugagggcaaaugcgagacuuguguguauaacaugauggggaagagggagaaaaagcugggagaguucgguaaagccaagggcucccgcgcuauuugguacaugugguuaggggcccguuuucuggaguucgaggcguugggauuucucaaugaagaucacugguucagccgggagaacucucugucaggcgucgagggugaagggcuacauaaacuuggauacauccugagagacgugaguaaaaaggagggcggcgcaauguaugccgacgauacagcugggugggacaccaggauuacacucgaagaucugaaaaaugaggaaaugguaacuaaccacauggagggagagcauaagcgcuuggccgaagcaauauuuaaacugaccuaccagaauaaggugguucgaguccagcggccuacgcccagagguaccgugauggacaucauuuccaggcgcgaucaaagaggcagcggacaggugggaacauauggccucaacacuuucaccaauauggaggcucaguucauccggcaaauggaaggugaggggaucuuuaagucuauucagcaccuuacagucacugaggaaauagccguucagaacuggcuggcuagggugggacgugagcgauuaucgcgcauggccaucucaggcgacgauugcguagugaaaccacuggacgauagauucgcaagcgcguugaccgcccucaaugacaugggcaagguccggaaagauauucagcaaugggaacccuccaagggguggaacgacuggacacaggugccuuuuugcagucaucacuuccacgagcugaucaugaaagauggaaggguucuaguggucccaugucgcaaucaggacgaacuuauugguagagcucggaucucucagggcgccggguggagccugaaggagacagcaugccucggaaaguccuacgcucaaauguggucacugauguauuuucauaggcgagacuugcguuuagccgcaaacgccauauguagugcggugccgucucacuggguacccaccagcagaacuacaugguccauccaugcuaaacacgaguggaugaccacugaagauaugcugaccguuuggaaucgcguguggauucaggagaacccuuggauggaagacaagacaccagucgagucaugggaagaggugcccuaccucggcaaacgggaggaucaguggugcgguagccuuaucgggcugacgucuagggccaccugggcaaagaacauucagacugccaucaaucaagugagaucccuaauaggaaacgaagaguauacagacuacaugccuaguaugaaacgcuuccggagggaagaggaagaggcuggcguccugugguga

SEQ ID NO: 14921 - RNA, 9876 nt, Artificial Sequence
  derived and/or modified CDS sequence (opt3) from DENV-2__FM210242__SS-prME
agcgcaggaaugaucauuaugcugauccccaccgugauggcuuuccaccucacuacuagaaacggggagccucauaugaucgucgguauucaagaaaagggaaaaucccuucuguuuaagacggaggacggcguuaauaugugcaccuugauggcaauggauuuaggggaacugugugaggacacuaucacuuacaaaugcccacugcucaggcaaaacgaaccggaggauauugacuguuggugcaauucuaccucaacaugggugaccuauggaacuuguacaaccacgggcgagcaccggcgcgaaaagcgaaguguagcccuggugccccaugucgguauggggcuugagacucguaccgaaacauggaugagcuccgagggagcguggaaacacgcucagagaaucgagacuuggauacugaggcauccuggcuucaccaucauggccgcaauuuuggccuacacaaucggcaccacgcacuuucagcgggugcucauuuucauccugcugacugcuguugcaccaucuaugacaaugcgcugcauagggauuucgaacagagauuuuguggaaggagucucagguggcagcuggguggacaucguacucgagcacgggaguuguguuaccacuauggccaagaauaagcccacauuagauuucgaacugauuaaaaccgaggcuaagcagccugccacgcuuaggaaauauugcaucgaagcgaaguugaccaacacaacuaccgagucccgguguccaacacaaggagagcccucucugaaagaagaacaggacaagcgcuuugugugcaagcauagcauggucgaucgaggcugggguaauggguguggacuauucggcaaaggcgggaucgugacuugcgcaauguuuaccugcaagaaaaacauggaaggaaagauugugcagccugagaaucucgaauacacaauagucguuaccccacacuccggugaggagcaugccgugggcaacgacacugggaaacacggaaaggaaaucaaaguaacgccgcagucaaguauuacagaggcugaacugaccggcuaugguacugugaccauggaguguagccccagaacagggcuugauuucaaugaaaugguccuguugcaaauggagaacaaggccuggcucgugcacaggcagugguuucuggacuuaccucugccauggcuccccggcgcagauaagcaggagucuaauuggauccagaaagaaacccuuguuacuuucaagaacccucaugcuaaaaagcaagacguggucgugcugggaucccaggagggcgccaugcacacagcguugacgggggccaccgaaauacagaugucaagcggaaaucuacuguuuacuggucaucucaaaugccggcugcguauggacaaacuucaacugaagggcaugaguuacucuauguguacagggaaauucaagguaguuaaagagauugcagagacccagcacggaacaaucgugauccgcguccaguaugaaggcgaugguuccccaugcaagauucccuucgagaucauggacuuggagaagagauacgugcucgggaggcugauuacugucaacccgauagugaccgagaaggauagcccuguuaacaucgaagcugagcccccauuuggcgacucguacauuaucaucggaguggagccuggccaguuaaagcugaauugguucaaaaaggggucuuccauuggacaaauguuugaaacgaccaugcggggugccaaacgaauggcuauacuaggcgauacagccugggacuucgggucacucggaggcguauuuacaaguaucgguaaggcacugcaucaggucuucggggccauuuauggcgcugcguuuagcggaguguccuggaccaugaaaauccuuauuggcguuaucauaacauggaucgggaugaacucucgcagcacuucauugagugugucccugguccucgugggaauuguaacccuguaccuuggcgugaugguucaggcagauagcgguugugucgugucuuggaagaauaaggagcugaaaugcgggucaggaaucuucauuacggacaacgugcacacauggaccgaacaguauaaguuucaacccgagaguccaagcaaauuggccuccgcuauccagaaggcccaggaagagggcauaugugguauuagaucugucacuaggcucgagaaucugauguggaaacagaucacacccgaauuaaaccacauucuggcagagaaugaaguuaagcuaaccaucaugacuggcgauauaaaagggaucaugcaagccggaaagcggucgcuccgcccucagccaaccgagcugaaguacagcuggaaaacauggggcaaggcuaaaaugcuuuccacggaaucauauaaccagaccuucuugauugacgggccggagacugccgagugccccaauacaaacagagcauggaauagucuggaaguggaggauuacggauuuggcguguucaccacaaacaucuggcucaagcugaaagaaaagcaggacgcguuuugugacucuaaguuaaugagcgcugccauuaaagauaauagggcaguacaugccgacauggguuauuggaucgaguccgcucugaacgauacuuggaagauagagaaagccucauucauugaagucaagaauugccacuggccuaaaagccauacccuuuggucuaacgggguguuggaguccgaaaugaucaucccaaagaaccucgcaggacccguuagucaacacaauuaccguccuggcuaccacacgcagauugcugguccauggcaucugggcaagcuagagauggacuucgauuuuugugacgggacaaccgugaucgucacugaagauugcggaaaccggggccccagccugcgaaccacaacugccucugggaaacucauuaccgaguggugcuguagauccugcacacugccgccucuuagguaucgcggagaggacggcuguugguacgguauggaaauacggccauugaaggagaaagaagagaaucuggugaacucauuaguuacggcggggcacggacagguggauaauuucagucucggcguacuggguauggcccuuuuucuggaagagauguugagaaccagggucggcacuaagcaugcuauccuccugguggcagugagcuucgucacacuaauuaccgggaacaugucguuuaaagaccugggacgcguugugguaauggugggcgccacuauggcugaugacaucgggaugggagucacauaucucgcccugcuugcagcguucaaggugcgacccaccuuugccgcuggcuugcuguuacggaagcucacguccaaagagcugaugaugacuaccauugguaucguucuucugucucaaagcacaauaccugaaaccgugcuagagcucacugaugcccuggcauuggggaugaugguccugaagaucgugcguaauauggaaaaauaccaguuagcuguuacaauuauggccauccucugcgugcccaacgcagucguacugcagaaugccuggaaggugucauguaccauucuugcuguugugagugucuccccacuguugcucacaucuagccagcagaagacugacuggaucccucuggcgcuaaccauaaagggacugaaccccacggccauuuuccuuacaacccucuccagaacuaauaaaaagaggucauggccacugaacgaggcaaucauggcugugggcaugguaagcaucuuggccaguucucuguuaaagaaugacauuccgaugaccggcccucucguggccgggggacugcuuacagucugcuauguucugacuggucgcuccgcugauuuggaacucgagcgggcaaccgacgugaaaugggaggaucaggccgaaauaagcggcucgucacccauccugucuauuacgaucagugaggacggguccaugagcauuaagaacgaagaggaggaacagacacuaaccauccugauaagaacuggacuucucgugaucucuggccuguuuccaauuagcauccccauuacagcggcugccugguacuugugggaggucaaaaagcagagggccgguguguuaugggauguuccuuccccacccccuauggggaaagccgaacuggaggacggagcuuaucgaaucaagcaaaagggcauacucggcuacucacagauuggggcaggaguauacaaagaagguaccuuccacacuauguggcaugugacacgcggcgccguccugaugcacaaggggaaacggaucgagccgaguugggcggaugugaagaaagaccuuaucagcuauggaggcgguuggaagcuggagggggaauggaaggagggagaagagguucagguguuggcucuagaaccaggcaaaaaucccagagccguccagaccaagccuggccuguuuaaaacgaacacugggaccauuggagcagugucucucgauuucuccccagguacaucaggcagucccaucauagacaagaaagggaagguagucggacuguacggcaacggugugguuaccaggagcggggccuauguguccgcuauugcccaaacagagaagucuaucgaggauaauccugaaauugaggacgauaucuuucguaaacgccggcuuacuauaauggacuuacacccgggagcaggcaagaccaaaagauaccugcccgcuauugucagggaagccaucaagcgaggccuccggacguugauccuggcgccaacacgcgugguugccgcagagauggaagaggcucucagagggcugccuauuagguaucagacucccgccaucaaagcugagcauaccggacgggaaauuguggaccuuaugugucacgcaacauucaccaugcgacuguugucgccagucagagugccuaacuacaaucuaauaaucauggaugaggcccauuucacugaccccgccagcauugcugcgcgcgguuauaucucaaccaggguagaaaugggcgaggcagccgggaucuuuaugacagcuacgccaccgggaucccgugauccuuucccccagaguaacgccccaauuauagacgaggaacgggagauccccgaaagaucuuggaauagcggccacgagugggugacugauuuuaaggguaagaccguuugguucgucccuuccauuaaagcagggaacgacaucgccgcuugccugaggaagaauggcaagaaggugauucaacucucacgcaaaacauuugauucugaauacgugaagacccgaacuaacgacugggauuucgucguaacaaccgacaucagcgagaugggcgcgaauuuuaaagccgagagagugauagauccacggagguguaugaagcccguuaucuuaacggacggcgaagaacgcgugauucuggcagggccuaugccggucacucauaguuccgcugcccagcguagaggacggaucgguaggaacccaaagaaugaaaacgaccaguacauuuauaugggcgagccccuugaaaaugaugaggacugcgcacacuggaaagaggccaagaugcugcucgauaacaucaauacaccugaagggauaauucccagcauguucgagccagaacgcgagaaaguggacgcuaucgauggagaauaccgauugagaggcgaggcccggaagaccuuuguugaccugaugaggcgcggugaucucccuguguggcuggcguauaaagucgcagccgaggggauuaacuacgcugacagaaggugguguuucgauggcaucaagaacaaucagauacuugaagagaacguggaaguagagaucuggaccaaggagggagaacggaaaaagcuaaaaccccguuggcuggacgcccgcauuuauucugauccauuggcuuuaaaggaguuuaaagaguucgcagccggccgaaagucacugacucucaaucugaucacagagauggggagacuuccuaccuucaugacacaaaagacuagggacgcucuggauaaccucgccguguugcacacggcagaagcgggaggucgggccuacaaucaugcucuguccgagcuaccggagacccuggaaacacuccuucuguuaacuuugcuggccaccguuacaggcgggauuuuucucuuccugaugaguggacgcggcaucgguaaaaugacccuugggaugugcugcauaauuacugcaagcauccugcucugguaugcucagauccagccccacuggauugccgcaucgaucauauuggaguuuuuccugauugucuuacuaaucccagaaccugagaagcagagaacgccccaagacaaccagcugaccuacguggugauugccauccucacagucguugcugcgacuauggccaaugaaaugggcuuucuugagaaaaccaagaaagaccugggauugggcucuauagcaacacagcagccagaguccaacauccuggauauugaccucaggccugcuagcgccuggacccuguacgccguggcaacuacauucguaacgcccaugcuucggcauucaaucgaaaauaguucugugaacgucucccucaccgcuauugccaaucaagcgacugugcugaugggguugggaaaggguuggccgcugagcaagauggauaucggcguuccauuacuagcuauuggguguuauucacaggugaacccuaucacacugaccgccgcacuccuucuguuggucgcccacuacgcuauaauuggacccggccugcaggcaaaagccacccgagaggcgcagaagagagcugccgcagguaucaugaaaaauccaacaguagacgggaucacugugauugaucucgaccccauaccuuaugauccgaaguuugaaaaacaacugggccagguuaugcuuuuaauccugugcgugacgcagguccucaugaugcgcaccacaugggccuugugugaggcucugacucuagccaccggacccauuaguacacugugggaaggcaacccagggagguucuggaauaccacuaucgcagugagcauggcuaacauuuuucggggauccuaccucgccggcgcgggucuucuguucucuaucaugaagaauacgacaaacacccguagagggacuggaaacauaggcgagaccuugggugagaaauggaaaagcaggcugaaugcccucggcaaguccgaauuucaaaucuauaaaaagucagggauucaggaggucgaccgcacacuggcaaaagaaggaaucaagcggggcgagacugaucaccaugcugugucucgagggagugccaaauuaagaugguucguugagaggaacauggugaccccugaaggaaagguaguggaccuuggcugcggucgcgggggauggucguacuauuguggcggucuaaagagcguccgggagguuaaaggccucacaaaagggggacccggccacgaagaaccuauuccaauguccacguacggguggaaucuagugagacugcagucuggagucgauguguuuuucauacccccugaaaaaugcgacaccuugcugugugauauaggcgagucaagcccaaaccccacuguagaggcaggucguacacucagggugcuuaaucugguugaaaacugguugaauaacaauacccaguucugcauuaaggugcugaacccguacaugccuuccgucaucgagaaaauggaagcucuccaacggaaguaugggggagccuuagugcgcaauccacugagucgaaacucuacucaugagauguacugggucagcaaugccucaggcaacaucguguccaguguuaauaugauuagcagaaugcuuauaaacagguuuacaaugcggcacaagaaagcgaccuaugaacccgacguagaccugggcucugggacgcgcaacaucggaauugaguccgagaucccuaaucuagauauuaucgguaagagaauagagaagaucaagcaggagcaugaaaccucauggcacuacgaccaggaucacccauauaaaacaugggcuuaccauggcagcuaugagacuaagcagaccgggucggcaucuaguauggugaacggagucgugaggcuccugacaaagcccugggacguuuugccgacugugacccaaauggccaugacagauaccacuccuuucggccagcagcgagucuuuaaagaaaagguggacacgcggacacaggagcccaaagaggguaccaagaaacugaugaagauuacugcugaauggcucuggaaagagcuugggaagaagaaaaccccacguauguguacaagagaagaguucacgcgcaagguaagguccaaugccgcacugggagccaucuuuaccgaugagaacaaauggaaaagcgcucgggaagcgguggaggacucaagauucugggaauuaguugauaaagagcgcaaucugcacuuggaaggcaagugcgagacuugugucuacaacaugaugggcaagagggagaaaaagcucggggaauuuggaaaagccaaggguucccgagcaauuugguacauguggcugggcgcucgguuccuagaguuugaagcccuuggguuccugaaugaggaccauugguuuucuagagaaaacagccucaguggaguggagggcgagggucugcacaaauugggguauauccugagggauguguccaagaaggaaggaggcgcaauguacgccgacgacacagcuggcugggauacccgcauuacucucgaggaccuuaaaaaugaagagauggucacaaaccacauggaaggggagcauaagaaacuggccgaggcgauauucaaguuaaccuaucaaaauaaaguugugcguguacagcggccuacacccagaggaacugugauggauaucauuagcaggcgcgaccagcgagguucuggccaagucgggaccuacggacugaacacguuuaccaauauggaagcacaguugauccggcagauggagggcgaagguguguucaagaacauccagcaccucacaguuacugaggagguggccguccaaaauuggcuggcuagaguggggagggaacgccuaucaagaauggccauuaguggagaugacugcguaguuaagccacuugaugaccgguucgcaaacgcucugaccgcccucaacgauaugggcaaaauaaggaaggacauccagcagugggagcccuccaaaggcuggaaugauuggacacaggugccuuuuugcagccaucacuuccaugaacugauuaugaaggacgggcgugucuugguggugccaugucgaaaccaagaugaguuaaucggacgcgcuagaauuucucagggugccggcuggucgcugcgggaaacugcaugccucgggaaaucauaugcgcagauguggagccuuauguacuuucacaggcgcgaccugagacuagccgcuaaugccaucuguuccgcagucccgagucacuggguucccaccucucggacgacauggagcauacaugcuaagcacgaguggaugaccacugaggacaugcugacaguguggaacaggguauggauccgagaaaauccuuggauggaggauaagaccccaguggaauccugggaggaaauucccuaucucggaaaacgugaggaccaguggugcggcucauugaucggucugacaaguagagccaccugggcaaagaacauucaagccgcgaucaaucagguccgcucucuuauagggaacgaggaauacacagauuacaugccuagcaugaaacgguucaggagagaggaagaggaagcuggagugcugugguga

SEQ ID NO: 14922 - RNA, 9876 nt, Artificial Sequence
  derived and/or modified CDS sequence (opt3) from DENV-2__FM210243__SS-prME
accgccggcgugaucauuaugcugauacccaccgcuauggcauuccaccucacuacgaggaacggggagccucauaugaucgucggaaggcaggaaaaggguaaaagccuucuguuuaagaccgaggacggcguuaauaugugcaccuugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaggaacaggacaaacgauuugugugcaagcauucuauggucgauagaggcugggguaacggguguggacuguucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcaguccucaaucacagaggcugaacugaccggcuaugguacugugaccauggaguguagucccaggacagggcuugauuucaacgaaaugguacuguugcaaauggaggacaaagccuggcucgugcaccggcagugguuucuggauuuaccucugccauggcuccccggcgcggacacccagggaagcaauuggauacagaaggagacucuugucacauucaagaacccucaugccaaaaagcaagacgugguugugcugggcucucaggaaggggcaaugcacacggcuuugaccggagccacugagauucagauguccucagguaaucuacuguuuacaggccaucucaaaugccgucugcgcauggauaaacuucaacugaaagggaugagcuacaguauguguaccggaaaguucaagaucgucaaagaaaucgcugagacacagcacggcacuauugugaucagaguacaguaugagggugacgggucuccaugcaagauucccuucgaaauaauggauuuggagaaaaggcauguucucggccggcugaucaccgugaacccgauugucacggaaaaggacuccccugugaacaucgaggccgaacccccauuuggagauagcuacaucauuauaggcgucgagccugggcaguuaaaacugaauugguucaagaagggaucgucuaucggucaaauguuugagaccacaaugcgaggcgcaaaacgcauggccauucuaggggacacugcuugggauuucggaucccucggcgguguguuuaccucaaucgggaaggcgcugcaccagguuuucggcgcaauuuacggagccgcuuuuaguggcgugagcuggacaaugaaaauccuuauagggguaaucauuacuuggaucggaaugaacuccagaucuaccagcuugucagucagucuggugcucguuggcauuaucacgcuguaucuuggugccauggugcaggcagacuccgggugugucgugagcuggaagaauaaagaacugaagugcggaucuggcauauucauuacagauaacguacacaccuggacugagcaguacaaguuucaacccgaaucaccaaguaaauuggccagcgcuauccagaaggcccaugaggaagguauuuguggcaucagguccgugacacggcucgagaaucugauguggaaacagauaacccccgaguuaaaccacauccugucugaaaaugagguuaagcuaacuauuaugaccggggacaucaaaggaauuaugcaggcaggcaagcgcucgcucagaccucaaccaacagaacugaaauauagcuggaagacgugggggaaggcgaaaaugcuuuccaccgagucacauaaccagacuuucuugaucgauggaccggaaacagcugagugccccaauaccaacagggccuggaauagucuggaggucgaagacuacggcuuugguguguucacaacuaacauauggcucaagcugcgugagaaacaggacguguuuugugauucuaaguuaaugagcgcagccauuaaagacaaucgggcuguccacgccgauaugggguauuggaucgaauccgcacugaacgacaccuggaagauggagaaggcuucauucaucgagguuaaaagcugccacuggccuaagucucauacgcuuugguccaauggaguguuggaaagugagaugauuaucccaaagagcuucgccggccccgugucucagcacaacuaccgaccugguuauuacacacaaaccgcgggcccauggcaucucgggaagcuggaaauggauuuugacuucugugagggaacuaccguagucgugacagaagauugcggcaacagagggcccucccuaaggacuaccacagccucaggaaaacugauuacggaguggugcugucgcaguugcacccucccgccucugcgguacagaggcgaggacgguuguugguaugggauggaaauaaggccacuuaaggagaaggaagagaauuugguuaacagccuggugacugcuggacacggccagaucgauaauuuuucguuagguguccucggcauggcacuguuccuugaagagaugcugcgcacacgaguggggaccaaacaugccauuuugcucguuacuguguccuuuguaacacugaucaccggaaacaugucuuuccgggaccuaggccgugucauggugauggugggggcugccaugacggaugacauuggaaugggcgucacuuaccuggcacuccuggcggccuuuaagguuagacccaccuucgcugccggucuuuugcugaggaaauuaacaagcaaggagcucaugauggcaaccaucgggauagcucugcuuucacagaguacuaucccugaaacaauucuggagcuaaccgaugcccucgcacugggaaugaugguguugaaaaucguacgcaauauggaaaaguaucaacuggccgugacaauuauggcuaucuccugcguccccaacgcggugauauuacagaaugccuggaagguuucuuguacuauucucgcagcugugagcgucuuuccacugcuucugaccuccucacagcagaaagccgacuggaucccuuuggcccucacgaucaagggccugaaccccacagcuauuuuccuaaccacucugagccggaccaguaaaaagagaucuuggccacuuaaugaggcaauaauggccgugggcaugguuuccauccucgcgagcucgcuguugaaaaacgacauuccgaugacagggccucugguggcuggagguuuacucacugucugcuacguacugaccggcaggucagccgaucuugaacuggagcgagcaacggacgugaagugggaggaucaagccgaaaucucugggaguucccccauuuugagcaucacaauagcugaggacggaucuaugagcaucaaaaaugaagaggaggaacagacccucacuauucugauccgcacaggccuacugguuauuuccggucuuuuuccagugucaauccccauaaccgcagccgcgugguaucucugggaggucaagaagcagcgggcuggggugcugugggauguaccuaguccacccccugugggaaaagccgaauuggaggacggcgcauacagaauuaagcagaaaggcaucuuaggguauagccaaaucggagccggugucuacaaggaaggcacuuuccacacaauguggcacguuaccagaggggcugugcugaugcaucguggaaaacgcauugagccgucuugggccgaugugaagaaggaccucaucuccuacggcgguggguggaaacuggagggagaauggaaggagggcgaagagguccaggugcuugcacuggaaccaggcaaaaacccccgggcuguucagacgaagccuggguuguuuaaaacuaauaccggaacaauaggugccguaucacuagauuucaguccaggcaccagcgggucccccauuguggacagaaagggaaaggucgugggccuguaugguaacgggguugugacaaggucuggagcguacgucucggccaucgcacagacugagaaaagcauugaggauaauccugaaaucgaggacgauauauuccgaaagaaacggcucaccauuauggaccugcacccgggcgcuggcaagacgaaacgcuaucuucccgccaucgugagagaagcuaucaagaggggguuacggacacugauucucgcaccaacucgaguagucgccgccgagauggaagaggcuuugagaggacugccuauccgcuaccaaacccccgcgauuagggcagagcauacaggucgugaaauaguggaccucaugugucacgccaccuuuacuaugcggcugcuuucaccaguuagagugccuaacuauaaccugaucauuauggaugaggcucauuucaccgaccccgccuccaucgcagccaggggcuacaucaguacacgcgucgaaaugggggaggcugcgggaauuuuuaugacggccacuccaccgggcucucgagauccuuucccccagagcaaugcaccaauaauggacgaggaaagagagauccccgaacgguccuggaacucaggucacgagugggugaccgauuuuaaggggaaaacaguuugguucgugccuucuauuaaggcuggaaaugacaucgccgcaugcuugaggaaaaacggcaagaaagucauucagcuaagccgcaagaccuuugauagugaauaugugaagacucguacaaaugacugggauuucguagugaccacggacaucuccgagaugggcgccaacuuuaaagcugagagaguuauagauccacggagguguaugaagcccgucauccugacugacggggaagaacgcgugauucucgccggaccuaugccggugacacacagcucugcggcacaacgaagaggucggaucggcaggaaucccaaaaacgaaaaugaccaguacauuuacaugggggagcccuuagaaaacgaugaggacugcgcccauuggaaggaggcuaaaaugcugcuugauaauaucaacaccccugaaggaauaauucccucaauguucgagccagaacgcgagaaggucgacgccaucgauggcgaauauagacugaggggugaggcucggaaaaccuuuguagaccucaugcgucgcggggauuugccuguguggcuggcauaccgaguugccgcugagggcauuaauuaugccgacagaaggugguguuucgauggagugaagaacaaucagauccucgaagagaacgucgaaguggagauauggacuaaggagggcgaacggaaaaagcugaaaccccgcuggcuugacgcaagaaucuacuccgauccacuagcgcugaaggaguucaaagaauuugccgcugggaggaagaguuugacauuaaaccugauuaccgagaugggacggcucccuacauucaugacucagaaggcccgagacgcacuggauaaucuugcuguucugcacacggccgaagcaggagguagagccuauaaccaugcucucagcgaguugccggagacccuggaaacacuacugcuccuuacucuguuagcgaccgugacagggggaaucuuuuuguuccugaugucgggcaaaggugucgggaagaugacccucggcaugugcugcauuaucacugccucuauacugcuuugguacgcacaaauucagccccacuggaucgcugccuccaucauucuggaguuuuuccucaucguguugcugauaccagaaccugagaaacagcgcacgccccaggacaaucaauuaaccuauguagugauugccauccuaacaguugucgcagcuacuauggccaacgaaaugggauuucuggagaagaccaaaaaggaccucggccuugggagcauugcgacacaggagccagaaucaaauauccuggauauagacuugaggccugcuagugccuggacccuguacgcaguggccacuacauucgugacgcccaugcuccggcacucuaucgagaacuccagcgucaauguuucacugaccgcuauugcaaaccaggccacugugcuuaugggacucgguaagggcuggccgcugaguaaaauggauaucgggguaccauugcuggcgauuggauguuacagccaggugaauccuaucacauuaaccgcugcccuacugcuccuugucgcacauuaugccauuaucggccccggucugcaagcuaaggccacccgugaagcacagaaaagagcugccgcggggauaaugaagaacccaacaguggacggcauuacuguuaucgauuuggaccccaucccuuacgauccgaaauuugagaagcagcugggacaggugaugcuccugauucuuugcgucacgcaaguauuaaugaugaggaccacaugggcccugugugaagcacucacuuuggcuaccggccccauauccacacugugggaggggaauccaggacgcuucuggaacaccacuaucgccgugucuauggcaaauauuuuucggggcagcuaucuagcuggugccgggcuacucuucuccaucaugaagaacacgacaaauacccgaagaggaacuggcaacauuggugagacccuuggcgaaaaauggaagucaaggcugaaugccuuggggaaaucugaguuucagaucuacaagaaaaguggaauacaggaaguugaccgcacacuggcgaaggagggcaucaaaagaggggagacugaucaccaugcugugucgagaggaagcgcaaagcuccguugguucgucgaaaggaacauggugaccccugagggcaaggucguggaccuggguugcgggcggggaggcugguccuauuacugugguggccuuaaaaacguucgcgaagugaaggggcuaacaaaaggaggccccgggcacgaggaaccuauuccaaugucuacguauggauggaaucugguacgacuccaaucaggcguggaugucuucuuuacaccaccugagaagugcgacacucuacugugugauaucggugagagcuccccaaaccccacaauugaagccgggagaaccuugaggguucugagucucguggagaauuggcuuaacaaugacacucaguucugcaucaaaguccugaacccguacaugccuucugugauagaaaagauggagacauugcagcggaaguacggaggcgcucugguacgcaauccacucagcagaaacucaacccaugaaauguauuggguguccaaugccacgggcaacauuguuaguagcgugaauaugaucucuaggauguuaaucaaccgauuuaccaugaaacacaagaaagcaacauacgagcccgacgucgaucugggguccggaacucggaauauugguauagagucagaaaucccuaaccuugacauuaucggcaagcguauugagaaaaucaagcaggaacacgagaccagcuggcauuaugaucaagaccacccauacaagacaugggccuaucaugggucguacgaaacuaaacagaccggaucugcuaguuccauggugaauggcgucgugagacugcuaacaaagcccugggauguuguaccgauggugacccagauggcgaugacugacacgacaccuuucggucagcaacgcgucuuuaaagagaagguggauaccaggacucaggagcccaaagaagggaccaagaagcucaugaaaauaacagccgaguggcuguggaaggaauugggcaaaaagaaaacgccacggauguguaccagagaggaguucacucgcaagguuaggagcaacgcagcucugggcgccaucuuuacagacgaaaacaaauggaagucagcacgagaggccguggaagauucccgguucugggagcucgucgacaaggaaagaaaucuucaccuggagggcaaaugcgagaccuguguguauaacaugauggggaagagggagaaaaaguuaggagaguuugguaaagcuaagggcucucgcgccauuugguacauguggcugggggcgcguuucuuggaauuugaggcacucggauuccugaaugaagaucacugguuuagccgggagaacagucuauccggcguagagggugaagggcuucauaagcugggauacauccucagagacgugagcaaaaaggagggcggcgccauguaugcugacgauacugccgggugggacacaaggauuacccuggaagauuugaaaaaugaggaaaugguuacaaaccacauggagggagagcauaagaaacuggcagaagcuaucuucaagcucacuuaccagaauaaggucgugcgcgugcagcgaccuacaccccgggguacggucauggacauuauaucuagaagggaucaacgcggcucagggcagguuggaaccuauggccuuaacacauucacuaauauggaggcccagcugaucagacaaauggaaggugaggggauuuuuaaaaguauccagcacuuaaccgugacagaggaaaucgcuguacagaacuggcuggcccgggugggaagggagcguuugucccgaauggcaauuagcggcgacgauugcgucgugaagccacucgacgaucgcuucgcgucugcccugacugcucuaaaugacaugggcaaaguuagaaaggauauacagcaaugggaacccucgcggggguggaacgacuggacccaggugccuuuuugcucacaucacuuccacgagcuuaucaugaaagauggaaggguccuggugguaccaugucgcaaucaggacgaacucauugguagagcccggaucagccagggcgcaggguggucccugaaggagacggcuugcuugggaaagaguuacgcccaaauguggucuuuaauguauuuucauaggcgagaccugcgucucgcagccaacgcgauuuguagcgcuguuccgucccacugggugcccacaucaagaaccacuuggaguauccaugccaaacacgaguggaugacaaccgaagauaugcuuacugucuggaaucgcguguggauacaggagaacccuuggauggaagacaagaccccaguggagucuugggaagagguccccuaccugggcaaacgggaggaucaguggugcgguagccuaaucgggcugacauccagggcaacgugggccaagaacauucagaccgcuaucaaucaaguuagaucacucauuggaaacgaagaguauacugacuacaugccuagcaugaaacgcuuccggagggaagaggaagaggccggcguguugugguga

SEQ ID NO: 14923 - RNA, 9876 nt, Artificial Sequence
  derived and/or modified CDS sequence (opt3) from DENV-2__FM210244__SS-prME
accgccggcgugaucauuaugcugauacccacagcuauggcauuccaccucacuacgaggaacggggaaccucauaugaucgucgggaggcaggaaaaggguaaaagccuucuguuuaagaccgaagacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagaccagaacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuuggugaacagucuggucacugcuggacacggccagauagauaauuuuagcuuaggugugcucggcauggcacuguuccuugaagagaugcugcgcacacgaguugggaccaaacaugccaucuugcucguggcuguaucguuugucacucugauuacaggaaacauguccuuccgggaccuaggccgugugauggugauggucggggccgcaaugaccgaugacaucggaauuggcguuacguaccuggcgcuccuggccgcuuuuaaggugagaccuacuuucgccgcaggucuuuugcugaggaaauuaaccucuaaggagcucaugauggcuacaaucgggauagcccugcuuagccagucaaccauccccgaaacuauucuggagcuaacagaugcacucgcccugggaaugaugguauugaaaaucgugcgcaauauggaaaaguaucaacuggcugucaccauuauggcgaucaguugcgugccaaacgccguuauauuacagaaugcauggaagguguccuguacaauucucgcuacugucucugugagcccucugcuucugaccuccucacagcagaaagccgacuggauccccuuggcccucacgaucaagggccugaacccaacagcuauuuuucuaaccacucugagccggaccaguaaaaagagaucuuggccgcuuaaugaggcaauaauggccguuggcaugguguccauccucgcgagcucgcuguugaaaaacgacauuccuaugacagggccccuggucgcuggagguuuacucacuguaugcuacgugcugaccggcaggucagccgaucuugaacuggagcgagcaacggacguuaagugggaggaucaagccgaaaucucugggaguuccccaauuuugagcaucacaauagcugaggacggaucuaugagcaucaaaaaugaagaggaggaacagacccucacuauucugauccgcacaggccuacuggugauuuccggucuuuuccccgucucaaucccuauaaccgcagccgcgugguaucucugggaggugaagaagcagcgggcugggguacugugggaugugccaagucccccuccggucggaaaagccgaauuggaggacggcgcauacagaauuaagcagaaaggcaucuuaggguauagccaaaucggagccgguguuuacaaggaaggcacuuuucacacaauguggcacgugaccagaggggcugugcugaugcaucguggaaaacgcauugagccaucuugggccgaugucaagaaggaccucaucuccuacggcgguggguggaaacuggagggagaauggaaggagggcgaagaggugcagguucuugcacuggaacccggcaaaaacccucgggcuguacagacgaagccaggguuguucaaaacuaauaccggaacaauaggugccgugucacuagauuuuagucccggcaccagcggguccccuauugucgacagaaagggaaaggugguuggccuguaugguaacgggguggucacaaggucuggagcguacgugucggccaucgcacagacugagaaaagcauugaggauaauccggaaaucgaggacgauauauuccgaaagaaacggcucaccauuauggaccugcaccccggcgcuggcaagacgaaacgcuaucuuccagccaucguaagagaagcuaucaagaggggguuacggacacugauucucgcaccuacucgagucguggccgccgagauggaagaggcuuugagaggacugcccauccgcuaccaaaccccagcgauuagggcagagcauacaggucgugaaauaguugaccucaugugucacgccaccuucacuaugcggcugcuuucaccugugagaguccccaacuauaaccugaucauuauggaugaggcucauuuuaccgacccagccuccaucgcagccaggggcuacaucaguacacgcguggaaaugggggaggcugcgggaauuuucaugacggccacuccgccuggcucuaaggaucccuuuccacagagcaaugcacccauaauggacgaggaacgagagaucccugaaagauccuggaacucaggucacgaguggguuaccgauuucaaagggaagacagugugguuugucccaucuauuaaagcuggaaaugacaucgccgcaugcuugcggaagaacggcaaaaaggugauucagcuaagcaggaagaccuucgauagugaauauguaaaaacucgcacaaaugacugggauuuugugguuaccacggacaucuccgagaugggcgccaacuucaaggcugagcgugucauagaucccagacgguguaugaaaccugugauccugacugacggggaagagagggugauucucgccggaccgaugccagucacacacagcucugcggcacaacgccgagguagaaucggccggaaucccaagaacgaaaaugaccaguacauuuacaugggggagccuuuagaaaacgaugaggacugcgcccauuggaaagaggcuaagaugcugcuugauaauaucaacacccccgaaggaauaauuccaucaauguuugagccugaaagggagaaaguagacgccaucgauggcgaauaucgccugagaggugaggcuaggaagaccuucguggaccucaugcggcguggggauuugcccguuuggcuggcauaccgcguggccgcugagggcauuaauuaugccgaccgaagaugguguuuugauggagucaagaacaaucagauccucgaagagaacguggaaguugagauauggacuaaagagggcgaaaggaagaaacugaagccacgguggcuugacgcacgcaucuacuccgauccucuagcgcugaaagaguucaaggaguucgccgcugggagaaagaguuugacauuaaaccugauuaccgagaugggaaggcucccgacauuuaugacucagaaagcccgggacgcacuggauaaucuugcugugcugcacacggccgaagcagggggaaaggccuauaaccaugcucucagcgaguugcccgagacccuggaaacacuacugcuccuuacucuguuagcgaccgucacagggggaaucuucuuguuucugaugucgggcaaagguguggggaagaugacccucggcaugugcugcauuaucacugccucuauacugcuuuggcacgcacaaauucagccacacuggaucgcugccuccaucauucuggaguucuuucucaucguauugcugauaccugaacccgagaaacagcgaacgccacaggacaaucaauuaaccuacgugguuauugccauccuaacagucguggcagcuacuauggccaacgaaaugggauuccuggagaagaccaagaaagaccucggccuugggagcauugcgacacaggagccugaaucaaauauccuggauauagacuugagacccgcuagugccuggacccuguaugcaguggccacuacauuugucacgccgaugcuccgccauucuaucgagaacuccagcguuaaugugucacugaccgcuauugcaaaccaggccacuguacuuaugggacucgguaagggcuggccacugaguaaaauggauaucggggugccuuugcuggcgauuggauguuacagccaggucaaucccaucacauuaaccgcugcccuacugcuccuuguggcacacuacgccauuaucggcccaggucugcaagcuaaggccaccagggaagcacagaaacgggcugccgcggggauaaugaagaaccccacaguugacggcauuacugugaucgauuuggacccuaucccguaugaucccaaguucgagaaacagcugggacaggucaugcuccugauucuuugcguaacgcaaguguuaaugaugcguaccacaugggcccugugugaagcacucacuuuggcuaccggcccaauauccacacugugggaggggaauccuggaagauuuuggaacaccacuaucgccguuucuauggcaaauauuuucaggggcagcuaccuagcuggugccgggcugcucuuuuccaucaugaagaacacgacaaauacccgccggggaacuggcaacauuggugagacccuuggcgaaaaauggaagucacgacugaaugccuuggggaaaucugaguuccagaucuauaagaaaaguggaauacaggaaguggacagaacacuggcgaaggagggcaucaagaggggugaaacugaucaucacgcugucucgcgcggaagcgcaaaacuccggugguuuguggaaagaaacauggucacccccgagggcaaggugguugaccuggguugcgggcguggaggcugguccuacuauugugguggccuaaagaaugugagggaaguaaaggggcuuacaaaaggaggcccugggcaugaggaaccaauucccaugucuacguacggauggaaucuggugcggcuccaaucaggcgucgauguuuucuucaccccuccagagaagugcgacacucuacugugugauaucggugagagcucccccaacccgacaauugaagccgggcgcaccuugcgagugcugagucucgucgagaauuggcuuaacaaugacacucaguuuugcaucaaggugcugaacccuuauaugccaucuguaauagagaaaauggagacauugcagagaaaguacggaggcgcucuggugaggaauccccucagccggaacucaacccacgaaauguacuggguuuccaaugccacgggcaacauugugaguagcgucaauaugaucucucgcauguuaaucaacagauucaccaugaaacacaagaaagcaacauaugagccugacguggaucugggguccggaacuaggaauauugguauagagucagaaaugccaaaccuugacaucauuggcaagcgaaucgagaagauuaaacaggaacaugagaccagcuggcacuacgaucaagaccaucccuauaagacaugggccuaccacgggucguaugaaacuaaacagaccggaucugcuaguuccauggucaauggcgugguucggcugcuaacaaagccgugggauguagugccuauggucacccagauggcgaugacugacacgacacccuuuggucagcaacguguguucaaagagaagguugauaccagaacucaggagccaaaggaagggaccaaaaagcucaugaaaaucacagccgaguggcuguggaaggaauugggcaaaaagaaaacgccucgcauguguaccagggaggaguuuacucggaaggugagaagcaacgcagcucugggcgccauauucacagacgaaaacaaguggaaaucagcacgcgaggccgucgaagauuccagguuuugggagcucguggacaaggaacgaaaucuucaccuggagggcaaaugcgagaccuguguauacaacaugauggggaagcgggagaaaaaguuaggagaguucgguaaggcuaaaggcucuagagccaucugguauauguggcugggggcgagguuuuuggaguucgaggcacucggauuucugaaugaagaucauugguucagccgcgagaacagucuauccggcguggagggugaagggcuucacaagcugggauacauucuccgugacguuagcaaaaaggagggcggcgccauguacgcugacgauacugccgggugggacacacggaucacccuggaagauuugaaaaaugaggaaauggucacaaaccauauggagggagagcacaagaagcuggcagaagcuauuuuuaaacucacuuaucagaauaagguggugagaguccagaggcccaccccacgcgguacgguuauggacaucauuucucgacgggaucaaagaggcucaggacaggugggaaccuacggccuuaacacauucacuaauauggaggcccagcugauaaggcaaauggaaggugaggggaucuucaaaaguauucagcauuuaaccguaacagaggaaaucgcugugcagaacuggcuggcccgcgucggaagagagcgguuguccaggauggcaaucagcggcgacgauugcgugguuaagccccucgacgaucguuuugcgucugcccugacugcucuaaaugacaugggcaaagugcgaaaggauauucagcaaugggaaccuucgcgcggguggaacgacuggacccaggucccauucugcucacaccacuuucaugagcuuauaaugaaggauggaagagugcugguaguuccgugucggaaucaggacgaacucaucgguagggcccgcauuagccagggcgcaggguggucccugaaagagacggcuugcuugggaaagaguuaugcccaaauguggucuuuaauguacuuccacagacgggaccugaggcucgcagccaacgcgaucuguagcgcugugcccucccauugggucccuacaucacgaaccacuuggaguauucacgccaaacacgaguggaugacaaccgaagauaugcuuacuguguggaaucguguguggauccaggagaacccauggauggaagacaagacccccgucgagucuugggaagagguuccuuaucugggcaaaagagaggaucaguggugcgguagccuaauagggcugacaucccgcgcaacgugggccaagaacauccagaccgcuauuaaucaagugcggucacucaucggaaacgaagaguacacugacuauaugccaagcaugaagagguuuagacgcgaagaggaagaggccggcguauugugguga

SEQ ID NO: 14924 - RNA, 9876 nt, Artificial Sequence
  derived and/or modified CDS sequence (opt3) from DENV-2__FM210234__SS-prME
accgccggcgugaucauuaugcugauacccacagcuauggcauuccaccucacuacgaggaacggggaaccucauaugaucgucggaaggcaggaaaaggguaaaagccuucuguuuaagaccgaagacggcguuaauaugugcacauugauggccauugauuuaggggaacugugugaagacacuaucaccuacaaaugcccauuacuccggcaaaacgaaccggaagauauugacuguuggugcaauuccacaucuaccugggugacuuauggaacauguaccacgacuggcgaacaccgccgagaaaagcguucaguagcgcuggugccccaugucgguauggggcuugagacccguacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugagaugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaagaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacgggaaaggacucucccgugaacaucgaagccgagccaccuuuuggcgauuccuacaucauuauaggggucgaacccggacaguuaaaacugaauugguucaagaaggguagcucgaucggccaaauguuugagaccacaaugcgaggggcaaaacgcauggccauucuaggagacacugcuugggauuucggcucucucggugggguguuuaccuccaucggcaaggcgcugcaccagguuuucggagcaauuuacggcgccgcuuuuucaggggugaguuggacaaugaaaauccuuauaggaguaaucauuacuuggaucggcaugaacagcagauccaccucuuugagcgucucacuggugcucguuggugugauuacgcuguaucuuggggccaugguccaggcagacaguggaugugugguauccuggaagaauaaagagcugaagugcggcagcgguaucuucauaacagauaacgugcacaccuggacugaacaguacaaguuucaaccagagucucccucaaaauuggccagugcuauucagaaggcccaugaagagggcaucugugggauuaggagcguuacacggcucgaaaaucugauguggaaacagaucaccccugaguuaaaccacauacuguccgagaaugaagucaagcuaacuaucaugaccggagacauuaaaggcaucaugcaggcagggaagcgcucucucagaccacaaccgacagagcugaaauauucguggaagacguggggaaaggcgaaaaugcuuagcaccgaaucccauaaccagacuuucuugauugauggccccgagacagcugaaugcccuaauaccaacagggccuggaacucacuggagguggaggacuacgguuuugggguguucacaacuaacaucuggcucaagcugcgugaaaaacaggacgucuuuugugauaguaaguuaaugucugcagccauaaaagacaaucgggcuguucacgccgauaugggauauuggauugagagcgcacugaacgacaccuggaagauggaaaaggcuuccuucaucgaggugaaaucaugccacuggccaaagagccauacgcuuuggucuaauggcguguuggaguccgaaaugaucauucccaaaaguuucgccgguccuguaagccagcacaacuaccgaccaggcuauuacacacaaaccgcggggcccuggcaucucggaaagcuggagauggauuuugacuucugugaaggcacuaccgucgugguuacagaggauugcgggaacagaggaccgucucuaaggacuaccacagccuccggcaaacugaucacggaauggugcugucgcucaugcacccucccuccacugcgguacagaggugaggacggguguugguauggaauggagauuaggccccuuaaggaaaaggaggaaaauuuggugaacagucuggucacugcuggccacggucagauagauaauuuuagcuuaggcgugcucgggaucgcacuguuccuugaggaaaugcugcgcacacgaguuggaaccaaacaugccauuuugcucguggcuguaucguuugucacucugaucacaggcaacauguccuuccgggaccuagggcgugugauggugauggucggagccgcaaugaccgaugacauuggcauggguguuacguaccuggcgcuccuggccgcuuuuaaggugagaccuacuuucgccgcagggcuuuugcugaggaaauuaaccucuaaggagcucaugauggcuacaaucggaauagcccugcuuagccagucaaccauccccgagacuauucuggaacuaacagaugcacucgcccugggcaugaugguauugaaaaucgugcgcaauauggagaaguaucaacuggcugucaccauuauggcgaucaguugcgugccaaacgccguuauauuacagaaugcauggaagguguccuguacaauucucgcuacugucucugugagcccucugcuucugaccuccucacagcagaaagccgacuggauccccuuggcccucacgaucaagggccugaacccaacagcuauuuuucuaaccacucugagccggaccaguaaaaagagaucuuggccgcuuaaugaagcaauaauggccguugggaugguguccauccucgcgagcucgcuguugaaaaacgacauuccuaugacaggaccccuggucgcugguggcuuacucacuguaugcuacgugcugaccgggaggucagccgaucuugagcuggaacgagcaacggacguuaagugggaggaucaagccgagaucucuggaaguuccccaauuuugagcaucacaauagcugaagacggcucuaugagcaucaaaaaugaggaagaggagcagacccucacuauucugauccgcacaggucuacuggugauuuccgggcuuuuccccgucucaaucccuauaaccgcagccgcgugguaucucugggaagugaagaagcagcgggcuggaguacugugggaugugccaagucccccuccggucggcaaagccgaguuggaagacggcgcauacagaauuaagcagaaagggaucuuaggauauagccaaaucggugccggcguuuacaaggaggggacuuuucacacaauguggcacgugaccaggggagcugugcugaugcaucguggcaaacgcauugaaccaucuugggccgaugucaagaaggaccucaucuccuacggugggggauggaaacuggagggcgaguggaaggaaggcgaggaagugcagguucuugcacuggagcccgggaaaaacccucgggcuguacagacgaagccaggauuguucaaaacuaauaccgguacaauaggcgccgugucacuagauuuuagucccgggaccagcggauccccuauugucgacagaaagggcaaggugguuggucuguaugggaacggaguggucacaaggucuggcgcguacgugucggccaucgcacagacugagaaaagcauugaggauaauccggagaucgaagacgauauauuccgaaagaaacggcucaccauuauggaccugcaccccggcgcugggaagacgaaacgcuaucuuccagccaucguaagagaggcuaucaagaggggauuacggacacugauucucgcaccuacucgagucguggccgccgaaauggaggaggcuuugagaggucugcccauccgcuaccaaaccccagcgauuagggcagagcauacaggccgugagauaguugaccucaugugucacgccaccuucacuaugcggcugcuuucaccugugagaguccccaacuauaaccugaucauuauggaugaagcucauuuuaccgacccagccuccaucgcagccaggggguacaucaguacacgcguggagaugggagaagcugcgggcauuuucaugacggccacuccgccugguucucgagaucccuuuccacagagcaaugcacccauaauggacgaggagagagaaaucccugagcgguccuggaacucagggcacgaauggguuaccgauuucaagggaaaaacagugugguuugucccaucuauuaaggcuggcaaugacaucgccgcaugcuugaggaaaaacggcaagaaagugauucagcuaagccgcaagaccuucgauagugaguauguaaagacucguacaaaugacugggauuuugugguuaccacggacaucuccgaaaugggggccaacuucaaagcugagagagucauagauccccggagguguaugaagccugugauccugacugacggagaggaacgcgugauucucgccgguccgaugccagucacacacagcucugcggcacaacgaagaggccggaucgggaggaaucccaaaaacgagaaugaccaguacauuuacaugggagaaccuuuagagaacgaugaagacugcgcccauuggaaggaggcuaaaaugcugcuugauaauaucaacacccccgagggcauaauuccaucaauguuugaaccugagcgcgaaaagguagacgccaucgauggugaguauagacugagaggggaagcucggaaaaccuucguggaccucaugcgucgcggcgauuugcccguuuggcuggcauaccgaguggccgcugagggaauuaauuaugccgacagaaggugguguuuugauggcgucaagaacaaucagauccucgaggaaaacguggagguugaaauauggacuaaggagggggagcggaaaaagcugaaaccacgcuggcuugacgcaagaaucuacuccgauccucuagcgcugaaggaguucaaagaguucgccgcuggaaggaagaguuugacauuaaaccugauuaccgaaaugggucggcucccgacauuuaugacucagaaggcccgagacgcacuggauaaucuugcugugcugcacacggccgaggcaggcgggagagccuauaaccaugcucucagcgaauugcccgagacccuggagacacuacugcuccuuacucuguuagcgaccgucacaggaggcaucuucuuguuucugaugucggguaaaggggugggcaagaugacccucggaaugugcugcauuaucacugccucuauacugcuuuggcacgcacaaauucagccacacuggaucgcugccuccaucauucuggaguucuuucucaucguauugcugauaccugagcccgaaaaacagcgcacgccacaggacaaucaauuaaccuacgugguuauugccauccuaacagucguggcagcuacuauggccaacgagaugggcuuccuggaaaagaccaaaaaggaccucgggcuuggaagcauugcgacacaggagccugagucaaauauccuggauauagacuugaggcccgcuagugccuggacccuguaugcaguggccacuacauuugucacgccgaugcuccggcauucuaucgaaaacuccagcguuaaugugucacugaccgcuauugcaaaccaggccacuguacuuaugggucucggcaagggguggccacugaguaaaauggauaucggagugccuuugcuggcgauuggcuguuacagccaggucaaucccaucacauuaaccgcugcccuacugcuccuuguggcacacuacgccauuaucgguccagggcugcaagcuaaggccacccgugaggcacagaaaagagcugccgcgggcauaaugaagaaccccacaguugacggaauuacugugaucgauuuggacccuaucccguaugaucccaaauucgaaaagcagcugggccaggucaugcuccugauucuuugcguaacgcaaguguuaaugaugaggaccacaugggcccugugugaggcacucacuuuggcuaccgggccaauauccacacugugggaaggaaauccuggccgcuuuuggaacaccacuaucgccguuucuauggcaaauauuuuccgggguagcuaccuagcuggggccggacugcucuuuuccaucaugaagaacacgacaaauacccgaagaggcacugguaacauuggcgagacccuuggggagaaauggaagucaaggcugaaugccuugggaaaaucugaguuccagaucuauaagaaaaguggcauacaggagguggaccgcacacuggcgaaggaagggaucaaacggggagagacugaucaucacgcugucucgagaggcagcgcaaagcuccguugguuuguggagaggaacauggucacccccgaagguaaggugguugaccuggggugcggacggggcgguugguccuacuauuguggcgggcuaaagaaugugcgcgagguaaagggacuuacaaaaggcgggccuggacaugaagaaccaauucccaugucuacguacggcuggaaucuggugcgacuccaaucaggugucgauguuuucuucaccccuccagaaaagugcgacacucuacugugugauaucggggagagcucccccaacccgacaauugaggccggaagaaccuugagggugcugagucucgucgaaaauuggcuuaacaaugacacucaguuuugcaucaaagugcugaacccuuauaugccaucuguaauagagaagauggaaacauugcagcggaaguacggcggcgcucuggugcgcaauccccucagcagaaacucaacccacgagauguacuggguuuccaaugccacggggaacauugugaguagcgucaauaugaucucuaggauguuaaucaaccgauucaccaugaaacacaagaaagcaacauaugaaccugacguggaucugggauccgguacucggaauauuggcauagagucagagaucccaaaccuugacauuaucgggaagcguauugagaaaaucaagcaggagcaugaaaccagcuggcacuacgaucaagaccaucccuauaagacaugggccuaccacggaucguaugagacuaaacagaccggcucugcuaguuccauggucaauggugugguuagacugcuaacaaagccgugggauguagugccuauggucacccagauggcgaugacugacacgacacccuuugggcagcaacgcguguucaaagaaaagguugauaccaggacucaggagccaaaagagggaaccaagaagcucaugaaaauaacagccgaauggcuguggaaggaguugggcaaaaagaaaacgccucggauguguaccagagaagaguuuacucgcaaggugaggagcaacgcagcucugggcgccaucuucacagacgagaacaaauggaagucagcacgagaagccgucgaggauucccgguuuugggaacucguggacaaggagagaaaucuucaccuggaagggaaaugcgagaccuguguauacaacaugaugggaaagagggagaaaaaguuaggugaguucggcaaagcuaaggggucucgcgccauuugguauauguggcugggagcgagauuuuuggaguucgaagcacucggcuuucugaaugaggaucauugguucagccgggaaaacagucuauccgguguggagggggagggacuucacaagcugggcuacauccucagagacguuagcaaaaaggaaggcggggccauguacgcugacgauacugccggaugggacacaaggauuacccuggaggauuugaaaaaugaagagauggucacaaaccauauggaaggugagcacaagaaacuggcagaggcuaucuuuaagcucacuuaucagaauaagguggugcgcguccagcgacccaccccacggggcacgguuauggacauuauaucuagaagggaucaacgcgggucaggacaggugggcaccuacggucuuaacacauucacuaauauggaagcccagcugaucagacaaauggagggggaaggaauuuucaaaaguauccagcauuuaaccguaacagaggagaucgcugugcagaacuggcuggcccgggucggcagggaacguuugucccgaauggcaauuagcggcgacgauugcgugguuaagccccucgacgaucgcuuugcgucugcccugacugcucuaaaugacauggggaaagugagaaaggauauacagcaaugggagccuucgcggggauggaacgacuggacccaggucccauucugcucacaccacuuucaugaacuuaucaugaaagaugguagggugcugguaguuccgugucgcaaucaggacgagcucauuggcagagcccggaucagccagggggcaggauggucccugaaggaaacggcuugcuugggcaagaguuaugcccaaauguggucuuuaauguacuuccacaggcgagaccugcgucucgcagccaacgcgauuuguagcgcugugcccucccauugggucccuacaucaagaaccacuuggaguauccacgccaaacacgaguggaugacaaccgaggauaugcuuacuguguggaaucgcguguggauacaggaaaacccauggauggaggacaagacccccgucgaaucuugggaggaaguuccuuaucuggguaaacgggaggaucaguggugcgggagccuaaucggacugacauccagggcaacgugggccaagaacauucagaccgcuaucaaucaagugagaucacucauuggcaacgaggaauacacugacuauaugccaagcaugaaacgcuuucggagggaggaagaggaagccggcguauugugguga

SEQ ID NO: 14925 - RNA, 9876 nt, Artificial Sequence
  derived and/or modified CDS sequence (opt3) from DENV-2__FM210213__SS-prME
accgccggcgugauaauuaugcugauacccacagcuauggcauuccaccucacuacgaggaauggggagccucauaugaucgucgggaggcaggaaaaggguaaaagccuucuguuuaagaccgaggacggcguuaauaugugcacauugauggccauugauuuaggggaacugugugaggacacuaucaccuacaaaugcccauuacuccggcaaaacgaaccggaggauauugacuguuggugcaauuccacaucuaccugggugacuuauggaacauguaccacgacuggcgagcaccgccgagaaaagcguucaguagcgcuggugccccaugucgguauggggcuugagacccggacagaaacuuggaugaguagcgagggagcuuggaaacacgcccagaggaucgagaccuggauacugcggcauccuggcuucacaaucauggcagccauuuuggcuuacaccgugggcacgacucacuuucagcgcgcacucaucuucauucugcuggccgcuguugccccauccaugacaaugcguugcaucgggauaucuaacagggauuuuguggaaggagucucggguggcucauggguggacauuguacucgagcacgggagcuguguuaccacuauggcgaagaauaagcccacauuagauuucgaacugaucaaaaccgaggcaaagcagccugccacgcuucggaaauauugcauugaagcuaaguugaccaacacaacuaccgagagucgcuguccaacacaaggagagcccucccugaaugaggaacaggacaaacgauuugugugcaagcauucuauggucgauagaggcugggguaacggguguggacuauucggcaagggcgggaucgugacuugcgccauguuuaccugcaaaaagaauauggaaggaaaaaucgugcagccugagaaccucgaauacacaauugucauaaccccacacagcggugaggagcaugcaguuggcaaugacacugggaagcacggaaaagaaaucaagauuacgccgcagucccccaucacagaggcugaacugaccggcuaugguacugugaccauggaguguucaccuaggacagggcuugauuucaacgaaaugguacuguugcaaauggaggacaaagccuggcucgugcaccggcagugguuucuggauuuaccacugcccuggcucccuggcgcggacacccagggaaguaauuggauacagaaggagacucuugucacauucaagaacccacaugccaaaaagcaagacgugguugugcugggcagccaggaaggggcaaugcacacggcuuugaccggagccacugagauucagaugucuuccgguaaucuacuguuuacaggccaucucaaaugccgucugcgcauggauaaacuucaacugaaagggaugucauacagcauguguaccggaaaguucaagaucgucaaagaaaucgcugagacacagcacggcacuauugugaucagaguacaguaugagggugacgggagucccugcaagauuccguucgaaauaauggauuuggagaaaaggcauguucucggccggcugaucaccgugaacccuauugucacggaaaaggacucucccgugaacaucgaggccgaaccaccuuuuggagauuccuacaucauuauaggcgucgagcccgggcaguuaaaacugaauugguucaagaagggaagcucgaucggucaaauguuugagaccacaaugcgaggcgcaaaacgcauggccauucuaggggacacugcuugggauuucggaucucucggcgguguguuuaccuccaucgggaaggcgcugcaccagguuuucggcgcaauuuacggagccgcuuuuucaggcgugaguuggacaaugaaaauccuuauagggguaaucauuacuuggaucggaaugaacagcagauccaccucuuugagcgucucacuggugcucguuggcgugauuacgcuguaucuuggugccaugguccaggcagacagugggugugugguauccuggaagaauaaagaacugaagugcggaagcggcaucuucauaacagauaacgugcacaccuggacugagcaguacaaguuucaaccagaaucucccucaaaauuggccagugcuauucagaaggcccaugaggaagguaucuguggcauuaggagcguuacacggcucgagaaucugauguggaaacagaucaccccugaguuaaaccacauacuguccgaaaaugaggucaagcuaacuaucaugaccggggacauuaaaggaaucaugcaggcaggcaagcgcucucucagaccacaaccgacagaacugaaauauucguggaagacgugggggaaggcgaaaaugcuuagcaccgagucccauaaccagacuuucuugauugauggacccgaaacagcugagugcccuaauaccaacagggccuggaacucacuggagguggaagacuacggcuuugguguguucacaacuaacaucuggcucaagcugcgugagaaacaggacgucuuuugugauaguaaguuaaugucugcagccauaaaagacaaucgggcuguucacgccgauaugggguauuggauugaaagcgcacugaacgacaccuggaagauggagaaggcuuccuucaucgaggugaaaucaugccacuggccaaagagccauacgcuuuggucuaauggaguguuggaauccgagaugaucauucccaaaaguuucgccggcccuguaagccagcacaacuaccgaccagguuauuacacacaaaccgcgggccccuggcaucucgggaagcuggaaauggauuuugacuucugugagggaacuaccgucgugguuacagaagauugcggcaacagagggccgucucuaaggacuaccacagccuccggaaaacugaucacggaguggugcugucgcucaugcacccucccuccacugcgguacagaggcgaggacgguuguugguaugggauggaaauuaggccccuuaaggagaaggaagagaauuuggugaacagucuggucacugcuggacacggccagauagauaauuuuagcuuaggugugcucggcauggcacuguuccuugaagagaugcugcgcacacgaguugggaccaaacaugccaucuugcucguggcuguaucguuugucacucugauuacaggaaacauguccuuccgggaccuaggccgugugauggugauggucggggccgcaaugaccgaugacaucggaaugggcguuacguaccuggcgcuccuggccgcuuuuaaggugagaccuacuuucgccgcaggucuuuugcugaggaaauuaaccucuaaggagcucaugauggcuacaauugggaucgcccugcuuagccagucaaccauacccgaaacuauccuggagcuaacagaugcacucgcccugggaaugaugguauugaaaauugugcgcaauauggaaaaguaucaacuggcugucaccaucauggcgauuaguugcgugccaaacgccguuaucuuacagaaugcauggaagguguccuguacaauacucgcuacugucucugugagcccucugcuucugaccuccucacagcagaaagccgacuggauucccuuggcccucacgaucaagggccugaacccaacagcuaucuuucuaaccacucugagccggaccaguaaaaagagaucuuggccgcuuaaugaggcaauuauggccguuggcaugguguccauacucgcgagcucgcuguugaaaaacgacaucccuaugacagggccccuggucgcuggagguuuacucacuguaugcuacgugcugaccggcaggucagccgaucuugaacuggagcgagcaacggacguuaagugggaggaucaagccgaaauuucugggaguuccccaaucuugagcauuacaaucgcugaggacggaucuaugagcaucaagaaugaagaggaggaacagacccucacuauccugauucgcacaggccuacuggugaucuccggucuuuuccccgucucaauuccuaucaccgcagccgcgugguaucucugggaggugaagaagcagcgggcugggguacugugggaugugccaagucccccuccggucggaaaagccgaauuggaggacggcgcauacagaauaaagcagaaaggcauuuuaggguauagccaaaucggagccgguguuuacaaggaaggcacuuuucacacaauguggcacgugaccagaggggcugugcugaugcaucguggaaaacgcaucgagccaucuugggccgaugucaagaaggaccucauuuccuacggcgguggguggaaacuggagggagaauggaaggagggcgaagaggugcagguucuugcacuggaacccggcaaaaacccucgggcuguacagacgaagccaggguuguucaaaacuaauaccggaacaaucggugccgugucacuagauuuuagucccggcaccagcggguccccuauagucgacagaaagggaaaggugguuggccuguaugguaacgggguggucacaaggucuggagcguacgugucggccauugcacagacugagaaaagcaucgaggauaauccggaaauugaggacgauaucuuccgaaagaaacggcucaccauaauggaccugcaccccggcgcuggcaagacgaaacgcuaucuuccagccauuguaagagaagcuaucaagaggggguuacggacacugauccucgcaccuacucgagucguggccgccgagauggaagaggcuuugagaggacugcccauucgcuaccaaaccccagcgaucagggcagagcauacaggucgugaaauuguugaccucaugugucacgccaccuucacuaugcggcugcuuucaccugugagaguccccaacuauaaccugauaaucauggaugaggcucauuuuaccgacccagccuccauugcagccaggggcuacaucaguacacgcguggaaaugggggaggcugcgggaaucuucaugacggccacuccgccuggcucucgagaucccuuuccacagagcaaugcacccauuauggacgaggaaagagagauaccugaacgguccuggaacucaggucacgaguggguuaccgauuucaaggggaaaacagugugguuugucccaucuaucaaggcuggaaaugacauugccgcaugcuugaggaaaaacggcaagaaagugauccagcuaagccgcaagaccuucgauagugaauauguaaagacucguacaaaugacugggauuuugugguuaccacggacauuuccgagaugggcgccaacuucaaagcugagagagucaucgauccccggagguguaugaagccugugauacugacugacggggaagaacgcgugauccucgccggaccgaugccagucacacacagcucugcggcacaacgaagaggucggauuggcaggaaucccaaaaacgaaaaugaccaguacaucuacaugggggagccuuuagaaaacgaugaggacugcgcccauuggaaggaggcuaaaaugcugcuugauaauauuaacacccccgaaggaaucauaccaucaauguuugagccugaacgcgagaagguagacgccauugauggcgaauauagacugaggggugaggcucggaaaaccuucguggaccucaugcgucgcggggauuugcccguuuggcuggcauaccgaguggccgcugagggcaucaauuaugccgacagaaggugguguuuugauggagucaagaacaaucagauucucgaagagaacguggaaguugagaucuggacuaaggagggcgaacggaaaaagcugaaaccacgcuggcuugacgcaagaauauacuccgauccucuagcgcugaaggaguucaaagaguucgccgcugggaggaagaguuugacauuaaaccugaucaccgagaugggacggcucccgacauuuaugacucagaaggcccgaaaugcacuggacaaccuugcugugcugcacacggccgaagcaggagguagagccuauaaucaugcucucagcgaguugcccgagacccuggaaacacuacugcuccuuacucuguuagcgaccgucacagggggaauuuucuuguuucugaugucgggcaaagguguggggaagaugacccucggcaugugcugcaucauuacugccucuauccugcuuuggcacgcacaaauacagccacacuggauugcugccuccaucauccuggaguucuuucucauuguauugcugaucccugaacccgagaaacagcgcacgccacaggauaaccaauuaaccuacgugguuauagccauucuaacagucguggcagcuacuauggccaaugaaaugggauuccuggagaagaccaaaaaggaccucggccuugggagcaucgcgacacaggagccugaaucaaacauucuggacaucgauuugaggcccgcuagugccuggacccuguaugcaguggccacuacauuugucacgccgaugcuccggcauucuauagaaaauuccagcguuaacgugucacugaccgcuaucgcaaaucaggccacuguacuuaugggacucgguaagggcuggccacugaguaaaauggacauuggggugccuuugcuggcgaucggauguuacagccaggucaaccccauuacauuaaccgcugcccuacugcuccuuguggcacacuacgccaucauuggcccaggucugcaagcuaaggccacccgugaagcacagaaaagagcugccgcggggaucaugaagaaucccacaguugauggcauaacugugauugacuuggauccuaucccguaugaccccaaauucgagaagcagcugggacaggucaugcuccugauccuuugcguaacgcaaguguuaaugaugaggaccacaugggcccugugugaagcacucacuuuggcuaccggcccaauuuccacacugugggaggggaacccuggacgcuuuuggaauaccacuauagccguuucuauggcaaacaucuuccggggcagcuaccuagcuggugccgggcugcucuuuuccauuaugaagaauacgacaaacacccgaagaggaacuggcaauaucggugagacccuuggcgaaaaauggaagucaaggcugaacgccuuggggaaaucugaguuccagauuuauaagaaaaguggaauccaggaaguggaucgcacacuggcgaaggagggcauaaaaagaggggaaacugaccaucacgcugucucgagaggaagcgcaaagcuccguugguuuguggaaaggaacauggucacccccgagggcaaggugguugaucuggguugcgggcggggaggcugguccuacuauugugguggccuuaaaaaugugcgcgaaguaaaggggcuaacaaaaggaggcccugggcaugaggaaccaauccccaugucuacguacggauggaaccuggugcgacuccaaucaggcgucgacguuuucuucaccccuccagagaagugcgauacucuacugugugacauuggugagagcucccccaauccgacaaucgaagccgggagaaccuugagggugcugagucucgucgagaacuggcuuaauaacgauacucaguuuugcauuaaagugcugaauccuuauaugccaucuguaaucgaaaagauggagacauugcagcggaaguacggaggcgcucuggugcgcaacccccucagcagaaauucaacccacgaaauguacuggguuuccaacgccacgggcaauauagugaguagcgucaacaugauuucuaggauguuaaucaaucgauucaccaugaaacacaagaaagcaacauaugagccugacguggaccugggguccggaacucggaacaucgguauugagucagaaauaccaaaucuugauaucauuggcaagcguaucgagaaaauuaagcaggaacaugagaccagcuggcacuacgaccaagaucaucccuauaagacaugggccuaccacgggucguaugaaacuaaacagaccggaucugcuaguuccauggucaacggcgugguuagacugcuaacaaagccgugggacguagugccuauggucacccagauggcgaugacugauacgacacccuuuggucagcaacgcguguucaaagagaagguugacaccaggacucaggagccaaaagaagggaccaagaagcucaugaaaaucacagccgaguggcuguggaaggaauugggcaaaaagaaaacgccucggauguguaccagagaggaguuuacucgcaaggugaggagcaacgcagcucugggcgccauauucacagaugaaaauaaauggaagucagcacgagaggccgucgaagacucccgguuuugggagcucguggauaaggaaagaaaccuucaccuggagggcaaaugcgagaccuguguauacaauaugauggggaagagggagaaaaaguuaggagaguucgguaaagcuaagggcucucgcgccaucugguauauguggcugggggcgagauuuuuggaguucgaggcacucggauuucugaacgaagaccauugguucagccgggagaauagucuauccggcguggagggugaagggcuucacaagcugggauacauucucagagauguuagcaaaaaggagggcggcgccauguacgcugacgacacugccgggugggauacaaggaucacccuggaagacuugaaaaacgaggaaauggucacaaaucauauggagggagagcacaagaaacuggcagaagcuauuuuuaagcucacuuaucagaacaagguggugcgcguccagcgacccaccccacgggguacgguuauggauaucauuucuagaagggaccaacgcggcucaggacaggugggaaccuacggccuuaauacauucacuaacauggaggcccagcugauaagacaaauggaaggugaggggaucuucaaaaguauucagcauuuaaccguaacagaggaaaucgcugugcagaauuggcuggcccgggucggaagggagcguuugucccgaauggcaaucagcggcgaugacugcgugguuaagccccucgaugaccgcuuugcgucugcccugacugcucuaaacgauaugggcaaagugagaaaggacauucagcaaugggaaccuucgcggggguggaaugauuggacccaggucccauucugcucacaccacuuucaugagcuuauaaugaaagacggaagggugcugguaguuccgugucgcaaccaggaugaacucaucgguagagcccggauuagccagggcgcaggguggucccugaaggagacggcuugcuugggaaagaguuaugcccaaauguggucuuuaauguacuuccacaggcgagaccugcgucucgcagccaaugcgaucuguagcgcugugcccucccauugggucccuacaucaagaaccacuuggaguauucacgccaaacacgaguggaugacaaccgaagacaugcuuacuguguggaaccgcguguggauccaggagaacccauggauggaagauaagacccccgucgagucuugggaagagguuccuuaucugggcaaacgggaggaccaguggugcgguagccuaauagggcugacauccagggcaacgugggccaagaauauccagaccgcuauuaaccaagugagaucacucaucggaaaugaagaguacacugauuauaugccaagcaugaaacgcuuucggagggaagaggaagaggccggcguauugugguga
